United States Patent 11,602,557 (BUNYAVIRALES VACCINE) - sequence listing, part 13

SEQ ID NO: 14483 - RNA, 3480 nt, Artificial Sequence
  derived and/or modified CDS sequence (opt5) from RVFV(2008/00101)__HE687306.1__NSm-Gn-Gc
augaucgagggcgccugggacagccugagagaagaggaaaugcccgaggaacucuccugcucugugagcgggauucgggaggucaagaccuccucucaggagcuguaccgcgcucuuaaagccaucauugcggcugauggacugaacaauaucacaugucacggcaagaacccugaagacaaaauuagccucaucaaggggccgccccauaaaaagagaguuggaaucgugcggugcgagcgcagacgggaugccaagcaaauuggccgcgaaacgauggccgggaucgcuaugaccgugcugccugcccuugcugucuucgcccuggcgcccgugguuuuugccgaggacccucaccucagaaaucggcccggaaaaggccauaacuauauugauggcaugacacaggaggacgcuaccuguaagccugugacauacgccggggcuugcuccucuuucgauguccugcuggaaaaaggaaaguuuccccucuuccagagcuaugcccaccaucgcacccugcuugaggcggugcacgacacaaucauugccaaagcugaucccccuuccugugaccugcagagcgcccacggcaaucccugcaugaaggaaaagcucguuaugaaaacccauuguccuaacgauuaccaaucugcucacuaucugaauaacgacgggaagauggccuccgugaaaugcccgccgaaguacgagcuuacggaagauuguaauuuuugcagacagaugaccggagccagccugaaaaagggcucuuauccucuccaggaccuguucugucaguccagcgaggacgaugggucuaaacugaagacaaagaugaaaggagucugcgaggugggcgugcaagcucucaagaaaugcgacggccagcuguccaccgcgcaugaagucguucccuuugccguguucaagaacagcaaaaagguguaccuugauaagcuggaccucaaaacagaggaaaaucugcuuccugauuccuuugucuguuucgagcacaaggggcaguacaaaggaaccauggacucuggccagacgaagcgggaacugaaauccuuugauaucucccaaugccccaagauugggggacacggcagcaagaaauguacaggggacgcugccuucugcucugccuaugaguguaccgcucaguacgccaacgcguauugcucccaugcuaauggaagcggcaucgugcagauccaaguuucuggcguguggaagaaaccccucugugucggguacgagcgcgugguugugaagagagaacugagcgccaaaccuauucagcgggucgagccgugcacaaccuguaucaccaagugcgaaccccacggacuggugguccgcuccacaggcuuuaagauuucuagcgccguggcuugugccuccgggguuugcgugacgggaagccagucuccuuccaccgagaucacacucaaauaucccggcauuagccagucuuccgggggcgauaucggaguccauauggcucacgacgaucaaagcguguccucuaagaucguugcccauugcccuccccaggacccgugucuggugcacggcugcauugucugugcgcacgggcuuaucaacuaccagugccauaccgcccugagcgcuuucguggugauuuucguuuuuagcucuacagccaucauuugucucgcuguccuguauagagugcuuaaaugccugaagaucgccccucggaaagugcucaauccccugauguggaucaccgcguucauuagaugggucuacaagaaaaugguggcccgcguugcugacaacaucaaccaggugaaucgggaaauuggauggauggagggcgggcaacuggcccucggaaacccugcucccaucccuagacacgcccccauuccgcgcuacagcacguaucugaugcuucugcucaucgucuccuacgccagcgcuuguucugagcugauucaggcguccagccggaucacaaccugcucuaccgaaggcgugaauacaaaguguagacuguccgggaccgcccuuauccgcgcuggcagcguuggagccgaggccugccucaugcugaagggcgugaaagaagaucagacaaaguuucugaaaauuaagacggucucuagcgagcucuccugucgggaggggcagagcuauuggaccggaucuuucuccccuaaaugccugagcuccagacgcugccaucuugugggcgaaugucacguuaaccggugccugucuuggagagacaaugagacaagcgcugaauuuuccuucgugggggagucuaccacaaugcgcgaaaacaaguguuuugagcaaugcggaggcuggggguguggcugcuucaaugucaaccccagcugucucuuugugcacaccuaccugcaguccgugcggaaggaggcccugagagucuucaauugcaucgauuggguucauaaacuuacgcucgaaauuaccgacuuugauggaucugugagcacaaucgaccugggcgcguccagcucucgguucaccaacuggggguccgugagccugucucucgaugcugagggaauuuccggcagcaauucuuuuuccuucaucgaaagccccgggaagggauaugccaucgucgacgagccuuucuccgaaauuccgcgccagggcuuucugggggagaucagauguaacagcgagucuagcgugcuuuccgcccacgaaucuugccugcgggcucccaaucucguuagcuacaaaccuaugauugaucagcuggaguguacaaccaaccugaucgaccccuucguggucuuugaaagaggcucccuuccucaaacgcgcaaugauaagacauucgccgcgucuaaaggaaaccggggcgugcaggcuuuuagcaagggguccguucaggccgaccucacccugauguucgauaacuuugagguggacuucgucggagccgcugugucuugcgacgccgcuuuucugaaucucacaggcugcuauagcuguaacgccggggcgagaguuugccuguccauuaccagcaccggaacaggcacgcuuucugcccauaauaaggauggcucccugcacaucgugcuccccagcgaaaacgggaccaaagaccaaugucagauccugcauuucacagucccugagguggaggaagaguuuauguacucuugcgauggagacgaacgcccccugcuugugaagggcacccucauugcuaucgauccguucgacgauagacgggaggccgggggagaguccacagucguuaauccuaaaagcggcuccuggaacuuuuucgacugguucucugggcugaugagcugguuuggaggcccccugaagaccacgcuccugauuugucuuuacguggcucuguccaucggccucuucuuucugcugauuuaucuugggcgcacaggacugagcaaaauguggcucgccgccaccaagaaggcuucuuga

SEQ ID NO: 14484 - RNA, 3480 nt, Artificial Sequence
  derived and/or modified CDS sequence (opt5) from RVFV(200803162)__JF311377.1__NSm-Gn-Gc
augaucgagggcgccugggacagccugagagaagaggaaaugcccgaggaacucuccugcucugugagcgggauucgggaggucaagaccuccucucaggagcuguaccgcgcucuuaaagccaucauugcggcugauggacugaacaauaucacaugucacggcaagaacccugaagacaaaauuagccucaucaaggggccgccccauaaaaagagaguuggaaucgugcggugcgagcgcagacgggaugccaagcaaauuggccgcgaaacgauggccgggaucgcuaugaccgugcugccugcccuugcugucuucgcccuggcgcccgugguuuuugccgaggacccucaccucagaaaucggcccggaaaaggccauaacuauauugauggcaugacacaggaggacgcuaccuguaagccugugacauacgccggggcuugcuccucuuucgauguccugcuggaaaaaggaaaguuuccccucuuccagagcuaugcccaccaucgcacccugcuugaggcggugcacgacacaaucauugccaaagcugaucccccuuccugugaccugcagagcgcccacggcaaucccugcaugaaggaaaagcucguuaugaaaacccauuguccuaacgauuaccaaucugcucacuaucugaauaacgacgggaagauggccuccgugaaaugcccgccgaaguacgagcuuacggaagauuguaauuuuugcagacagaugaccggagccagccugaaaaagggcucuuauccucuccaggaccuguucugucaguccagcgaggacgaugggucuaaacugaagacaaagaugaaaggagucugcgaggugggcgugcaagcucucaagaaaugcgacggccagcuguccaccgcgcaugaagucguucccuuugccguguucaagaacagcaaaaagguguaccuugauaagcuggaccucaaaacagaggaaaaucugcuuccugauuccuuugucuguuucgagcacaaggggcaguacaaaggaaccauggacucuggccagacgaagcgggaacugaaauccuuugauaucucccaaugccccaagauugggggacacggcagcaagaaauguacaggggacgcugccuucugcucugccuaugaguguaccgcucaguacgccaacgcguauugcucccaugcuaauggaagcggcaucgugcagauccaaguuucuggcguguggaagaaaccccucugugucggguacgagcgcgugguugugaagagagaacugagcgccaaaccuauucagcgggucgagccgugcacaaccuguaucgccaagugcgaaccccacggacuggugguccgcuccaccggcuuuaagauuucuagcgcuguggccugugcuuccgggguuugcgugacaggaagccagucuccuuccacggagaucacccucaaauaucccggcauuagccagucuuccgggggcgauaucggaguccauauggcccacgacgaucaaagcguguccucuaagaucguugcgcauugcccuccccaggacccgugucuggugcacgacugcauugucugugcccacggccuuaucaacuaccagugccauacagcucugagcgccuucguggugauuuucguuuuuagcucuaccgcuaucauuugucucgccguccuguauagagugcuuaaaugccugaagaucgcgccucggaaagugcucaauccccugauguggaucacagccuucauuagaugggucuacaagaaaaugguggcucgcguugccgauaacaucaaccaggugaaucgggaaauuggguggauggagggaggccaacuggcucucagaaacccugcccccaucccucgccacgcccccauuccgcgguacagcaccuaucugaugcuucugcucaucgucuccuacgcuagcgcguguucugagcugauucaggccuccagcagaaucacgacaugcucuaccgaaggggugaauaccaagugucgccuguccggaacagcucuuauccgggccggcagcguuggggccgaggcuugccucaugcugaagggcgugaaagaagaccagaccaaguuucugaaaauuaagacagucucuagcgagcucuccuguagagagggacagagcuauuggacgggcucuuucuccccuaaaugccugagcucccgccggugccaucuugugggggaaugucacguuaacagaugccugucuuggcgcgauaaugagaccagcgccgaauuuuccuucgugggagagucuacaaccaugcgggaaaacaaguguuuugagcaaugcggcggguggggauguggcugcuucaaugucaaccccagcugucucuuugugcacacauaccugcaguccgugagaaaggaggcgcugcgggucuucaauugcaucgacuggguucauaaacuuacccucgaaauuacggauuuugacgggucugugagcaccaucgaucugggcgcuuccagcucucgcuucacaaacuggggauccgugagccugucucucgacgccgagggcauuuccgggagcaauucuuuuuccuucaucgaaagccccggaaagggcuaugccaucgucgaugagccuuucuccgaaauuccgagacagggguuucugggagagauccgguguaacagcgagucuagcgugcuuuccgcucacgaaucuugccugagagcccccaaucucguuagcuacaaaccuaugauugaccagcuggaguguaccacaaaccugaucgaucccuucguggucuuugaacgcggcucccuuccucaaacccggaaugacaagacguucgcggcuucuaaagggaacagaggcgugcaggccuuuagcaagggauccguucaggccgaucucacacugauguucgacaacuuugagguggacuucgucggcgcugccgugucuugcgaugcugccuuucugaaucucaccgggugcuauagcuguaacgcgggagcccgcguuugccuguccauuacaagcaccggcaccgggacacuuucugcucauaauaaggacggaucccugcacaucgugcuccccagcgaaaacggcacgaaagaucaaugucagauccugcauuucaccgucccugagguggaggaagaguuuauguacucuugcgacggcgaugaaagaccccugcuugugaaggggacacucauugccaucgacccguucgaugaccggcgcgaggcuggaggcgaguccaccgucguuaauccuaaaagcggguccuggaacuuuuucgauugguucucuggacugaugagcugguuuggcgggccccugaagacaauucuccugaucugucuuuacguggcccuguccauuggacucuucuuucugcugaucuaucuuggcagaaccggccugagcaaaauguggcucgccgcuacgaagaaggcgucuuga

SEQ ID NO: 14485 - RNA, 3480 nt, Artificial Sequence
  derived and/or modified CDS sequence (opt5) from RVFV(2007002060)__EU574039.1__NSm-Gn-Gc
augaucgagggcgccugggacagccugagagaagaggaaaugcccgaggaacucuccugcucugugagcgggauucgggaggucaagaccuccucucaggagcuguaccgcgcucuuaaagccaucauugcggcugauggacugaacaauaucacaugucacggcaagaacccugaagacaaaauuagccucaucaaggggccgccccauaaaaagagaguuggaaucgugcggugcgagcgcagaaaggaugccaaacaaauuggccgggaaacgauggccgggaucgcuaugaccgugcugccugcccuugcugucuucgcccuggcgcccgugguuuuugccgaggacccucaccuccgcaauagacccggaaagggccauaacuauauugauggcaugacacaggaggacgcuaccuguaaaccugugacauacgccggggcuugcuccucuuucgauguccugcuggaaaagggaaaauuuccccucuuccagagcuaugcccaccaucggacccugcuugaggcggugcacgacacaaucauugccaaggcugaucccccuuccugugaccugcagagcgcccacggcaaucccugcaugaaggaaaaacucguuaugaagacccauuguccuaacgauuaccaaucugcucacuaucugaauaacgacgggaaaauggccuccgugaagugcccgccgaaauacgagcuuacggaagauuguaauuuuugccgccagaugaccggagccagccugaagaaaggcucuuauccucuccaggaccuguucugucaguccagcgaggacgaugggucuaagcugaagacaaaaaugaagggagucugcgaggugggcgugcaagcucucaaaaagugcgacggccagcuguccaccgcgcaugaagucguucccuuugccguguucaaaaacagcaagaagguguaccuugauaaacuggaccucaagacagaggaaaaucugcuuccugauuccuuugucuguuucgagcacaaagggcaguacaagggaaccauggacucuggccagacgaaaagagaacugaaguccuuugauaucucccaaugccccaagauugggggacacggcagcaaaaaguguacaggggacgcugccuucugcucugccuaugaguguaccgcucaguacgccaacgcguauugcucccaugcuaauggaagcggcaucgugcagauccaaguuucuggcguguggaaaaagccccucugugucggguacgagcgggugguugugaaacgcgaacugagcgccaagccuauucagagagucgagccgugcacaaccuguaucaccaagugcgaaccccacggacuggugguccgguccacaggcuuuaaaauuucuagcgccguggcuugugccuccgggguuugcgugacgggaagccagucuccuuccaccgagaucacacucaaguaucccggcauuagccagucuuccgggggcgauaucggaguccauauggcucacgacgaucaaagcguguccucuaaaaucguugcccauugcccuccccaggacccgugucuggugcacggcugcauugucugugcgcacgggcuuaucaacuaccagugccauaccgcccugagcgcuuucguggugauuuucguuuuuagcucuacagccaucauuugucucgcuguccuguaucgcgugcuuaagugccugaaaaucgccccuagaaaggugcucaauccccugauguggaucaccgcguucauucggugggucuacaaaaagaugguggccagaguugcugacaacaucaaccaggugaaucgcgaaauuggauggauggagggcgggcaacuggcccucggaaacccugcucccaucccucggcacgcccccauuccgagauacagcacguaucugaugcuucugcucaucgucuccuacgccagcgcuuguucugagcugauucaggcguccagccgcaucacaaccugcucuaccgaaggcgugaauacaaagugucggcuguccgggaccgcccuuaucagagcuggcagcguuggagccgaggccugccucaugcugaaaggcgugaaggaagaucagacaaaauuucugaagauuaaaacggucucuagcgagcucuccugucgcgaggggcagagcuauuggaccggaucuuucuccccuaagugccugagcucccggagaugccaucuugugggcgaaugucacguuaaccgcugccugucuuggcgggacaaugagacaagcgcugaauuuuccuucgugggggagucuaccacaaugagagaaaacaaguguuuugagcaaugcggaggcuggggguguggcugcuucaaugucaaccccagcugucucuuugugcacaccuaccugcaguccgugcgcaaagaggcccugcgggucuucaauugcaucgauuggguucauaaacuuacgcucgaaauuaccgacuuugauggaucugugagcacaaucgaccugggcgcguccagcucuagauucaccaacuggggguccgugagccugucucucgaugcugagggaauuuccggcagcaauucuuuuuccuucaucgaaagccccgggaaaggauaugccaucgucgacgagccuuucuccgaaauuccgcggcagggcuuucugggggagauccgcuguaacagcgagucuagcgugcuuuccgcccacgaaucuugccugagagcucccaaucucguuagcuacaagccuaugauugaucagcuggaguguacaaccaaccugaucgaccccuucguggucuuugaacggggcucccuuccucaaacgagaaaugauaaaacauucgccgcgucuaagggaaaccgcggcgugcaggcuuuuagcaagggguccguucaggccgaccucacccugauguucgauaacuuugagguggacuucgucggagccgcugugucuugcgacgccgcuuuucugaaucucacaggcugcuauagcuguaacgccggggcgcggguuugccuguccauuaccagcaccggaacaggcacgcuuucugcccauaauaaagauggcucccugcacaucgugcuccccagcgaaaacgggaccaaggaccaaugucagauccugcauuucacagucccugagguggaggaagaguuuauguacucuugcgauggagacgaaagaccccugcuugugaaaggcacccucauugcuaucgauccguucgacgaucgcagagaggccgggggagaguccacagucguuaauccuaagagcggcuccuggaacuuuuucgacugguucucugggcugaugagcugguuuggaggcccccugaaaaccauucuccugaucugucuuuacguggcucuguccauuggccucuucuuucugcugaucuaucuugggcggacgggacugagcaagauguggcucgccgccacaaagaaggcuucuuga

SEQ ID NO: 14486 - RNA, 3480 nt, Artificial Sequence
  derived and/or modified CDS sequence (opt5) from RVFV(2007002476)__EU574036.1__NSm-Gn-Gc
augaucgagggcgccugggacagccugagagaagaggaaaugcccgaggaacucuccugcucugugagcgggauucgggaggucaagaccuccucucaggagcuguaccgcgcucuuaaagccaucauugcggcugauggacugaacaauaucacaugucacggcaagaacccugaagacaaaauuagccucaucaaggggccgccccauaaaaagagaguuggaaucgugcggugcgagcgcagacgggaugccaagcaaauuggccgcgaaacgauggccgggaucgcuaugaccgugcugccugcccuugcugucuucgcccuggcgcccgugguuuuugccgaggacccucaccucagaaaucggcccggaaaaggccauaacuauauugauggcaugacacaggaggacgcuaccuguaagccugugacauacgccggggcuugcuccucuuucgauguccugcuggaaaaaggaaaguuuccccucuuccagagcuaugcccaccaucgcacccugcuugaggcggugcacgacacaaucauugccaaagcugaucccccuuccugugaccugcagagcgcccacggcaaucccugcaugaaggaaaagcucguuaugaaaacccauuguccuaacgauuaccaaucugcucacuaucugaauaacgacgggaagauggccuccgugaaaugcccgccgaaguacgagcuuacggaagauuguaauuuuugcagacagaugaccggagccagccugaaaaagggcucuuauccucuccaggaccuguucugucaguccagcgaggacgaugggucuaaacugaagacaaagaugaaaggagucugcgaggugggcgugcaagcucucaagaaaugcgacggccagcuguccaccgcgcaugaagucguucccuuugccguguucaagaacagcaaaaagguguaccuugauaagcuggaccucaaaacagaggaaaaucugcuuccugauuccuuugucuguuucgagcacaaggggcaguacaaaggaaccauggacucuggccagacgaagcgggaacugaaauccuuugauaucucccaaugccccaagauugggggacacggcagcaagaaauguacaggggacgcugccuucugcucugccuaugaguguaccgcucaguacgccaacgcguauugcucccaugcuaauggaagcggcaucgugcagauccaaguuucuggcguguggaagaaaccccucugugucggguacgagcgcgugguugugaagagagaacugagcgccaaaccuauucagcgggucgagccgugcacaaccuguaucaccaagugcgaaccccacggacuggugguccgcuccacaggcuuuaagauuucuagcgccguggcuugugccuccgggguuugcgugacgggaagccagucuccuuccaccgagaucacacucaaauaucccggcauuagccagucuuccgggggcgauaucggaguccauauggcucacgacgaucaaagcguguccucuaagaucguugcccauugcccuccccaggacccgugucuggugcacggcugcauugucugugcgcacgggcuuaucaacuaccagugccauaccgcccugagcgcuuucguggugauuuucguuuuuagcucuacagccaucauuugucucgcuguccuguauagagugcuuaaaugccugaagaucgccccucggaaagugcucaauccccugauguggaucaccgcguucauuaagugggucuacaaaaagaugguggccagaguugcugacaacaucaaccaggugaaucgcgaaauuggauggauggagggcgggcaacuggcccucggaaacccugcucccaucccucggcacgcccccauuccgagauacagcacguaucugaugcuucugcucaucgucuccuacgccagcgcuuguucugagcugauucaggcguccagccgcaucacaaccugcucuaccgaaggcgugaauacaaagugucggcuguccgggaccgcccuuaucagagcuggcagcguuggagccgaggccugccucaugcugaaaggcgugaaggaagaucagacaaaauuucugaagauuaaaacggucucuagcgagcucuccugucgcgaggggcagagcuauuggaccggaucuuucuccccuaagugccugagcucccggagaugccaucuugugggcgaaugucacguuaaccgcugccugucuuggcgggacaaugagacaagcgcugaauuuuccuucgugggggagucuaccacaaugagagaaaacaaguguuuugagcaaugcggaggcuggggguguggcugcuucaaugucaaccccagcugucucuuugugcacaccuaccugcaguccgugcgcaaagaggcccugcgggucuucaauugcaucgauuggguucauaaacuuacgcucgaaauuaccgacuuugauggaucugugagcacaaucgaccugggcgcguccagcucuagauucaccaacuggggguccgugagccugucucucgaugcugagggaauuuccggcagcaauucuuuuuccuucaucgaaagccccgggaaaggauaugccaucgucgacgagccuuucuccgaaauuccgcggcagggcuuucugggggagauccgcuguaacagcgagucuagcgugcuuuccgcccacgaaucuugccugagagcucccaaucucguuagcuacaagccuaugauugaucagcuggaguguacaaccaaccugaucgaccccuucguggucuuugaacggggcucccuuccucaaacgagaaaugauaaaacauucgccgcgucuaagggaaaccgcggcgugcaggcuuuuagcaagggguccguucaggccgaccucacccugauguucgauaacuuugagguggacuucgucggagccgcugugucuugcgacgccgcuuuucugaaucucacaggcugcuauagcuguaacgccggggcgcggguuugccuguccauuaccagcaccggaacaggcacgcuuucugcccauaauaaagauggcucccugcacaucgugcuccccagcgaaaacgggaccaaggaccaaugucagauccugcauuucacagucccugagguggaggaagaguuuauguacucuugcgauggagacgaaagaccccugcuugugaaaggcacccucauugcuaucgauccguucgacgaucgcagagaggccgggggagaguccacagucguuaauccuaagagcggcuccuggaacuuuuucgacugguucucugggcugaugagcugguuuggaggcccccugaaaaccauucuccugaucugucuuuacguggcucuguccauuggccucuucuuucugcugaucuaucuugggcggacgggacugagcaagauguggcucgccgccacaaagaaggcuucuuga

SEQ ID NO: 14487 - RNA, 3480 nt, Artificial Sequence
  derived and/or modified CDS sequence (opt5) from RVFV(2269/74)__DQ380222.1__NSm-Gn-Gc
augaucgagggcgccugggacagccugagagaagaggaaaugcccgaggaacucuccugcucuauuagcgggauccgggaggugaagaccuccucucaggagcuguaccgcgcucuuaaagccauuaucgcggcugauggacugaauaauauuacaugucacggcaaggacccugaagauaaaaucagccucaucaaggggccgccccauaaaaagagagucggaauuguucggugcgagcgcagacgggacgccaagcaaaucggccgcgaaacgauggccgggauugcuaugaccgugcugccugcccuugcuguguucgcccuggcgcccgucguguuugccgaggauccucaccucagaaaccggcccggaaaaggccauaauuauaucgacggcaugacacaggaggaugcuaccuguaagccuguuacauacgccggggcuugcuccucuuucgacgugcugcuggaaaaaggaaaguuuccccucuuccagagcuaugcccaccaucgcacccugcuugaggcgguccacgauacaauuaucgccaaagcugacccgccuuccugugaucugcagagcgcccacggcaaccccugcaugaaggaaaagcucgugaugaaaacccauuguccuaaugacuaccaaucugcucacuaucugaacaaugaugggaagauggccuccguuaaaugucccccgaaguacgagcuuacggaagacugcaacuuuugcagacagaugaccggagccagccugaaaaagggcucuuauccucuccaggaccuguucugucaguccagcgaggaugacgggucuaaacugaagacaaagaugaaaggagugugcgaggucggcgugcaagcucucaagaaaugcgauggccagcuguccaccgcgcaugaagugguccccuuugccguuuucaagaauagcaaaaagguguaccuugacaagcuggaucucaaaacagaggaaaaccugcuuccugacuccuuuguguguuucgagcacaaggggcagcacaaaggaaccauggauucuggccagacgaagcgggaacugaaauccuuugacauuucccaaugccccaagaucgggggacauggcagcaagaaauguacaggggaugcugccuucugcucugccuacgaguguaccgcucaguaugccaaugcguacugcucccacgcuaacggaagcggcaucguccagauucaagugucuggcguuuggaagaaaccccucugugugggguaugagcgcgucgugguuaagagagaacugagcgccaaaccuauccagcggguggagccgugcacaaccuguauuaccaagugcgaaccccauggacuggucgugcgcuccacaggcuuuaagaucucuagcgccgucgcuugugccuccggggugugcguuacgggaagccagucuccuuccaccgagauuacacucaaauaccccggcaucagccagucuuccgggggcgacaucggagugcacauggcucaugaugaccaaagcgucuccucuaagauuguggcccacugcccuccccaggacccgugucugguucacggcugcaucgugugugcgcaugggcuuauuaauuaucagugccacaccgcccugagcgcuuucgucgugguguucguuuuuagcucugucgccaucauuugucucgcuauccuguacaaagugcuuaagugccugaaaaucgccccuaagaaagugcucaacccccugauguggauuacagcguucaucagaugggucuauaagaagaugguggcccggguugcugauaauauuaaccaggugaacagagaaaucggauggauggagggcgggcaacuggcccucggaaauccugcucccauuccucgccaugcccccaucccgcgguacagcaccuaccugaugcuucugcucauugucuccuaugccagcgcuuguucugagcugauccaggcguccagcagaaucacgacaugcucuaccgaaggcgugaacaccaaaugucgccuguccgggacagcccuuauucgggcuggcagcguuggagccgaggccugccucaugcugaagggcgugaaagaagaccagaccaaguuucugaaaaucaagacagucucuagcgagcucuccuguagagaggggcagagcuacuggacgggaucuuucuccccuaagugccugagcucccgccggugccaccuugugggcgaaugucacguuaauagaugccugucuuggcgcgauaacgagaccagcgcugaauuuuccuucgugggggagucuacaaccaugcgggaaaauaaauguuuugagcaaugcggaggcuggggguguggcugcuucaacgucaaucccagcugucucuuugugcauacauaucugcaguccgugagaaaggaggcccugcgcgucuucaacugcauugacuggguucacaaacuuacccucgaaaucacggauuuugacggaucugugagcaccauugaucugggcgcguccagcucucgguucacaaauuggggguccgugagccugucucucgacgcugagggaaucuccggcagcaacucuuuuuccuucaucgaaagccccgggaagggauacgccauugucgaugagccuuucuccgaaaucccgagacagggcuuucugggggagauucgguguaauagcgagucuagcgugcuuuccgcccaugaaucuugccugcgcgcucccaaccucaucagcuauaaaccuaugauugaccagcuggaguguaccacaaaucugaucgaucccuucguuguguuugaaagaggcucccuuccucaaacccggaacgacaagacguucgccgcgucuaagggaaauagaggcguccaggcuuuuagcaaaggguccgugcaggccgaucucacacugauguucgacaacuuugagguugacuucgugggagccgcugucucuugcgaugccgcuuuucugaaccucaccggcugcuacagcuguaaugccggggcgcgcgugugccuguccaucacaagcaccggaaccggcacacuuucugcccacaacaaggacggcucccugcauauuguucuccccagcgaaaaugggacgaaagaucaaugucagauccugcacuucaccgugccugaggucgaggaagaguuuauguauucuugcgacggagaugaacggccccugcuugugaagggcacacucauugcuaucgacccguucgaugacagacgcgaggccgggggagaguccaccguggucaacccuaaaagcggcuccuggaacuuuuucgauugguucucugggcugaugagcugguuuggaggcccccugaagacaauucuccugaucugucuuuacguugcucuguccaucggccucuucuuucugcugauuuaccuugggagaaccggacugagcaagauguggcucgccgccacgaaaaaggcuucuuga

SEQ ID NO: 14488 - RNA, 3480 nt, Artificial Sequence
  derived and/or modified CDS sequence (opt5) from RVFV(73HB1449)__DQ380211.1__NSm-Gn-Gc
augaucgagggcgccugggacagccugagagaagaggaaaugcccgaggaacucuccugcucuauuagcgggauccgggaggugaagaccuccucucaggagcuguaccgcgcucuuaaagccauuaucgcggcugauggacugaacaauauuacaugucacggcaaggacccugaagauaaaaucagccucaucaaggggccgccccauaaaaagagagucggaauuguucggugcgagcgcagacgggacgccaagcaaaucggccgcgaaacgauggccgggauugcuaugaccgugcugccugcccuugcuguguucgcccuggcgcccgucguguuugccgaggauccucaccucagaaaccggcccggaaaaggccauaauuauaucgacggcaugacacaggaggaugcuaccuguaagccuguuacauacgccggggcuugcuccucuuucgacgugcugcuggaaaaaggaaaguuuccccucuuccagagcuaugcccaccaucgcacccugcuugaggcgguccacgauacaauuaucgccaaagcugacccgccuuccugugaucugcagagcgcccacggcaaccccugcaugaaggaaaagcucgugaugaaaacccauuguccuaaugacuaccaaucugcucacuaucugaacaaugaugggaagauggccuccguuaaaugucccccgaaguacgagcuuacggaagacugcaacuuuugcagacagaugaccggagccagccugaaaaagggcucuuauccucuccaggaccuguucugucaguccagcgaggaugacgggucuaaacugaagacaaagaugaaaggagugugcgaggucggcgugcaagcucucaagaaaugcgauggccagcuguccaccgcgcaugaagugguccccuuugccguuuucaagaauagcaaaaagguguaccuugacaagcuggaucucaaaacagaggaaaaccugcuuccugacuccuuuguguguuucgagcacaaggggcaguacaaaggaaccauggauucuggccagacgaagcgggaacugaaauccuuugacauuagccaaugccccaagaucgggggacacggcagcaagaaauguacaggggaugcugccuucugcucugccuaugaguguaccgcucaguacgccaaugcguauugcucccaugcuaacggaagcggcaucguccagauucaagugucuggcguuuggaagaaaccccucugugugggguacgagcgcgucgugguuaagagagaacugagcgccaaaccuauccagcggguggagccgugcacaaccuguauuaccaagugcgaaccccacggacuggucgugcgcuccacaggcuuuaagaucucuagcgccgucgcuugugccuccggggugugcguuacgggaagccagaauccuucuaccgagauuacacucaaauaucccggcaucucccagagcucugggggcgacaucggagugcauauggcucacgaugaccaauccgucagcuccaagauuguggcccauugcccuccccaggacccgugucugguucacggcugcaucgugugugcgcacgggcuuauuaacuaccagugccauaccgcccugucugcuuucgucgugguguucguuuuuagcuccaucgccauuaucugucucgcuauccuguauagaguccuuaaaugccugaagauugccccucggaaagugcucaauccccugauguggaucacagcguucauuagauggguguacaagaaaauggucgcccgcguggcugauaacaucaaccagguuaaucgggaaauuggauggauggagggcgggcaacuggugcucggaaacccugcccccaucccuagacacgcucccauuccgcgcuacucuaccuaucugaugcuucugcucaucgucagcuacgccuccgccuguagcgagcugauccaggcuucuucccggauuacgacaugcagcaccgaaggcgugaauaccaaguguagacugucugggacagcgcuuauccgcgccggcuccguuggagcugaggccugccucaugcugaagggcgugaaagacgaucagaccaaguuucugaaaauuaagacagucagcucugaacucagcugucgggaggggcaguccuauuggacgggcagcuucucuccuaaaugccuguccagcagacgcugccaucuugugggagagugucacguuaaccggugccuguccuggagagacaaugaaaccucugccgaguuuagcuucgugggggaauccacaaccaugcgcgagaacaaguguuuugaacaaugcggaggcuggggguguggcugcuucaaugucaaccccucuugucucuuugugcacacauaccugcagagcgugcggaaggaggcucugagagucuucaauugcaucgauuggguucauaaacuuacccucgagauuacggacuuugauggauccgugucuaccaucgaccugggcgccagcuccagccgguucacaaacugggggucugugucccugagccucgaugcggaaggaaucucuggcuccaauagcuuuucuuucauugagucccccgggaagggauaugcuaucgucgacgaaccuuucagcgagauuccgcgccagggcuuucugggggaaaucagauguaacuccgagagcucugugcuuagcgcccacgaguccugccugcgggcccccaaucucauuucuuacaaaccuaugaucgaucagcuggaauguaccacaaaccugaucgaccccuucguuguguuugagagaggcagccuuccucaaacccgcaaugaaaagacguucgcugccuccaaaggaaaccggggcguccaggcguuuucuaaggggagcgugcaggcugaucucacacugauguucgacaacuuugagguugacuucgugggagccgccgucuccugcgaugcugccuuucugaaucucaccggcugcuauucuuguaacgcuggggccagagugugccugagcauuacauccaccggaaccggcacacuuagcgcgcauaauaaggacggcucucugcacaucguucuccccuccgaaaacgggacgaaagaucaaugucagauucugcauuucaccgugccugaggucgaggaagaguuuauguacagcugcgacggagaugaacgcccccugcuugugaagggcacacucaucgccauugacccguucgaugacagacgggaggcugggggagagucuaccguggucaauccuaaauccggcagcuggaacuuuuucgauugguucuccgggcugaugucuugguuuggaggcccccugaagacaauccuccugaucugucuuuacguugcccugagcauuggccucuucuuucugcugaucuaucuugggcgcaccggacuguccaaaauguggcucgcugccacgaagaaggccagcuga

SEQ ID NO: 14489 - RNA, 3480 nt, Artificial Sequence
  derived and/or modified CDS sequence (opt5) from RVFV(SA-51 (Van Wyck))__DQ380195.1__NSm-Gn-Gc
augaucgagggcgccugggacagccugagagaagaggaaaugcccgaggaacucuccugcucuauuagcgggauccgggaggugaagaccuccucucaggagcuguaccgcgcucuuaaagccauuaucgcggcugauggacugaauaauauuacaugucacggcaaggacccugaagauaaaaucagccucaucaaggggccgccccauaaaaagagagucggaauuguucggugcgagcgcagacgggacgccaagcaaaucggccgcgaaacgauggccgggauugcuaugaccgugcugccugcccuugcuguguucgcccuggcgcccgucguguuugccgaggauccucaccucagaaaccggcccggaaaaggccauaauuauaucgacggcaugacacaggaggaugcuaccuguaagccuguuacauacgccggggcuugcuccucuuucgacgugcugcuggaaaaaggaaaguuuccccucuuccagagcuaugcccaccaucgcacccugcuugaggcgguccacgauacaauuaucgccaaagcugacccgccuuccugugaucugcagagcgcccacggcaaccccugcaugaaggaaaagcucgugaugaaaacccauuguccuaaugacuaccaaucugcucacuaucugaacaaugaugggaagauggccuccguuaaaugucccccgaaguacgagcuuacggaagacugcaacuuuugcagacagaugaccggagccagccugaaaaagggcucuuauccucuccaggaccuguucugucaguccagcgaggaugacgggucuaaacugaagacaaagaugaaaggagugugcgaggucggcgugcaagcucucaagaaaugcgauggccagcuguccaccgcgcaugaagugguccccuuugccguuuucaagaauagcaaaaagguguaccuugacaagcuggaucucaaaacagaggaaaaccugcuuccugacuccuuuguguguuucgagcacaaggggcaguacaaaggaaccauggauucuggccagacgaagcgggaacugaaauccuuugacauuucccaaugccccaagaucgggggacgcggcagcaagaaauguacaggggaugcugccuucugcucugccuaugaguguaccgcucaguacgccaaugcguauugcucccacgcuaacggaagcggcaucguccagauucaagugucuggcguuuggaagaaaccccucugugugggguacgagagagucgugguuaagcgggaacugagcgccaaaccuauccagcgcguggagccgugcacaaccuguauuaccaagugcgaaccccauggacuggucgugagauccacaggcuuuaagaucucuagcgccgucgcuugugccuccggggugugcguuacgggaagccagucuccuuccaccgagauuacacucaaauaucccggcaucagccagucuuccgggggcgacaucggagugcacauggcucaugaugaccaaagcgucuccucuaagauuguggcccacugcccuccccaggacccgugucugguucauggcugcaucgugugugcgcacgggcuuauuaauuaccagugccacaccgcccugagcgcuuucgucgugguguucguuuuuagcucugucgccaucauuugucucgcuauccuguauaaagugcuuaagugccugaaaaucgccccucggaaggugcucaacccccugauguggauuacagcguucaucagaugggucuacaaaaagaugguggcccgcguugcugauaauauuaaccaggugaaccgggaaaucggauggauggagggcgggcaacuggcccucggaaauccugcucccauuccuagacaugcccccaucccgcgcuacagcaccuaucugaugcuucugcucauugucuccuacgccagcgcuuguucugagcugauccaggcguccagccggaucacgacaugcucuaccgaaggcgugaacaccaaguguagacuguccgggacagcccuuauucgcgcuggcagcguuggagccgaggccugccucaugcugaaaggcgugaaggaagaccagaccaaauuucugaagaucaaaacagucucuagcgagcucuccugucgggaggggcagagcuauuggacgggaucuuucuccccuaagugccugagcuccagacgcugccaccuugugggcgaaugucauguuaaucggugccugucuuggagagauaacgagaccagcgcugaauuuuccuucgugggggagucuacaaccaugcgcgaaaauaaguguuuugagcaaugcggaggcuggggguguggcugcuucaacgucaaucccagcugucucuuugugcacacauaccugcaguccgugcggaaagaggcccugagagucuucaacugcauugacuggguucacaaacuuacccucgaagugacggauuuugacggaucugugagcaccaucgaucugggcgcguccagcucucgguucacaaauuggggguccgucagccugucucucgacgcugagggaauuuccggcagcaacucuuuuuccuucaucgaaagccccgggaaaggauaugccaucguggaugagccuuucuccgaaauuccgcgccagggcuuucugggggagaucagauguaauagcgagucuagcguucuuuccgcccaugaaucuugccugcgggcucccaaccucauuagcuacaagccuaugaucgaccagcuggaguguaccacaaaucugauugaucccuucguggucuuugaaagaggcucccuuccucaaacccgcaacgacaaaacguucgccgcgucuaagggaaaucggggcgugcaggcuuuuagcaagggguccguucaggccgaucucacacugauguucgacaacuuugagguggacuucgucggagccgcugugucuugcgaugccgcuuuucugaaccucaccggcugcuauagcuguaaugccggggcgagaguuugccuguccaucacaagcaccggaaccggcacacuuucugcccacaacaaagacggcucccugcauaucgugcuccccagcgaaaaugggacgaaggaucaaugucagauucugcacuucaccgucccugagguggaggaagaguuuauguacucuugcgacggagaugaacgcccccugcuugugaaaggcacacucaucgcuauugacccguucgaugacagacgggaggccgggggagaguccaccgucguuaacccuaagagcggcuccuggaacuuuuucgauugguucucugggcugaugagcugguuuggaggcccccugaaaacaauccuccugauuugucuuuacguggcucuguccaucggccucuucuuucugcugaucuaucuugggcgcaccggacugagcaagauguggcucgccgccacgaagaaggcuucuuga

SEQ ID NO: 14490 - RNA, 3480 nt, Artificial Sequence
  derived and/or modified CDS sequence (opt5) from RVFV(KEN/Gar-Msq/131B-04/06)__HM586972.1__NSm-Gn-Gc
augaucgagggcgccugggacagcuucagagaagaggaaaugcccgaggaacuguccugcucugugagcgggauucgggaggucaagaccuccucucaggagcucuaccgcgcucugaaagccaucauugcggcugauggacuuaacaauaucacaugucacggcaagaacccugaagacaaaauuagccugaucaaggggccgccccauaaaaagagaguuggaaucgugcggugcgagcgcagacgggaugccaagcaaauuggccgcgaaacgauggccgggaucgcuaugaccgugcucccugcccuggcugucuuugcccuugcgcccgugguuuucgccgaggacccucaccugagaaaucggcccggaaaaggccauaacuauauugauggcaugacacaggaggacgcuaccuguaagccugugacauacgccggggcuugcuccucuuuugauguccuccuggaaaaaggaaaguucccgcuguuucagagcuaugcccaccaucgcacccuccuggaggcggugcacgacacaaucauugccaaagcugaucccccuuccugugaccuucagagcgcccacggcaaucccugcaugaaggaaaagcugguuaugaaaacccauuguccuaacgauuaccaaucugcucacuaucucaauaacgacgggaagauggccuccgugaaaugucccccgaaguacgagcugacggaagauugcaauuucugcagacagaugaccggagccagccuuaaaaagggcucuuauccucugcaggaccucuuuugucaguccagcgaggacgaugggucuaaacugaagacaaagaugaaaggagucugcgaggugggcgugcaagcucugaagaaaugcgacggccagcucuccaccgcgcaugaagucguucccuucgccguguuuaagaacagcaaaaagguguaccuggauaaacuugaccugaaaacagaggaaaaucuccugccugauuccuucgucuguuuugagcacaaggggcaguacaaaggaaccauggacucuggccagacgaagcgggaacuuaagagcuucgauaucucccaaugccccaagauugggggacacggcagcaagaaauguacaggggacgcugccuuuugcucugccuaugaguguaccgcucaguacgccaacgcguauugcucccaugcuaauggaagcggcaucgugcagauccaaguuucuggcguguggaagaaaccccugugugucggguacgagcgcgugguugugaagagagaacucagcgccaaaccuauucagcgggucgagccgugcacaaccuguaucaccaagugcgaaccccacggacuggugguccgcuccacaggcuucaagauuucuagcgccguggcuugugccuccgggguuugcgugacgggaagccagucuccuuccaccgagaucacacugaaauaucccggcauuagccagucuuccgggggcgauaucggaguccauauggcucacgacgaucaaagcguguccucuaagaucguugcccauugcccuccccaggacccgugucucgugcacggcugcauugucugugcgcacgggcugaucaacuaccagugccauaccgcccuuagcgcuuucguggugauuuuuguuuucuccucuacagccaucauuugucuggcuguccucuauagagugcugaaaugccuuaagaucgccccucggaaagugcugaauccccucauguggaucaccgcguuuauuagaugggucuacaagaaaaugguggcccgcguugcugacaacaucaaccaggugaaucgggaaauuggauggauggagggcgggcaacuggcccugggaaacccugcucccaucccuagacacgcccccauuccgcgcuacagcacguaucucaugcugcuucugaucgucuccuacgccagcgcuuguucugagcucauucaggcguccagccggaucacaaccugcucuaccgaaggcgugaauacaaaguguagacuguccgggaccgcccugauccgcgcuggcagcguuggagccgaggccugccuuaugcucaagggcgugaaagaagaucagacaaaguuccugaaaauuaagacggucucuagcgagcuguccugucgggaggggcagagcuauuggaccggaucuuuuuccccuaaaugccucagcuccagacgcugccaucuggugggcgaaugucacguuaaccggugccuuucuuggagagacaaugagacaagcgcugaguucuccuuugugggggaaucuaccacaaugcgcgaaaacaaguguuucgagcaaugcggaggcuggggguguggcugcuuuaaugucaaccccagcugucuguucgugcacaccuaccuccaguccgugcggaaggaggcccugagagucuuuaauugcaucgauuggguucauaaacugacgcuugaaauuaccgacuucgauggaucugugagcacaaucgaccucggcgcguccagcucucgguuuaccaacuggggguccgugagccugucucuggaugcugagggaauuuccggcagcaauucuuucuccuucaucgaaagccccgggaagggauaugccaucgucgacgagccuuuuuccgaaauuccgcgccagggcuuccucggggagaucagauguaacagcgagucuagcgugcuguccgcccacgaaucuugccuucgggcucccaaucugguuagcuacaaaccuaugauugaucagcucgaguguacaaccaaccugaucgaccccuuuguggucuucgaaagaggcucccugccucaaacgcgcaaugauaagacauuugccgcgucuaaaggaaaccggggcgugcaggcuuucagcaagggguccguucaggccgaccuuacccucauguuugauaacuucgagguggacuuugucggagccgcugugucuugcgacgccgcuuuccugaaucugacaggcugcuauagcuguaacgccggggcgagaguuugccucuccauuaccagcaccggaacaggcacgcugucugcccauaauaaggauggcucccuucacaucgugcugcccagcgaaaacgggaccaaagaccaaugucagauccuccauuuuacagucccugagguggaggaagaguucauguacucuugcgauggagacgaacgcccccugcuggugaagggcacccuuauugcuaucgauccguuugacgauagacgggaggccgggggagaguccacagucguuaauccuaaaagcggcuccuggaacuucuucgacugguuuucugggcucaugagcugguucggaggcccccugaagaccauucugcucaucugucuguacguggcucuuuccauuggccuguuuuuccuccugaucuaucuggggcgcacgggacuuagcaaaauguggcuggccgccacaaagaaggcuucuuga

SEQ ID NO: 14491 - RNA, 3480 nt, Artificial Sequence
  derived and/or modified CDS sequence (opt5) from RVFV(2007001107)__EU574047.1__NSm-Gn-Gc
augaucgagggcgccugggacagccugagagaagaggaaaugcccgaggaacucuccugcucugugagcgggauucgggaggucaagaccuccaaucaggagcuguaccgcgcucuuaaagccaucauugcggcugauggacugaauaacaucacaugucacggcaagaauccugaagacaaaauuucucucaucaaggggccgccccauaaaaagagaguuggaaucgugcggugcgagcgcagacgggaugccaagcaaauuggccgcgaaacgauggccgggaucgcuaugaccgugcugccugcccuugcugucuucgcccuggcgcccgugguuuuugccgaggacccucaccucagaaaccggcccggaaaaggccauaauuauauugauggcaugacacaggaggacgcuaccuguaagccugugacauacgccggggcuugcagcuccuucgauguccugcuggaaaaaggaaaguuuccccucuuccagucuuaugcccaccaucgcacccugcuugaggcggugcacgacacaaucauugccaaagcugaucccccuagcugugaccugcaguccgcccacggcaaccccugcaugaaggaaaagcucguuaugaaaacccauuguccuaaugauuaccaaagcgcucacuaucugaacaaugacgggaagauggccucugugaaaugcccgccgaaguacgagcuuacggaagauuguaacuuuugcagacagaugaccggagccucccugaaaaagggcagcuauccucuccaggaccuguucugucagucuuccgaggacgaugggagcaaacugaagacaaagaugaaaggagucugcgaggugggcgugcaagcucucaagaaaugcgacggccagcugucuaccgcgcaugaagucguucccuuugccguguucaagaauagcaaaaagguguaccuugauaagcuggaccucaaaacagaggaaaaccugcuuccugauagcuuugucuguuucgagcacaaggggcaguacaaaggaaccauggacuccggccagacgaagcgggaacugaaaucuuuugauaucagccaaugccccaagauugggggacacggcuccaagaaauguacaggggacgcugccuucugcagcgccuaugaguguaccgcucaguacgccaaugcguauugcucucaugcuaacggauccggcaucgugcagauccaaguuagcggcguguggaagaaaccccucugugucggguacgagcgcgugguugugaagagagaacugucugccaaaccuauucagcgggucgagccgugcacaaccuguaucaccaagugcgaaccccacggacuggugguccgcagcacaggcuuuaagauuuccucugccguggcuugugccagcgggguuugcgugacgggaucccagagcccuucuaccgagaucacacucaaauaucccggcauuucccagagcucugggggcgauaucggaguccauauggcucacgacgaucaauccgugagcuccaagaucguugcccauugcccuccccaggacccgugucuggugcacggcugcauugucugugcgcacgggcuuaucaauuaccagugccauaccgcccugucugcuuucguggugauuuucguuuuuagcuccacagccaucauuugucucgcuguccuguauagagugcuuaaaugccugaagaucgccccucggaaagugcucaacccccugauguggaucaccgcguucauuagaugggucuacaagaaaaugguggcccgcguugcugacaacaucaaucaggugaaccgggaaauuggauggauggagggcgggcaacuggcccucggaaauccugcucccaucccuagacacgcccccauuccgcgcuacucuacguaucugaugcuucugcucaucgucagcuacgccuccgcuuguagcgagcugauucaggcgucuucccggaucacaaccugcagcaccgaaggcgugaacacaaaguguagacugucugggaccgcccuuauccgcgcuggcuccguuggagccgaggccugccucaugcugaagggcgugaaagaagaucagacaaaguuucugaaaauuaagacggucagcucugagcucagcugucgggaggggcaguccuauuggaccggauccuucucuccuaaaugccuguccagcagacgcugccaucuugugggcgaaugucacguuaaucggugccuguccuggagagacaacgagacaucugcugaauuuagcuucgugggggaguccaccacaaugcgcgaaaauaaguguuuugagcaaugcggaggcuggggguguggcugcuucaacgucaaucccucuugucucuuugugcacaccuaccugcagagcgugcggaaggaggcccugagagucuucaacugcaucgauuggguucauaaacuuacgcucgaaauuaccgacuuugauggauccgugucuacaaucgaccugggcgcgagcuccagccgguucaccaauugggggucugugucccugagccucgaugcugagggaauuucuggcuccaacagcuuuucuuucaucgaaucccccgggaagggauaugccaucgucgacgagccuuucagcgaaauuccgcgccagggcuuucugggggagaucagauguaauuccgagagcucugugcuuagcgcccacgaauccugccugcgggcucccaaccucguuucuuacaaaccuaugauugaucagcuggaguguacaaccaaucugaucgaccccuucguggucuuugaaagaggcagccuuccucaaacgcgcaacgauaagacauucgccgcguccaaaggaaaccggggcgugcaggcuuuuucuaaggggagcguucaggccgaccucacccugauguucgauaauuuugagguggacuucgucggagccgcuguguccugcgacgccgcuuuucugaaccucacaggcugcuauucuuguaaugccggggcgagaguuugccugagcauuaccuccaccggaacaggcacgcuuagcgcccauaacaaggauggcucucugcacaucgugcuccccuccgaaaaugggaccaaagaccaaugucagauccugcauuucacagucccugagguggaggaagaguuuauguacagcugcgauggagacgaacgcccccugcuugugaagggcacccucauugcuaucgauccguucgacgauagacgggaggccgggggagagucuacagucguuaacccuaaauccggcagcuggaacuuuuucgacugguucuccgggcugaugucuugguuuggaggcccccugaagaccauucuccugaucugucuuuacguggcucugagcauuggccucuucuuucugcugaucuaucuugggcgcacgggacuguccaaaauguggcucgccgccacaaagaaggcuagcuga

SEQ ID NO: 14492 - RNA, 3480 nt, Artificial Sequence
  derived and/or modified CDS sequence (opt5) from RVFV(ANK-3837)__DQ380215.1__NSm-Gn-Gc
augaucgagggcgccugggacagccugagagaagaggaaaugcccgaggaacucuccugcucuauuagcgggauccgggaggugaagaccuccucucaggagcuguaccgcgcucuuaaagccauuaucgcggcugauggacugaauaauauuacaugucacggcaaggacccugaagauaaaaucagccucaucaaggggccgccccauaaaaagagagucggaauuguucggugcgagcgcagacgggacgccaagcaaaucggccgcgaaacgauggccgggauugcuaugaccgugcugccugcccuugcuguguucgcccuggcgcccgucguguuugccgaggauccucaccucagaaaccggcccggaaaaggccauaauuauaucgacggcaugacacaggaggaugcuaccuguaagccuguuacauacgccggggcuugcuccucuuucgacgugcugcuggaaaaaggaaaguuuccccucuuccagagcuaugcccaccaucgcacccugcuugaggcgguccacgauacaauuaucgccaaagcugacccgccuuccugugaucugcagagcgcccacggcaaccccugcaugaaggaaaagcucgugaugaaaacccauuguccuaaugacuaccaaucugcucacuaucugaacaaugaugggaagauggccuccguuaaaugucccccgaaguacgagcuuacggaagacugcaacuuuugcagacagaugaccggagccagccugaaaaagggcucuuauccucuccaggaccuguucugucaguccagcgaggaugacgggucuaaacugaagacaaagaugaaaggagugugcgaggucggcgugcaagcucucaagaaaugcgauggccagcuguccaccgcgcaugaagugguccccuuugccguuuucaagaauagcaaaaagguguaccuugacaagcuggaucucaaaacagaggaaaaccugcuuccugacuccuuuguguguuucgagcacaaggggcaguacaaaggaaagcuggauucuggccagaccaaacgggaacucaagagcuuugacauuucccaaugccccaagaucgggggacacggcagcaaaaaguguacgggggaugcugccuucugcucugccuaugaguguacagcucaguacgccaaugcguauugcucccaugcuaacggaagcggcaucguccagauucaagugucuggcguuuggaaaaagccccugugugugggguacgagcgcgucgugguuaaaagagaacugagcgccaagccuauccagcggguggagccgugcaccacauguauuaccaagugcgaaccccacggacucgucgugcgcuccaccggcuuuaaaaucucuagcgccgucgcuugugccuccggggugugcguuacaggaagccagucuccuuccacggagauuacccugaaguaucccggcaucagccagucuuccgggggcgacaucggagugcauauggcucacgaugaccaaagcgucuccucuaaaauuguggcccauugcccuccccaggacccgugucuuguucacggcugcaucgugugugcgcacgggcugauuaauuaccagugccauacagcccucagcgcuuucgucgugguguucgucuuuuccucuaucgccauuaucugucuggcuauccuuuauagaguucugaagugccucaaaauugccccucggaaggugcugaacccccugauguggaucaccgcguucauuagauggguguaccgcaaaauggucgcccggguggcugauaauaucaaccagguuaacagagaaauuggauggauggagggcgggcaacucgugcugggaaauccugcccccaucccucgccacguccccauuccgcgguacagcacauaucuuaugcugcuccugaucguguccuacgcuagcgccuguucugagcugauccaggccuccagcagaauuaccacgugcucuacagaaggcguuaacaccaagugucgccuuuccgggaccgcucucauccgggcgggcagcgugggagccgaggcuugccugaugcugaagggcgucaaagaagaccagacaaaguuucucaaaauuaagaccgugucuagcgagcuguccuguagagaggggcagagcuauuggacaggaucuuucuccccuaaaugccuuagcucccgccggugccaucugguuggcgaaugucacgugaauagaugccucucuuggcgcgauaacgagacgagcgccgaauuuuccuucgucggggagucuaccacaaugcgggaaaauaaguguuuugagcaaugcggaggcuggggguguggcugcuucaacgugaaucccagcugucuguuugugcacaccuaccugcaguccgucagaaaggaggcccuucggguuuucaacugcaucgacugggugcauaaacucacacuggaaauuaccgauuuugacggaucugugagcacgaucgaucugggcgcuuccagcucucgcuucaccaauuggggguccgucagccucucucuggacgccgagggaaucuccggcagcaacucuuuuuccuucauugaaagccccgggaagggauaugcgaucguggaugagccuuucuccgaaauuccgagacagggcuuucuuggggagauccgguguaauagcgagucuagcguucuguccgcucacgaaucuugccucagagcccccaaccugauuagcuacaaaccuaugaucgaccagcuggaguguacaaccaaucuuaucgaucccuucguggucuuugaacgcggcucccucccucaaacacggaacgacaagaccuucgccgcuucuaaaggaaauagaggcgugcaggccuuuagcaagggguccguucaggcggaucugacgcugauguucgacaacuuugagguggacuucgucggagcugccgugucuugcgaugccgcuuuucucaaccugacaggcugcuauagcuguaaugccggggcucgcguuugccuuuccauuaccagcacaggaaccggcacccugucugcccauaacaaggacggcucccuccacaucgugcugcccagcgaaaaugggacaaaagaucaaugucagauucugcauuucacggucccugagguggaggaagaguuuauguacucuugcgacggagaugaaagaccccuucucgugcggggcacccugaucgcgauugacccguucgaugaccgcagagaggccgggggagaguccacagucguuaacccuaagagcggcuccuggaacuuuuucgauugguucucugggcugaugagcugguuuggaggcccccucaaaaccauccugcuuaucugucuguacguggcucucuccauuggccuguucuuucugcuuaucuaucuggggcggacaggacucagcaagauguggcuggccgcuaccaaaaaggccucuuga

SEQ ID NO: 14493 - RNA, 3480 nt, Artificial Sequence
  derived and/or modified CDS sequence (opt5) from RVFV(Lunyo)__KU167026.1__NSm-Gn-Gc
augaucgagggcgccugggacagccugagagaagaggaaaugcccgaggaacucuccugcucuauuagcgggauccgggaggugaagaccuccucucaggagcuguaccgcgcucuuaaagccauuaucgcggcugauggacugaauaauauuacaugucacggcaaggacccugaagauaaaaucagccucaucaaggggccgccccauaaaaagagagucggaauuguucggugcgagcgcagacgggacgccaagcaaaucggccgcgaaacgauggccgggauugcuaugaccgugcugccugcccuugcuguguucgcccuggcgcccgucguguuugccgaggauccucaccucagaaaccggcccggaaaaggccauaauuauaucgacggcaugacacaggaggaugcuaccuguaagccuguuacauacgccggggcuugcuccucuuucgacgugcugcuggaaaaaggaaaguuuccccucuuccagagcuaugcccaccaucgcacccugcuugaggcgguccacgauacaauuaucgccaaagcugacccgccuuccugugaucugcagagcgcccacggcaaccccugcaugaaggaaaagcucgugaugaaaacccauuguccuaaugacuaccaaucugcucacuaucugaacaaugaugggaagauggccuccguuaaaugucccccgaaguacgagcuuacggaagacugcaacuuuugcagacagaugaccggagccagccugaaaaagggcucuuauccucuccaggaccuguucugucaguccagcgaggaugacgggucuaaacugaagacaaagaugaaaggagugugcgaggucggcgugcaagcucucaagaaaugcgauggccagcuguccaccgcgcaugaagugguccccuuugccguuuucaagaauagcaaaaagguguaccuugacaagcuggaucucaaaacagaggaaaaccugcuuccugacuccuuuguguguuucgagcacaaggggcaguacaaaggaaccauggucucuggccagacgaagcgggaacugaaauccuuugauauuagccaaugccccaagaucgggggacacggcagcaagaaauguacaggggacgcugccuucugcucugccuaugaguguaccgcucaguacgccaaugcguauugcucccaugcuaacggaagcggcaucgugcagauucaaguuucuggcguguggaagaaaccccucugugucggguacgagcgcgugguugugaagagagaacugagcgccaaaccuauccagcgggucgagccgugcacaaccuguauuaccaagugcgaaccccacggacuggugguccgcuccacaggcuuuaagaucucuagcgccguggcuugugccuccgggguuugcgugacgggaagccagucuccuuccaccgagauuacacucaaauaucccggcaucagccagucuuccgggggcgauaucggaguccauauggcucacgacgaucaaagcguguccucuaagauuguugcccauugcccuccccaggacccgugucuggugcacggcugcaucgucugugcgcacgggcuuauuaauuaccagugccauaccgcccugagcgcuuucguggugguuuucgucuuuuccucuguggccaucauuugucucgcuauccuguauaaagugcuuaagugccugaaaaucgccccuagaaagguccucaacccccugauguggauuacagcguucauccgguggguguacaaaaagaugguugccagaguggcugacaauauuaaccaggucaaccgcgaaaucggauggauggagggcgggcaacuggcccucggaaauccugcucccauuccucggcacgcccccaucccgagauacagcaccuaucugaugcuucugcucauuguguccuacgccagcgcuuguucugagcugauccaggcguccagccgcaucacgacaugcucuaccgaaggcguuaacacccgguguagacuguccgggacagcccuuauucgcgcuggcagcgugggagccgaggccugccucaugcugaagggcgucaaagaagaucagaccaaguuucugaaaaucaagacagugucuagcgagcucuccugucgggaggggcagagcuauuggacgggaucuuucuccccuaaaugccugagcuccagacgcugccaucuuguuggcgaaugucacgugaaucggugccugucuuggagagacaacgagaccagcgcugaauuuuccuucgucggggagucuacaaccaugcgcgaaaauaaguguuuugagcaaugcggaggcuggggguguggcugcuucaacgugaaucccagcugucucuuugugcacacauaccugcaguccguccggaaggaggcccugagaguuuucaacugcauugauugggugcauaaacuuacccucgaaaucacggacuuugauggaucugugagcaccauugaccugggcgcguccagcucucgguucacaaauuggggguccgucagccugucucucgaugcugagggaaucuccggcagcaacucuuuuuccuucaucgaaagccccgggaagggauaugccauuguggacgagccuuucuccgaaaucccgcgccagggcuuucugggggagauuagauguaauagcgagucuagcguucuuuccgcccacgaaucuugccugcgggcucccaaccucaucagcuacaaaccuaugauugaucagcuggaguguaccacaaaucugaucgaccccuucguggucuuugaaagaggcucccuuccucaaacccgcaacgauaagacguucgccgcgucuaaaggaaaucggggcgugcaggcuuuuagcaagggguccguucaggccgaccucacacugauguucgauaacuuugagguggacuucgucggagccgcugugucuugcgacgccgcuuuucugaaccucaccggcugcuauagcuguaaugccggggcgagaguuugccuguccaucacaagcaccggaaccggcacacuuucugcccauaacaaggauggcucccugcacauugugcuccccagcgaaaaugggacgaaagaccaaugucagauccugcauuucaccgucccugagguggaggaagaguuuauguacucuugcgauggagacgaacgcccccugcuugugaagggcacacucauugcuaucgauccguucgacgauagacgggaggccgggggagaguccaccgucguuaacccuaaaagcggcuccuggaacuuuuucgacugguucucugggcugaugagcugguuuggaggcccccugaagacaauucuccugaucugucuuuacguggcucuguccaucggccucuucuuucugcugauuuaucuugggcgcaccggacugagcaaaauguggcucgccgccacgaagaaggcuucuuga

SEQ ID NO: 14494 - RNA, 3480 nt, Artificial Sequence
  derived and/or modified CDS sequence (opt5) from RVFV(RVFBJ01/2016)__KX785331.1__NSm-Gn-Gc
augaucgagggcgccugggacagccugagagaagaggaaaugcccgaggaacucuccugcucuauuagcgggauccgggaggugaagaccuccucucaggagcuguaccgcgcucuuaaagccauuaucgcggcugauggacugaauaauauuacaugucacggcaaggacccugaagauaaaaucagccucaucaaggggccgccccauaaaaagagagucggaauuguucggugcgagcgcagacgggacgccaagcaaaucggccgcgaaacgauggccgggauugcuaugaccgugcugccugcccuugcuguguucgcccuggcgcccgucguguuugccgaggauccucaccucagaaaccggcccggaaaaggccauaauuauaucgacggcaugacacaggaggaugcuaccuguaagccuguuacauacgccggggcuugcuccucuuucgacgugcugcuggaaaaaggaaaguuuccccucuuccagagcuaugcccaccaucgcacccugcuugaggcgguccacgauacaauuaucgccaaagcugacccgccuuccugugaucugcagagcgcccacggcaaccccugcaugaaggaaaagcucgugaugaaaacccauuguccuaaugacuaccaaucugcucacuaucugaacaaugaugggaagauggccuccguuaaaugucccccgaagcaugagcuuacggaagacugcaacuuuugcagacagaugaccggagccagccugaaaaagggcucuuacccucuccaggaccuguucugucaguccagcgaggaugacgggucuaaacugaagacaaagaugaaaggagugugcgaggucggcgugcaagcucucaagaaaugcgauggccagcuguccaccgcgcacgaagugguccccuuugccguuuucaagaauagcaaaaagguguaucuugacaagcuggaucucaaaacagaggaaaaccugcuuccugacuccuuuguguguuucgagcacaaggggcaguacaaaggaaccauggauucuggccagacgaagcgggaacugaaauccuuugacauuucccaaugccccaagaucgggggacauggcagcaagaaauguacaggggaugcugccuucugcucugccuacgaguguaccgcucaguaugccaaugcguacugcucccacgcuaacggaagcggcaucguccagauucaagugucuggcguuuggaagaaaccccucugugugggguaugagcgcgucgugguuaagagagaacugagcgccaaaccuauccagcggguggagccgugcacaaccuguauuaccaagugcgaaccccauggacuggucgugcgcuccacaggcuuuaagaucucuagcgccgucgcuugugccuccggggugugcguuacgggaagccagucuccuuccaccgagauuacacucaaauaccccggcaucagccagucuuccgggggcgacaucggagugcacauggcucaugaugaccaaagcgucuccucuaagauuguggcccacugcccuccccaggacccgugucugguucacggcugcaucgugugugcgcaugggcuuauuaauuaucagugccacaccgcccugagcgcuuucgucgugguguucguuuuuagcucugucgccaucauuugucucgcuauccuguacaaagugcuuagaugccugaagaucgccccuaaaaaggugcucaacccccugauguggauuacagcguucauccggugggucuauaaaaagaugguggccagaguugcugauaauauuaaccaggugaaccgcgaaaucggauggauggagggcgggcaacuggcccucggaaauccugcucccauuccucggcaugcccccaucccgagauacagcaccuaccugaugcuucugcucauuaucuccuaugccagcgcuuguucugagcugauccaggcguccagccgcauuacgacaugcucuaccgaaggcgucaacaccaagugucggcuguccgggacagcccuuaucagagcuggcagcgugggagccgaggccugccucaugcugaaaggcguuaaggaagaccagaccaaauuucugaagauuaaaacagugucuagcgagcucuccugucgcgaggggcagagcuacuggacgggaucuuucuccccuaagugccugagcucccggagaugccaccuugucggcgaaugucacgugaaucgcugccugucuuggcgggauaacgagaccagcgcugaauuuuccuucguuggggagucuacaaccaugagagaaaauaaguguuuugagcaaugcggaggcuggggguguggcugcuucaacgugaaucccagcugucucuuuguccauacauaucugcaguccgugcgcaaagaggcccugcggguguucaacugcaucgacuggguccacaaacuuacccucgaaauuacggauuuugacggaucuguuagcaccaucgaucugggcgcguccagcucuagauucacaaauuggggguccgugagccugucucucgacgcugagggaaucuccggcagcaacucuuuuuccuucauugaaagccccgggaaaggauacgccaucguggaugagccuuucuccgaaauuccgcggcagggcuuucugggggagauccgcuguaauagcgagucuagcguccuuuccgcccaugaaucuugccugagagcucccaaccucauuagcuauaagccuaugaucgaccagcuggaguguaccacaaaucugaucgaucccuucgugguuuuugaacggggcucccuuccucaaaccagaaacgacaaaacguucgccgcgucuaagggaaaucgcggcgugcaggcuuuuagcaagggguccguccaggccgaucucacacugauguucgacaacuuugagguggacuucguuggagccgcugugucuugcgaugccgcuuuucugaaccucaccggcugcuacagcuguaaugccggggcgcgggucugccuguccauuacaagcaccggaaccggcacacuuucugcccacaacaaagacggcucccugcauaucgugcuccccagcgaaaaugggacgaaggaucaaugucagauucugcacuucaccguuccugagguggaggaagaguuuauguauucuugcgacggagaugaaagaccccugcuugucaaaggcacacucaucgcuauugacccguucgaugaccgcagagaggccgggggagaguccaccguggugaacccuaagagcggcuccuggaacuuuuucgauugguucucugggcugaugagcugguuuggaggcccccugaaaacaauccuccugaucugucuuuacgucgcucuguccauuggccucuucuuucugcugaucuaccuugggcggaccggacugagcaagauguggcucgccgccacgaagaaggcuucuuga

SEQ ID NO: 14495 - RNA, 3480 nt, Artificial Sequence
  derived and/or modified CDS sequence (opt5) from RVFV(Ken 199800523)__KU978777.1__NSm-Gn-Gc
augaucgagggcgccugggacagccugagagaagaggaaaugcccgaggaacucuccugcucugugagcgggauucgggaggucaagaccuccucucaggagcuguaccgcgcucuuaaagccaucauugcggcugauggacugaacaauaucacaugucacggcaagaacccugaagacaaaauuagccucaucaaggggccgccccauaaaaagagaguuggaaucgugcggugcgagcgcagacgggauacgaagcaaauuggccgcgaaaccauggccgggaucgccaugacagugcugccugcucuugccgucuucgcucuggcccccgugguuuuugcggaggacccucaccucagaaaucggcccggaaaaggccauaacuauauugauggcaugacccaggaggacgccacauguaagccugugaccuacgcuggggccugcuccucuuucgauguccugcuggaaaaaggaaaguuuccccucuuccagagcuaugcucaccaucgcacacugcuugaggccgugcacgacaccaucauugcgaaagccgaucccccuuccugugaccugcagagcgcucacggcaaucccugcaugaaggaaaagcucguuaugaaaacgcauuguccuaacgauuaccaaucugcccacuaucugaauaacgacgggaagauggcuuccgugaaaugcccgccgaaguacgagcuuaccgaagauuguaauuuuugcagacagaugacaggagccagccugaaaaagggcucuuauccucuccaggaccuguucugucaguccagcgaggacgaugggucuaaacugaagaccaagaugaaaggagucugcgaggugggcgugcaagcccucaagaaaugcgacggccagcuguccacagcucaugaagucguucccuuugcgguguucaagaacagcaaaaagguguaccuugauaagcuggaccucaaaaccgaggaaaaucugcuuccugauuccuuugucuguuucgagcacaaggggcaguacaaaggaacgauggacucuggccagacaaagcgggaacugaaauccuuugauaucagccaaugccccaagauugggggacacggcagcaagaaauguaccggggacgccgcuuucugcucugccuaugaguguacagcccaguacgcuaacgccuuuugcucccaugcgaauggaagcggcaucgugcagauccaaguuucuggcguguggaagaaaccccucugugucggguaugagcgcgugguugugaagagagaacugagcgcuaaaccuauucagcgggucgagccgugcaccaccuguaucacaaagugcgaaccccacggacuggugguccgcuccacgggcuucaagauuucuagcgccguggccugugcuuccgggguuugcgugaccggaagccagucuccuuccacagagaucacccucaaauaccccggcauuagccagucuuccgggggcgauaucggaguccauauggcccacgacgaucaaagcguguccucuaagaucguugcucauugcccuccccaggacccgugucuggugcacggcugcauugucugugcccacgggcuuaucaacuaucagugccauacagcgcugagcgccuucguggugguuuuugucuucuccucuauugcuaucauuugucucgccauccuguacagagugcuuaaaugccugaagaucgcuccucggaaagugcucaauccccugauguggauuaccgccuuuaucagaugggucuauaagaaaaugguggcgcgcguugccgacaacauuaaccaggugaaucgggaaaucggauggauggagggcgggcaacugguccucggaaacccugcucccauuccuagacacgcccccaucccgcgcuacagcacguaccugaugcuucugcucauuguguccuaugcuagcgccuguucugagcugauccaggccuccagccggaucacaaccugcucuaccgaaggcguuaauacaaaguguagacuguccgggaccgcucuuauucgcgcgggcagcgugggagccgaggcuugccucaugcugaagggcgucaaagaagaucagacaaaguuccugaaaaucaagacggugucuagcgagcucuccugucgggaggggcagagcuacuggaccggaucuuuuuccccuaaaugccugagcuccagacgcugccaucuuguuggcgaaugucacgugaaccggugccugucuuggagagacaaugagacaagcgccgaguucuccuuugucggggaaucuaccacaaugcgcgaaaacaaguguuucgagcaaugcggaggcuggggguguggcugcuuuaaugugaaccccagcugucucuucgugcacaccuaucugcaguccguccggaaggaggcccugagaguuuuuaauugcauugauugggugcauaaacuuacgcucgaaaucaccgacuucgauggaucugugagcacaauugaccugggcgcuuccagcucucgguuuaccaacuggggguccgucagccugucucucgaugccgagggaaucuccggcagcaauucuuucuccuucaucgaaagccccgggaagggauacgcgauuguggacgagccuuuuuccgaaaucccgcgccagggcuuccugggggagauuagauguaacagcgagucuagcguucuuaaugcucacgaauccugccugcgggcccccaaccucaucucuuauaaaccuaugauugaucagcuggaguguacaaccaaucugaucgaccccuuuguggucuucgaaagaggcagccuuccucaaacgcgcaacgauaagacauuugccgcuuccaaaggaaaccggggcgugcaggccuucucuaaggggagcguucaggcggaccucacccugauguuugauaauuucgagguggacuuugucggagcugccguguccugcgacgccgcuuuccugaaccucacaggcugcuacucuuguaaugccggggcuagaguuugccugagcaucaccuccaccggaacaggcacgcuuagcgcccauaacaaggaaggcucucugcacauugugcuccccuccgagaaugggaccaaagaucaaugucagauccugcauuuuacagucccugagguggaagaggaguucauguauagcugcgacggagaugaacgcccccugcuugugaagggcacccucauugcgaucgacccguuugaugacagacgggaggccgggggagaaucuacagucguuaacccuaaauccggcagcuggaauuucuucgauugguuuuccgggcugaugucuugguucggaggcccccugaagaccauucuccugaucugucuuuacguggcucugagcaucggccucuuuuuccugcugauuuaccuugggcgcacgggacuguccaaaauguggcucgccgcuacaaagaaggccagcuga

SEQ ID NO: 14496 - RNA, 3480 nt, Artificial Sequence
  derived and/or modified CDS sequence (opt5) from RVFV__JQ068143.1__NSm-Gn-Gc
augaucgagggcgccugggacagccugagagaagaggaaaugcccgaggaacucuccugcucuauuagcgggauccgggaggugaagaccuccucucaggagcuguaccgcgcucuuaaagccauuaucgcggcugauggacugaauaauauuacaugucacggcaaggacccugaagauaaaaucagccucaucaaggggccgccccauaaaaagagagucggaauuguucggugcgagcgcagacgggacgccaagcaaaucggccgcgaaacgauggccgggauugcuaugaccgugcugccugcccuugcuguguucgcccuggcgcccgucguguuugccgaggauccucaccucagaaaccggcccggaaaaggccauaauuauaucgacggcaugacacaggaggaugcuaccuguaagccuguuacauacgccggggcuugcuccucuuucgacgugcugcuggaaaaaggaaaguuuccccucuuccagagcuaugcccaccaucgcacccugcuugaggcgguccacgauacaauuaucgccaaagcugacccgccuuccugugaucugcagagcgcccacggcaaccccugcaugaaggaaaagcucgugaugaaaacccauuguccuaaugacuaccaaucugcucacuaucugaacaaugaugggaagauggccuccguuaaaugucccccgaaguacgagcuuacggaagacugcaacuuuugcagacagaugaccggagccagccugaaaaagggcucuuauccucuccaggaccuguucugucaguccagcgaggaugacgggucuaaacugaagacaaagaugaaaggagugugcgaggucggcgugcaagcucucaagaaaugcgauggccagcuguccaccgcgcaugaagugguccccuuugccguuuucaagaauagcaaaaagguguaccuugacaagcuggaucucaaaacagaggaaaaccugcuuccugacuccuuuguguguuucgagcacaaggggcaguacaaaggaaccauugauucuggccagacgaagcgggaacugaaauccuuugacaucucccaaugccccaagaucgggggacacggcagcaagaaauguacaggggaugcugccuucugcucugccuaugaguguaccgcucaguacgccaaugcguauugcucccaugcuaacggaagcggcauuguccagauccaagugucuggcguuuggaagaaaccccucugugugggguacgagcgcgucgugguuaagagagaacugagcgccaaaccuauucagcggguggagccgugcacaaccuguaucaccaagugcgaaccccacggacuggucgugcgcuccacaggcuuuaagauuucuagcgccgucgcuugugccuccggggugugcguuacgggaagccagucuccuuccaccgagaucacacucaaauaucccggcaucagccagucuuccgggggcgacauuggagugcauauggcucacgaugaccaaagcgucuccucuaagaucguggcccauugcccuccccaggacccgugucugguucacggcugcauugugugugcgcacgggcuuaucaauuaccagugccauaccgcccugagcgcuuucgucgugguguucguuuuuagcucugucgccauuaucugucucgcuauccuguauaaagugcuuagaugccugaagauugccccuaaaaaggugcucaacccccugauguggaucacagcguucauucggugggucuacaaaaagaugguggccagaguugcugauaauaucaaccaggugaaccgcgaaauuggauggauggagggcgggcaacuggcccucggaaauccugcucccaucccucggcacgcccccauuccgagauacagcaccuaucugaugcuucugcucaucaucuccuacgccagcgcuuguucugagcugauucaggcguccagccgcaucacgacaugcucuaccgaaggcgucaacaccaagugucggcuguccgggacagcccuuauuagagcuggcagcgugggagccgaggccugccucaugcugaaaggcguuaaggaagaccagaccaaauuucugaagaucaaaacagugucuagcgagcucuccugucgcgaggggcagagcuauuggacgggaucuuucuccccuaagugccugagcucccggagaugccaucuugucggcgaaugucacgugaaucgcugccugucuuggcgggauaacgagaccagcgcugaauuuuccuucguuggggagucuacaaccaugagagaaaauaaguguuuugagcaaugcggaggcuggggguguggcugcuucaacgugaaucccagcugucucuuuguccacacauaccugcaguccgugcgcaaagaggcccugcggguguucaacugcauugacuggguccauaaacuuacccucgaaaucacggauuuugacggaucuguuagcaccaucgaucugggcgcguccagcucuagauucacaaauuggggguccgugagccugucucucgacgcugagggaauuuccggcagcaacucuuuuuccuucaucgaaagccccgggaaaggauaugccauuguggaugagccuuucuccgaaaucccgcggcagggcuuucugggggagauucgcuguaauagcgagucuagcguccuuuccgcccacgaaucuugccugagagcucccaaccucaucagcuacaagccuaugaucgaccagcuggaguguaccacaaaucugauugaucccuucgugguuuuugaacggggcucccuuccucaaaccagaaacgacaaaacguucgccgcgucuaagggaaaucgcggcgugcaggcuuuuagcaagggguccguccaggccgaucucacacugauguucgacaacuuugagguggacuucguuggagccgcugugucuugcgaugccgcuuuucugaaccucaccggcugcuauagcuguaaugccggggcgcgggucugccuguccaucacaagcaccggaaccggcacacuuucugcccauaacaaagacggcucccugcacauugugcuccccagcgaaaaugggacgaaggaucaaugucagauccugcauuucaccguuccugagguggaggaagaguuuauguacucuugcgacggagaugaaagaccccugcuugucaaaggcacacucauugcuaucgacccguucgaugaccgcagagaggccgggggagaguccaccguggugaacccuaagagcggcuccuggaacuuuuucgauugguucucugggcugaugagcugguuuggaggcccccugaaaacaauccuccugauuugucuuuacgucgcucuguccaucggccucuucuuucugcugauuuaucuugggcggaccggacugagcaagauguggcucgccgccacgaagaaggcuucuuga

SEQ ID NO: 14497 - RNA, 3480 nt, Artificial Sequence
  derived and/or modified CDS sequence (opt5) from RVFV(200803169)__JF311384.1__NSm-Gn-Gc
augaucgagggcgccugggacagccugagagaagaggaaaugcccgaggaacucuccugcucugugagcgggauucgggaggucaagaccuccucucaggagcuguaccgcgcucuuaaagccaucauugcggcugauggacugaacaauaucacaugucacggcaagaacccugaagacaaaauuagccucaucaaggggccgccccauaaaaagagaguuggaaucgugcggugcgagcgcagacgggaugccaagcaaauuggccgcgaaacgauggccgggaucgcuaugaccgugcugccugcccuugcugucuucgcccuggcgcccgugguuuuugccgaggacccucaccucagaaaucggcccggaaaaggccauaacuauauugauggcaugacacaggaggacgcuaccuguaagccugugacauacgccggggcuugcuccucuuucgauguccugcuggaaaaaggaaaguuuccccucuuccagagcuaugcccaccaucgcacccugcuugaggcggugcacgacacaaucauugccaaagcugaucccccuuccugugaccugcagagcgcccacggcaaucccugcaugaaggaaaagcucguuaugaaaacccauuguccuaacgauuaccaaucugcucacuaucugaauaacgacgggaagauggccuccgugaaaugcccgccgaaguacgagcuuacggaagauuguaauuuuugcagacagaugaccggagccagccugaaaaagggcucuuauccucuccaggaccuguucugucaguccagcgaggacgaugggucuaaacugaagacaaagaugaaaggagucugcgaggugggcgugcaagcucucaagaaaugcgacggccagcuguccaccgcgcaugaagucguucccuuugccguguucaagaacagcaaaaagguguaccuugauaagcuggaccucaaaacagaggaaaaucugcuuccugauuccuuugucuguuucgagcacaaggggcaguacaaaggaaccauggacucuggccagacgaagcgggaacugaaauccuuugauaucucccaaugccccaagauugggggacacggcagcaagaaauguacaggggacgcugccuucugcucugccuaugaguguaccgcucaguacgccaacgcguauugcucccaugcuaauggaagcggcaucgugcagauccaaguuucuggcguguggaagaaaccccucugugucggguacgagcgcgugguugugaagagagaacugagcgccaaaccuauucagcgggucgagccgugcacaaccuguaucaccaagugcgaaccccacggacuggugguccgcuccacaggcuuuaagauuucuagcgccguggcuugugccuccgggguuugcgugacgggaagccagucuccuuccaccgagaucacacucaaauaucccggcauuagccagucuuccgggggcgauaucggaguccauauggcucacgacgaucaaagcguguccucuaagaucguugcccauugcccuccccaggacccgugucuggugcacggcugcauugucugugcgcacgggcuuaucaacuaccagugccauaccgcccugagcgcuuucguggugauuuucguuuuuagcucuacagccaucauuugucucgcuguccuguauagagugcuuaaaugccugaagaucgccccucggaaagugcucaauccccugauguggaucaccgcguucauuagaugggucuacaagaaaaugguggcccgcguugcugacaacaucaaccaggugaaucgggaaauuggauggauggagggcgggcaacuggcccucggaaacccugcucccaucccuagacacgcccccauuccgcgcuacagcacguaucugaugcuucugcucaucgucuccuacgccagcgcuuguucugagcugauucaggcguccagccggaucacaaccugcucuaccgaaggcgugaauacaaaguguagacuguccgggaccgcccuuauccgcgcuggcagcguuggagccgaggccugccucaugcugaagggcgugaaagucgaucagacaaaguuucugaaaauuaagacggugucuagcgaacucuccugucgggaggggcagagcuauuggaccggaucuuucuccccuaaaugccugagcuccagacgcugccaucuuguuggcgagugucacgugaaccggugccugucuuggagagacaaugaaacaagcgcugaguuuuccuucgucggggaaucuaccacaaugcgcgagaacaaguguuuugaacaaugcggaggcuggggguguggcugcuucaaugugaaccccagcugucucuuugugcacaccuaccugcaguccguccggaaggaggcccugagaguuuucaauugcaucgauugggugcauaaacuuacgcucgagauuaccgacuuugauggaucugugagcacaaucgaccugggcgcguccagcucucgguucaccaacuggggguccgucagccugucucucgaugcugaaggaauuuccggcagcaauucuuuuuccuucaucgagagccccgggaagggauaugccaucguggacgaaccuuucuccgagauuccgcgccagggcuuucugggggaaguuagauguaacagcgagucuagcgugcuuuccgcccacgagucuugccugcgggcucccaaucucgucagcuacaaaccuaugaucgaucagcuggaauguacaaccaaccugauugaccccuucgugguuuuugagagaggcucccuuccucaaacgcgcaaugauaagacauucgccgcgucuaaaggaaaccggggcgugcaggcuuuuagcaagggguccguccaggccgaccucacccugauguucgauaacuuugaaguggacuucguuggagccgcugugucuugcgacgccgcuuuucugaaucucacaggcugcuauagcuguaacgccggggcgagagucugccuguccaucaccagcaccggaacaggcacgcuuucugcccauaauaaggauggcucccugcacauugugcuccccagcgagaacgggaccaaagaccaaugucagauccugcauuucacagugccugaagucgaggaggaauuuauguacucuugcgauggagacgagcgcccccugcuuguuaagggcacccucaucgcuauugauccguucgacgauagacgggaagccgggggagaguccacaguggugaauccuaaaagcggcuccuggaacuuuuucgacugguucucugggcugaugagcugguuuggaggcccccugaagaccauccuccugauuugucuuuacgucgcucuguccaucggccucuucuuucugcugauuuaucuugggcgcacgggacugagcaaaauguggcucgccgccacaaagaaggcuucuuga

SEQ ID NO: 14498 - RNA, 3480 nt, Artificial Sequence
  derived and/or modified CDS sequence (opt5) from RVFV(2007002445)__EU574037.1__NSm-Gn-Gc
augaucgagggcgccugggacagccugagagaagaggaaaugcccgaggaacucuccugcucugugagcgggauucgggaggucaagaccuccucucaggagcuguaccgcgcucuuaaagccaucauugcggcugauggacugaacaauaucacaugucacggcaagaacccugaagacaaaauuagccucaucaaggggccgccccauaaaaagagaguuggaaucgugcggugcgagcgcagacgggaugccaagcaaauuggccgcgaaacgauggccgggaucgcuaugaccgugcugccugcccuugcugucuucgcccuggcgcccgugguuuuugccgaggacccucaccucagaaaucggcccggaaaaggccauaacuauauugauggcaugacacaggaggacgcuaccuguaagccugugacauacgccggggcuugcuccucuuucgauguccugcuggaaaaaggaaaguuuccccucuuccagagcuaugcccaccaucgcacccugcuugaggcggugcacgacacaaucauugccaaagcugaucccccuuccugugaccugcagagcgcccacggcaaucccugcaugaaggaaaagcucguuaugaaaacccauuguccuaacgauuaccaaucugcucacuaucugaauaacgacgggaagauggccuccgugaaaugcccgccgaaguacgagcuuacggaagauuguaauuuuugcagacagaugaccggagccagccugaaaaagggcucuuauccucuccaggaccuguucugucaguccagcgaggacgaugggucuaaacugaagacaaagaugaaaggagucugcgaggugggcgugcaagcucucaagaaaugcgacggccagcuguccaccgcgcaugaagucguucccuuugccguguucaagaacagcaaaaagguguaccuugauaagcuggaccucaaaacagaggaaaaucugcuuccugauuccuuugucuguuucgagcacaaggggcaguacaaaggaaccauggacucuggccagacgaagcgggaacugaaauccuuugauaucucccaaugccccaagauugggggacacggcagcaagaaauguacaggggacgcugccuucugcucugccuaugaguguaccgcucaguacgccaacgcguauugcucccaugcuaauggaagcggcaucgugcagauccaaguuucuggcguguggaagaaaccccucugugucggguacgagcgcgugguugugaagagagaacugagcgccaaaccuauucagcgggucgagccgugcacaaccuguaucaccaagugcgaaccccacggacuggugguccgcuccacaggcuuuaagauuucuagcgccguggcuugugccuccgggguuugcgugacgggaagccagucuccuuccaccgagaucacacucaaauaucccggcauuagccagucuuccgggggcgauaucggaguccauauggcucacgacgaucaaagcguguccucuaagaucguugcccauugcccuccccaggacccgugucuggugcacggcugcauugucugugcgcacgggcuuaucaacuaccagugccauaccgcccugagcgcuuucguggugauuuucguuuuuagcucuacagccaucauuugucucgcuguccuguauagagugcuuaaaugccugaagaucgccccucggaaagugcucaauccccugauguggaucaccgcguucauuagaugggucuacaagaaaaugguggcccgcguugcugacaacaucaaccaggugaaucgggaaauuggauggauggagggcgggcaacuggcccucggaaacccugcucccaucccuagacacgcccccauuccgcgcuacagcacguaucugaugcuucugcucaucgucuccuacgccagcgcuuguucugagcugauucaggcguccagccggaucacaaccugcucuaccgaaggcgugaauacaaaguguagacuguccgggaccgcccuuauccgcgcuggcagcguuggagccgaggccugccucaugcugaagggcgugaaagaagaucagacaaaguuucugaaaauuaagacggucucuagcgagcucuccugucgggaggggcagagcuauuggaccggaucuuucuccccuaaaugccugagcuccagacgcugccaucuugugggcgaaugucacguuaaccggugccugucuuggagagacaaugagacaagcgcugaauuuuccuucgugggggagucuaccacaaugcgcgaaaacaaguguuuugagcaaugcggaggcuggggguguggcugcuucaaugucaaccccagcugucucuuugugcacaccuaccugcaguccgugcggaaggaggcccugagagucuucaauugcaucgauuggguucauaaacuuacgcucgaaauuaccgacuuugauggaucugugagcacaaucgaccugggcgcguccagcucucgguucaccaacuggggguccgugagccugucucucgaugcugagggaauuuccggcagcaauucuuuuuccuucaucgaaagccccgggaagggauaugccaucgucgacgagccuuucuccgaaauuccgcgccagggcuuucugggggagaucagauguaacagcgagucuagcgugcuuuccgcccacgaaucuugccugcgggcucccaaucucguuagcuacaaaccuaugauugaucagcuggaguguacaaccaaccugaucgaccccuucguggucuuugaaagaggcucccuuccucaaacgcgcaaugagaagacauucgccgcgucuaaaggaaaccggggcgugcaggcuuuuagcaagggguccauucaggccgaucucacccugauguucgacaacuuugaaguugauuucgugggagccgcugucucuugcgacgccgcuuuucugaaucucacaggcugcuauagcuguaacgccggggcgagagugugccuguccaucaccagcaccggaacaggcacgcuuucugcccauaauaaggacggcucccugcacaucguucuccccagcgagaacgggaccaaagaucaaugucagauucugcauuucacagugccugaggucgaagaggaauuuauguacucuugcgacggagaugagcgcccccugcuugugaagggcacccucaucgcuauugacccguucgaugacagacgggaggccgggggagaauccacaguggucaauccuaaaagcggcuccuggaacuuuuucgauugguucucugggcugaugagcugguuuggaggcccccugaagaccauccuccugauuugucuuuacguugcucuguccaucggccucuucuuucugcugaucuaucuugggcgcacgggacugagcaaaauguggcucgccgccacaaagaaggcuucuuga

SEQ ID NO: 14499 - RNA, 3480 nt, Artificial Sequence
  derived and/or modified CDS sequence (opt5) from RVFV(Hv-B375)__DQ380218.1__NSm-Gn-Gc
augaucgagggcgccugggacagccugagagaaggggagaugcccgaggaacucuccugcucuauuagcggaauccgggaagugaagaccuccucucaggagcuguaccgcgcucuuaaagccauuaucgcggcugauggccugaacaauauuacaugucacgggaaggacccugaggauaaaaucagccucaucaagggaccgccccauaaaaagagagucggcauuguucggugcgaacgcagacgggacgccaagcaaaucgggcgcgagacgauggccggaauugcuaugaccgugcugccugcccuugcuguguucgcccuggcgcccgucguguuugccgaagauccucaccucagaaaccggcccggcaaaggccauaauuauaucgacgggaugacacaggaggaugcuaccuguaagccuguuacauacgccggagcuugcuccucuuucgacgugcugcuggagaaaggcaaguuuccccucuuccagagcuaugcccaccaucgcacccugcuugaagcgguccacgauacaauuaucgccaaagcugacccgccuuccugugaucugcagagcgcccacgggaaccccugcaugaaggagaagcucgugaugaaaacccauuguccuaaugacuaccaaucugcucacuaucugaacaaugauggaaagauggccuccguuaaaugucccccgaagaacgaacuuacggaggacugcaauuuuugcagacagaugaccggcgccagccugaaaaaggggucuuacccucuccaggaccuguucugucaguccagcgaagaugacggaucuaaacugaagacaaagaugaaaggcgugugcgaggucggcgugcaagcucucaagaaaugcgaugggcagcuguccaccgcgcaugaggugguccccuuugccguuuucaagaacagcaaaaagguguaucuugacaagcuggaucucaaaacagaagagaaucugcuuccugacuccuuuguguguuucgaacacaagggacaguacaaaggcaccauggauucugggcagacgaagcgggagcugaaauccuuugacauuucccaaugccccaagaucggaggccacgggagcaagaaauguacaggagaugcugccuucugcucugccuacgaauguaccgcucaguaugccaacgcguacugcucccaugcuaauggcagcggcaucguccagauucaagugucugggguuuggaagaaaccccucugugugggauaugagcgcgucgugguuaagagagagcugagcgccaaaccuauccagcggguggaaccgugcacaaccuguauuaccaagugcgagccccacggccuggucgugcgcuccacaggguuuaagaucucuagcgccgucgcuugugccuccggagugugcguuacgggcagccagucuccuuccaccgaaauuacacucaaauaccccgggaucagccagucuuccggcggagacaucggcgugcauauggcucacgaugaccaaagcgucuccucuaagauuguggcccauugcccuccccaggacccgugucugguucacgggugcaucgugugugcgcacggacuuauuaacuaucagugccauaccgcccugagcgcuuucgucgugguguucguuuuuagcucuaucgccauuaucugucucgcuauccuguacagaguccuuaaaugccugaagauugccccucggaaagugcucaauccccugauguggaucacagcguucauuagauggguguauaagaaaauggucgcccgcguggcugauaacaucaaccagguuaaucgggagauuggcuggauggaagggggacaacuggugcucggcaacccugcccccaucccuagacacgcucccauuccgcgcuacagcaccuaccugaugcuucugcucaucgucuccuaugccagcgccuguucugagcugauccaggcuuccagccggauuacgacaugcucuaccgagggggugaauaccaaguguagacuguccggcacagcgcuuauccgcgccggaagcguuggcgcugaagccugccucaugcugaagggggugaaagaggaccagaccaaguuucugaaaauuaagacagucucuagcgaacucuccugucgggagggacagagcuacuggacgggcucuuucuccccuaaaugccugagcuccagacgcugccaucuugugggggagugucacguuaaccggugccugucuuggagagauaaugaaaccagcgccgaguuuuccuucgugggagaaucuacaaccaugcgcgagaacaaguguuuugaacaaugcggcggguggggcuguggaugcuucaaugucaaccccagcugucucuuugugcacacauaucugcaguccgugcggaaggaggcucugagagucuucaauugcaucgacuggguucauaaacuuacccucgagauuacggauuuugacggcucugugagcaccaucgaucugggggccuccagcucucgguucacaaacuggggauccgugagccugucucucgacgcggaaggcaucuccgggagcaauucuuuuuccuucauugagagccccggaaagggcuacgcuaucgucgaugaaccuuucuccgagauuccgcgccagggguuucugggcgaaaucagauguaacagcgagucuagcgugcuuuccgcccacgagucuugccugcgggcccccaaucucauuagcuauaaaccuaugaucgaccagcuggaauguaccacaaaccugaucgaucccuucguuguguuugagagaggaucccuuccucaaacccgcaaugacaagacguucgcugccucuaaaggcaacagagggguccaggcguuuagcaagggauccgugcaggcugaucucacacugauguucgacaacuuugaaguugacuucgugggcgccgccgucucuugcgaugcugccuuucugaaucucaccgggugcuacagcuguaacgcuggagcccgggugugccuguccauuacaagcaccggcaccggcacacuuucugcgcauaauaaggacgggucccugcacaucguucuccccagcgagaacggaacgaaagaucaaugucagauucugcauuucaccgugccugaagucgaggaggaauuuauguauucuugcgacggcgaugagcgcccccugcuugugaaggggacacucaucgccauugacccguucgaugacagacgggaagcuggaggcgaguccaccguggucaauccuaaaagcggguccuggaacuuuuucgauugguucucuggacugaugagcugguuuggcggcccccugaagacaauccuccugaucugucuuuacguugcccuguccauuggacucuucuuucugcugaucuaccuugggcgcaccggccugagcaaaauguggcucgcugccacgaagaaggccucuuga

SEQ ID NO: 14500 - RNA, 3480 nt, Artificial Sequence
  derived and/or modified CDS sequence (opt5) from RVFV(clone 13)__DQ380213.1__NSm-Gn-Gc
augaucgagggcgccugggacagccugagagaagaggaaaugcccgaggaacucuccugcucuauuagcgggauccgggaggugaagaccuccucucaggagcuguaccgcgcucuuaaagccauuaucgcggcugauggacugaacaauauuacaugucacggcaaggacccugaagauaaaaucagccucaucaaggggccgccccauaaaaagagagucggaauuguucggugcgagcgcagacgggacgccaagcaaaucggccgcgaaacgauggccgggauugcuaugaccgugcugccugcccuugcuguguucgcccuggcgcccgucguguuugccgaggauccucaccucagaaaccggcccggaaaaggccauaauuauaucgacggcaugacacaggaggaugcuaccuguaagccuguuacauacgccggggcuugcuccucuuucgacgugcugcuggaaaaaggaaaguuuccccucuuccagagcuaugcccaccaucgcacccugcuugaggcgguccacgauacaauuaucgccaaagcugacccgccuuccugugaucugcagagcgcccacggcaaccccugcaugaaggaaaagcucgugaugaaaacccauuguccuaaugacuaccaaucugcucacuaucugaacaaugaugggaagauggccuccguuaaaugucccccgaagcaugagcuuacggaagacugcaacuuuugcagacagaugaccggagccagccugaaaaagggcucuuacccucuccaggaccuguucugucaguccagcgaggaugacgggucuaaacugaagacaaagaugaaaggagugugcgaggucggcgugcaagcucucaagaaaugcgauggccagcuguccaccgcgcacgaagugguccccuuugccguuuucaagaauagcaaaaagguguaucuugacaagcuggaucucaaaacagaggaaaaccugcuuccugacuccuuuguguguuucgagcacaaggggcaguacaaaggaaccauggauucuggccagacgaagcgggaacugaaauccuuugacauuagccaaugccccaagaucgggggacauggcagcaagaaauguacaggggaugcugccuucugcucugccuacgaguguaccgcucaguaugccaaugcguacugcucccacgcuaacggaagcggcaucguccagauucaagugucuggcguuuggaagaaaccccucugugugggguaugagcgcgucgugguuaagagagaacugagcgccaaaccuauccagcggguggagccgugcacaaccuguauuaccaagugcgaaccccauggacuggucgugcgcuccacaggcuuuaagaucucuagcgccgucgcuugugccuccggggugugcguuacgggaagccagaauccuucuaccgagauuacacucaaauaccccggcaucucccagagcucugggggcgacaucggagugcacauggcucaugaugaccaauccgucagcuccaagauuguggcccacugcccuccccaggacccgugucugguucacggcugcaucgugugugcgcaugggcuuauuaacuaucagugccacaccgcccugucugcuuucgucgugguguucguuuuuagcuccaucgccauuaucugucucgcuauccuguacagaguccuuaaaugccugaagauugccccucggaaagugcucaauccccugauguggaucacagcguucauuagauggguguauaagaaaauggucgcccgcguggcugauaacaucaaccagguuaaucgggaaauuggauggauggagggcgggcaacuggugcucggaaacccugcccccaucccuagacaugcucccauuccgcgcuacucuaccuaccugaugcuucugcucaucgucagcuaugccuccgccuguagcgagcugauccaggcuucuucccggauuacgacaugcagcaccgaaggcgugaauaccaaguguagacugucugggacagcgcuuauccgcgccggcuccguuggagcugaggccugccucaugcugaagggcgugaaagacgaucagaccaaguuucugaaaauuaagacagucagcucugaacucagcugucgggaggggcaguccuacuggacgggcagcuucucuccuaaaugccuguccagcagacgcugccaccuugugggagagugucacguuaaccggugccuguccuggagagacaaugaaaccucugccgaguuuagcuucgugggggaauccacaaccaugcgcgagaacaaguguuuugaacaaugcggaggcuggggguguggcugcuucaaugucaaccccucuugucucuuugugcauacauaucugcagagcgugcggaaggaggcucugagagucuucaauugcaucgauuggguucacaaacuuacccucgagauuacggacuuugauggauccgugucuaccaucgaccugggcgccagcuccagccgguucacaaacugggggucugugucccugagccucgaugcggaaggaaucucuggcuccaauagcuuuucuuucauugagucccccgggaagggauacgcuaucgucgacgaaccuuucagcgagauuccgcgccagggcuuucugggggaaaucagauguaacuccgagagcucugugcuuagcgcccaugaguccugccugcgggcccccaaucucauuucuuauaaaccuaugaucgaucagcuggaauguaccacaaaccugaucgaccccuucguuguguuugagagaggcagccuuccucaaacccgcaaugaaaagacguucgcugccuccaaaggaaaccggggcguccaggcguuuucuaaggggagcgugcaggcugaucucacacugauguucgacaacuuugagguugacuucgugggagccgccgucuccugcgaugcugccuuucugaaucucaccggcugcuacucuuguaacgcuggggccagagugugccugagcauuacauccaccggaaccggcacacuuagcgcgcacaauaaggacggcucucugcauaucguucuccccuccgaaaacgggacgaaagaucaaugucagauucugcacuucaccgugccugaggucgaggaagaguuuauguauagcugcgacggagaugaacgcccccugcuugugaagggcacacucaucgccauugacccguucgaugacagacgggaggcugggggagagucuaccguggucaauccuaaauccggcagcuggaacuuuuucgauugguucuccgggcugaugucuugguuuggaggcccccugaagacaauccuccugaucugucuuuacguugcccugagcauuggccucuucuuucugcugaucuaccuugggcgcaccggacuguccaaaauguggcucgcugccacgaagaaggccagcuga

SEQ ID NO: 14501 - RNA, 3480 nt, Artificial Sequence
  derived and/or modified CDS sequence (opt5) from RVFV(Kenya 57 (Rintoul))__DQ380192.1__NSm-Gn-Gc
augaucgagggcgccugggacagccugagagaagaggaaaugcccgaggaacucuccugcucuauuagcgggauccgggaggugaagaccuccucucaggagcugcaccgcgcucuuaaagccauuaucgcggcugauggacugaauaauauuacaugucauggcaaggacccugaagauaaaaucagccucaucaaggggccgccccacaaaaagagagucggaguugugcggugcgagcgcagacgggacgccaagcaaauuggccgcgaaacgauggccgggaucgcuaugaccgugcugccugcccuugcugucuucgcccuggcgcccgugguuuuugccgaggauccucaucucagaaaccggcccggaaaaggccacaauuacauugacggcaugacacaggaggaugcuaccuguaagccugugacauaugccggggcuugcuccucuuucgacguccugcuggaaaaaggaaaguuuccccucuuccagagcuacgcccaucaccgcacccugcuugaggcggugcacgauacaaucauugccaaagcugacccgccuuccugugaucugcagagcgcccauggcaaccccugcaugaaggaaaagcucguuaugaaaacccacuguccuaaugacuaucaaucugcucauuaccugaacaaugaugggaagauggccuccgugaaaugucccccgaaguaugagcuuacggaagacugcaacuuuugcagacagaugaccggagccagccugaaaaagggcucuuacccucuccaggaccuguucugucaguccagcgaggaugacgggucuaaacugaagacaaagaugaaaggagucugcgaggugggcgugcaagcucucaagaaaugcgauggccagcuguccaccgcgcacgaagucguucccuuugccguguucaagaauagcaaaaagguguaucuugacaagcuggaucucaaaacagaggaaaaccugcuuccugacuccuuugucuguuucgagcacaaggggcaguacaaaggaaccauggauucuggccagaucaagcgggaacugaaauccuuugacauuagccaaugccccaagaucgggggacauggcagcaagaaauguacgggggaugcugccuucugcucugccuacgaguguacagcucaguaugccaaugcguacugcucccacgcuaacggaagcggcaucgugcagauucaaguuucuggcguguggaagaaaccccucugugucggguaugagcgcgugguugugaagagagaacugagcgccaaaccuauccagcgggucgagccgugcaccacauguauuaccaagugcgaaccccauggacuggugguccgcuccaccggcuuuaagaucucuagcgccguggcuugugccuccgggguuugcgugacaggaagccagucuccuuccacggagauuacccucaaauaccccggcaucagccagucuuccgggggcgacaucggaguccacauggcucaugaugaccaaagcguguccucuaagauuguugcccacugcccuccccaggacccgugucuggugcacggcugcaucgucugugcgcaugggcuuauuaauuaucagugccacacagcccugagcgcuuucguggugguuuucgucuuuuccucuguggccaucauuugucucgcuauccuguacaaagugcuuaagugccugaaaaucgccccuagaaagguccucaacccccugauguggauuaccgcguucauccgguggguguauaaaaagaugguugccagaguggcugauaauauuaaccaggucaaccgcgaaaucggauggauggagggcgggcaacuggugcucggaaauccugcccccauuccucggcaugcucccaucccgagauacagcacauaccugaugcuucugcucauuguuuccuaugccagcgccuguucugagcugauccaggcuuccagccgcaucaccacgugcucuacagaaggcgugaacaccaagugucggcuguccgggaccgcgcuuauuagagccggcagcgucggagcugaggccugccucaugcugaaaggcgugaaggaagaccagacaaaauuucugaagaucaaaaccguuucuagcgagcucuccugucgcgaggggcagagcuacuggacaggaucuuucuccccuaagugccugagcucccggagaugccaccuugugggcgaaugucacgucaaucgcugccugucuuggcgggauaacgagacgagcgccgaauuuuccuucgugggggagucuaccacaaugagagaaaauaaguguuuugagcaaugcggaggcuggggguguggcugcuucaacgugaaucccagcugucucuuuguccauaccuaucugcaguccguucgcaaagaggcucugcggguguucaacugcauugacugggugcacaaacuuacacucgaaaucaccgauuuugacggaucugucagcacgguggaucugggcgccuccagcucuagauucaccaauuggggguccguuagccugucucucgacgcggagggaauuuccggcagcaacucuuuuuccuucaucgaaagccccgggaagggauacgcuaucguggaugagccuuucuccgaaauuagccggcagggcuuucugggggagauccgcuguaauucugagagcuccguccuuucugcccaugaaagcugccugagagccccgaaccucauuuccuauaagcccaugaucgaccagcuggaguguacaaccaaucugauugauccuuucgugguuuuugaacggggcucucuuccccaaacaagaaacgacaaaaccuucgcugccagcaagggaaaucgcggcgugcaggcguuuuccaaggggucuguccaggcugaucucacgcugauguucgacaacuuugagguggacuucguuggagccgccgugagcugcgaugcugccuuucugaaccucacaggcugcuacuccuguaaugcuggggcccgggucugccugagcaucaccucuacaggaaccggcacccuuuccgcgcacaacaaagacggcagccugcauaucgugcucccuucugaaaaugggacaaaggaucaaugucagauucugcacuucacggugcccgaggucgaggaagaguuuauguauuccugcgacggagaugaaagaccucugcuuguuaaaggcacccucaucgccauugaccccuucgaugaccgcagagaggcugggggagagagcacaguggugaacccgaaguccggcucuuggaacuuuuucgauugguucagcgggcugauguccugguuuggaggcccucugaaaaccauccuccugauuugucuuuacgucgcccugagcaucggccucuucuuucugcugaucuaccuugggcggacaggacugucuaagauguggcucgcugccaccaagaaagccuccuga

SEQ ID NO: 14502 - RNA, 3480 nt, Artificial Sequence
  derived and/or modified CDS sequence (opt5) from RVFV(2007001292)__EU574046.1__NSm-Gn-Gc
augaucgagggcgccugggacagccugagagaagaggaaaugcccgaggaacucuccugcucugugagcgggauucgggaggucaagaccuccucucaggagcuguaccgcgcucuuaaagccaucauugcggcugauggacugaacaauaucacaugucacggcaagaacccugaagacaaaauuagccucaucaaggggccgccccauaaaaagagaguuggaaucgugcggugcgagcgcagacgggaugccaagcaaauuggccgcgaaacgauggccgggaucgcuaugaccgugcugccugcccuugcugucuucgcccuggcgcccgugguuuuugccgaggacccucaccucagaaaucggcccggaaaaggccauaacuauauugauggcaugacacaggaggacgcuaccuguaagccugugacauacgccggggcuugcuccucuuucgauguccugcuggaaaaaggaaaguuuccccucuuccagagcuaugcccaccaucgcacccugcuugaggcggugcacgacacaaucauugccaaagcugaucccccuuccugugaccugcagagcgcccacggcaaucccugcaugaaggaaaagcucguuaugaaaacccauuguccuaacgauuaccaaucugcucacuaucugaauaacgacgggaagauggccuccgugaaaugcccgccgaaguacgagcuuacggaagauuguaauuuuugcagacagaugaccggagccagccugaaaaagggcucuuauccucuccaggaccuguucugucaguccagcgaggacgaugggucuaaacugaagacaaagaugaaaggagucugcgaggugggcgugcaagcucucaagaaaugcgacggccagcuguccaccgcgcaugaagucguucccuuugccguguucaagaacagcaaaaagguguaccuugauaagcuggaccucaaaacagaggaaaaucugcuuccugauuccuuugucuguuucgagcacaaggggcaguacaaaggaaccauggacucuggccagacgaagcgggaacugaaauccuuugauaucucccaaugccccaagauugggggacacggcagcaagaaauguacaggggacgcugccuucugcucugccuaugaguguaccgcucaguacgccaacgcguauugcucccaugcuaauggaagcggcaucgugcagauccaaguuucuggcguguggaagaaaccccucugugucggguacgagcgcgugguugugaagagagaacugagcgccaaaccuauucagcgggucgagccgugcacaaccuguaucaccaagugcgaaccccacggacuggugguccgcuccacaggcuuuaagauuucuagcgccguggcuugugccuccgggguuugcgugacgggaagccagucuccuuccaccgagaucacacucaaauaucccggcauuagccagucuuccgggggcgauaucggaguccauauggcucacgacgaucaaagcguguccucuaagaucguugcccauugcccuccccaggacccgugucuggugcacggcugcauugucugugcgcacgggcuuaucaacuaccagugccauaccgcccugagcgcuuucguggugauuuucguuuuuagcucuacagccaucauuugucucgcuguccuguauagagugcuuaaaugccugaagaucgccccucggaaagugcucaauccccugauguggaucaccgcguucauuagaugggucuacaagaaaaugguggcccgcguugcugacaacaucaaccaggugaaucgggaaauuggauggauggagggcgggcaacuggcccucggaaacccugcucccaucccuagacacgcccccauuccgcgcuacagcacguaucugaugcuucugcucaucgucuccuacgccagcgcuuguucugagcugauucaggcguccagccggaucacaaccugcucuaccgaaggcgugaauacaaaguguagacuguccgggaccgcccuuauccgcgcuggcagcguuggagccgaggccugccucaugcugaagggcgugaaagaagaucagacaaaguuucugaaaauuaagacggucucuagcgagcucuccugucgggaggggcagagcuauuggaccggaucuuucuccccuaaaugccugagcuccagacgcugccaucuugugggcgaaugucacguuaaccggugccugucuuggagagacaaugagacaagcgcugaauuuuccuucgugggggagucuaccacaaugcgcgaaaacaaguguuuugagcaaugcggaggcuggggguguggcugcuucaaugucaaccccagcugucucuuugugcacaccuaccugcaguccgugcggaaggaggcccugagagucuucaauugcaucgauuggguucauaaacuuacgcucgaaauuaccgacuuugauggaucugugagcacaaucgaccugggcgcguccagcucucgguucaccaacuggggguccgugagccugucucucgaugcugagggaauuuccggcagcaauucuuuuuccuucaucgaaagccccgggaagggauaugccaucgucgacgagccuuucuccgaaauuccgcgccagggcuuucugggggagaucagauguaacagcgagucuagcgugcuuuccgcccacgaaucuugccugcgggcucccaaucucguuagcuacaaaccuaugauugaucagcuggaguguacaaccaaccugaucgaccccuucguggucuuugaaagaggcucccuuccucaaacgcgcaaugauaagacauucgccgcgucuaaaggaaaccggggcgugcaggcuuuuagcaagggguccguucaggccgaccucacccugauguucgauaacuuugagguggacuucgucggagccgcugugucuugcgacgccgcuuuucugaaucucacaggcugcuauagcuguaacgccggggcgagaguuugccuguccauuaccagcaccggaacaggcacgcuuucugcccauaauaaggauggcucccugcacaucgugcuccccagcgaaaacgggaccaaagaccaaugucagauccugcauuucacagucccugagguggaggaagaguuuauguacucuugcgauggagacgaacgcccccugcuugugaagggcacccucauugcuaucgauccguucgacgauagacgggaggccgggggagaguccacagucguuaauccuaaaagcggcuccuggaaccuguuugacugguucucugggcugaugagcugguucggaggcccccucaagaccauucugcuuaucugucuguacguggcucucuccauuggccuguuuuuccugcuuaucuaucuggggcgcacgggacucagcaaaauguggcuggccgccacaaagaaggcuucuuga

SEQ ID NO: 14503 - RNA, 3480 nt, Artificial Sequence
  derived and/or modified CDS sequence (opt5) from RVFV(2007001811)__EU574040.1__NSm-Gn-Gc
augaucgagggcgccugggacagccugagagaagaggaaaugcccgaggaacucuccugcucugugagcgggauucgggaggucaagaccuccucucaggagcuguaccgcgcucuuaaagccaucauugcggcugauggacugaacaauaucacaugucacggcaagaacccugaagacaaaauuagccucaucaaggggccgccccauaaaaagagaguuggaaucgugcggugcgagcgcagacgggaugccaagcaaauuggccgcgaaacgauggccgggaucgcuaugaccgugcugccugcccuugcugucuucgcccuggcgcccgugguuuuugccgaggacccucaccucagaaaucggcccggaaaaggccauaacuauauugauggcaugacacaggaggacgcuaccuguaagccugugacauacgccggggcuugcuccucuuucgauguccugcuggaaaaaggaaaguuuccccucuuccagagcuaugcccaccaucgcacccugcuugaggcggugcacgacacaaucauugccaaagcugaucccccuuccugugaccugcagagcgcccacggcaaucccugcaugaaggaaaagcucguuaugaaaacccauuguccuaacgauuaccaaucugcucacuaucugaauaacgacgggaagauggccuccgugaaaugcccgccgaaguacgagcuuacggaagauuguaauuuuugcagacagaugaccggagccagccugaaaaagggcucuuauccucuccaggaccuguucugucaguccagcgaggacgaugggucuaaacugaagacaaagaugaaaggagucugcgaggugggcgugcaagcucucaagaaaugcgacggccagcuguccaccgcgcaugaagucguucccuuugccguguucaagaacagcaaaaagguguaccuugauaagcuggaccucaaaacagaggaaaaucugcuuccugauuccuuugucuguuucgagcacaaggggcaguacaaaggaaccauggacucuggccagacgaagcgggaacugaaauccuuugauaucagccaaugccccaagauugggggacacggcagcaagaaauguacaggggacgcugccuucugcucugccuaugaguguaccgcucaguacgccaacgcguauugcucccaugcuaauggaagcggcaucgugcagauccaaguuucuggcguguggaagaaaccccucugugucggguacgagcgcgugguugugaagagagaacugagcgccaaaccuauucagcgggucgagccgugcacaaccuguaucaccaagugcgaaccccacggacuggugguccgcuccacaggcuuuaagauuucuagcgccguggcuugugccuccgggguuugcgugacgggaagccagucuccuuccaccgagaucacacucaaauaucccggcauuagccagucuuccgggggcgauaucggaguccauauggcucacgacgaucaaagcguguccucuaagaucguugcccauugcccuccccaggacccgugucuggugcacggcugcauugucugugcgcacgggcuuaucaacuaccagugccauaccgcccugagcgcuuucguggugguuuucgucuuuuccucuauugccaucauuugucucgcuauccuguauagagugcuuaaaugccugaagaucgccccucggaaagugcucaauccccugauguggauuacagcguucaucagaugggucuacaagaaaaugguggcccgcguugcugacaacauuaaccaggugaaucgggaaaucggauggauggagggcgggcaacugguccucggaaacccugcccccauuccuagacacgcucccaucccgcgcuacagcaccuaucugaugcuucugcucauuguguccuacgccagcgccuguucugagcugauccaggcuuccagccggaucacgacaugcucuaccgaaggcguuaauaccaaguguagacuguccgggacagcgcuuauucgcgccggcagcgugggagcugaggccugccucaugcugaagggcgucaaagaagaucagaccaaguuucugaugaucaaaacagugucuagcgagcucuccugucgggaggggcagagcuauuggacgggaucuuucuccccuaagugccugagcuccagacgcugccaucuuguuggcgaaugucacgugaaccggugccugucuuggagagacaaugagaccagcgccgaauuuuccuucgucggggagucuacaaccaugcgcgaaaacaaauguuuugagcaaugcggaggcuggggguguggcugcuucaaugugaaccccagcugucucuuugugcacacauaccugcaguccguccggaaggaggcucugagaguuuucaauugcauugauugggugcauaaacuuacccucgaaaucacggacuuugauggaucugugagcaccauugaccugggcgccuccagcucucgguucacaaacuggggguccgucagccugucucucgaugcggagggaaucuccggcagcaauucuuuuuccuucaucgaaagccccgggaagggauaugcuauuguggacgagccuuucuccgaaaucccgcgccagggcuuucugggggagauuagauguaacagcgagucuagcguucuuuccgcccacgaaucuugccugcgggcccccaaucucaucagcuacaagccuaugauugaucagcuggaguguaccacaaaccugaucgaccccuucguggucuuugaaagaggcucccuuccucaaacccgcaaugagaaaacguucgcugccucuaagggaaaccggggcgugcaggcguuuagcaaaggguccguucaggcugaucucacacugauguucgacaacuuugaaguggauuucgucggagccgccgugucuugcgacgcugccuuucugaaucucaccggcugcuauagcuguaacgcuggggccagaguuugccuguccaucacaagcaccggaaccggcacacuuucugcgcauaauaaggacggcucccugcacauugugcuccccagcgagaacgggacgaaggaucaaugucagauccugcauuucaccgucccugagguggaagaggaauuuauguacucuugcgacggagaugagcgcccccugcuugugaaaggcacacucauugccaucgacccguucgaugacagacgggaggcugggggagaauccaccgucguuaauccuaagagcggcuccuggaacuuuuucgauugguucucugggcugaugagcugguuuggaggcccccugaaaacaauucuccugaucugucuuuacguggcccuguccaucggccucuucuuucugcugauuuaucuugggcgcaccggacugagcaagauguggcucgcugccacgaaaaaggccucuuga

SEQ ID NO: 14504 - RNA, 3480 nt, Artificial Sequence
  derived and/or modified CDS sequence (opt5) from RVFV(ANK-6087)__DQ380216.1__NSm-Gn-Gc
augaucgagggcgccugggacagccugagagaagaggaaaugcccgaggaacucuccugcucuauuagcgggauccgggaggugaagaccuccucucaggagcuguaccgcgcucuuaaagccauuaucgcggcugauggacugaauaauauuacaugucacggcaaggacccugaagauaaaaucagccucaucaaggggccgccccauaaaaagagagucggaauuguucggugcgagcgcagacgggacgccaagcaaaucggccgcgaaacgauggccgggauugcuaugaccgugcugccugcccuugcuguguucgcccuggcgcccgucguguuugccgaggauccucaccucagaaaccggcccggaaaaggccauaauuauaucgacggcaugacacaggaggaugcuaccuguaagccuguuacauacgccggggcuugcuccucuuucgacgugcugcuggaaaaaggaaaguuuccccucuuccagagcuaugcccaccaucgcacccugcuugaggcgguccacgauacaauuaucgccaaagcugacccgccuuccugugaucugcagagcgcccacggcaaccccugcaugaaggaaaagcucgugaugaaaacccauuguccuaaugacuaccaaucugcucacuaucugaacaaugaugggaagauggccuccguuaaaugucccccgaaguacgagcuuacggaagacugcaacuuuugcagacagaugaccggagccagccugaaaaagggcucuuauccucuccaggaccuguucugucaguccagcgaggaugacgggucuaaacugaagacaaagaugaaaggagugugcgaggucggcgugcaagcucucaagaaaugcgauggccagcuguccaccgcgcaugaagugguccccuuugccguuuucaagaauagcaaaaagguguaccuugacaagcuggaucucaaaacagaggaaaaccugcuuccugacuccuuuguguguuucgagcacaaggggcaguacaaaggaaagcuggauucuggccagaccaaacgggaacucaagagcuuugacauuucccaaugccccaagaucgggggacacggcagcaaaaaguguacgggggaugcugccuucugcucugccuaugaguguacagcucaguacgccaaugcguauugcucccaugcuaacggaagcggcaucguccagauucaagugucuggcguuuggaaaaagccccugugugugggguacgagcgcgucgugguuaaaagagaacugagcgccaagccuauccagcggguggagccgugcaccacauguauuaccaagugcgaaccccacggacucgucgugcgcuccaccggcuuuaaaaucucuagcgccgucgcuugugccuccggggugugcguuacaggaagccagucuccuuccacggagauuacccugaaguaucccggcaucagccagucuuccgggggcgacaucggagugcauauggcucacgaugaccaaagcgucuccucuaaaauuguggcccauugcccuccccaggacccgugucuuguucacggcugcaucgugugugcgcacgggcugauuaauuaccagugccauacagcccucagcgcuuucgucgugguguucgucuuuuccucuaucgccauuaucugucuggcuauccuuuauagaguucugaagugccucaaaauugccccucggaaggugcugaacccccugauguggaucaccgcguucauuagauggguguaccgcaaaauggucgcccggguggcugauaauaucaaccagguuaacagagaaauuggauggauggagggcgggcaacucgugcugggaaauccugcccccaucccucgccacguccccauuccgcgguacagcacauaucuuaugcugcuccugaucguguccuacgcuagcgccuguucugagcugauccaggccuccagcagaauuaccacgugcucuacagaaggcguuaacaccaagugucgccuuuccgggaccgcucucauccgggcgggcagcgugggagccgaggcuugccugaugcugaagggcgucaaagaagaccagacaaaguuucucaaaauuaagaccgugucuagcgagcuguccuguagagaggggcagagcuauuggacaggaucuuucuccccuaaaugccuuagcucccgccggugccaucugguuggcgaaugucacgugaauagaugccucucuuggcgcgauaacgagacgagcgccgaauuuuccuucgucggggagucuaccacaaugcgggaaaauaaguguuuugagcaaugcggaggcuggggguguggcugcuucaacgugaaucccagcugucuguuugugcacaccuaccugcaguccgucagaaaggaggcccuucggguuuucaacugcaucgacugggugcauaaacucacacuggaaauuaccgauuuugacggaucugugagcacgaucgaucugggcgcuuccagcucucgcuucaccaauuggggguccgucagccucucucuggacgccgagggaaucuccggcagcaacucuuuuuccuucauugaaagccccgggaagggauaugcgaucguggaugagccuuucuccgaaauuccgagacagggcuuucuuggggagauccgguguaauagcgagucuagcguucuguccgcucacgaaucuugccucagagcccccaaccugauuagcuacaaaccuaugaucgaccagcuggaguguuccacaaaucuuaucgaucccuucguggucuuuaagcgcggcucucucccucaaacccggaacgacaaaacauucgccgcuagcaagggaaauagaggcgugcaggccuuuuccaaggggucuguucaggcggaucugacccugauguucgacaacuuugaaguggacuucgucggagcugccgugagcugcgaugccgcuuuucucaaccugacgggcugcuauuccuguaaugccggggcucgcguuugccuuagcauuacaucuaccggaacaggcacccuguccgcccauaacaaagacggcagccuccacaucgugcugcccucugagaaugggaccaaggaucaaugucagauucugcauuucacagucccugaaguggaggaggaauuuauguacuccugcgacggagaugagagaccccuucucgugcggggcacgcugaucgcgauugacccguucgaugaccgcagagaagccgggggagagagcaccgucguuaacccuaaauccggcucuuggaacuuuuucgauugguucagcgggcugauguccugguuuggaggcccccucaagacaauccugcuuaucugucuguacguggcucucagcauuggccuguucuuucugcuuaucuaucuggggcggaccggacucucuaaaauguggcuggccgcuacaaagaaggccuccuga

SEQ ID NO: 14505 - RNA, 3480 nt, Artificial Sequence
  derived and/or modified CDS sequence (opt5) from RVFV(2007000234)__JF326191.1__NSm-Gn-Gc
augaucgagggcgccugggacagccugagagaagaggaaaugcccgaggaacucuccugcucugugagcgggauucgggaggucaagaccuccucucaggagcuguaccgcgcucuuaaagccaucauugcggcugauggacugaacaauaucacaugucacggcaagaacccugaagacaaaauuagccucaucaaggggccgccccauaaaaagagaguuggaaucgugcggugcgagcgcagacgggaugccaagcaaauucgcagagaaacgauggccggcaucgcuaugaccgugcugccugcccuugcugucuucgcccuggcgcccgugguuuuugccgaggacccucaccuccggaaucgccccgggaaaggacauaacuauauugauggcaugacacaggaggacgcuaccuguaagccugugacauacgccggcgcuugcuccucuuucgauguccugcuggaaaaagggaaguuuccccucuuccagagcuaugcccaccauagaacccugcuugaggcggugcacgacacaaucauugccaaagcugaucccccuuccugugaccugcagagcgcccacggaaaucccugcaugaaggaaaagcucguuaugaaaacccauuguccuaacgauuaccaaucugcucacuaucugaauaacgacggcaagauggccuccgugaaaugcccgccgaaguacgagcuuacggaagauuguaauuuuugccggcagaugaccggggccagccugaaaaagggaucuuauccucuccaggaccuguucugucaguccagcgaggacgauggcucuaaacugaagacaaagaugaaaggggucugcgaggugggagugcaagcucucaagaaaugcgacggccagcuguccaccgcgcaugaagucguucccuuugccguguucaagaacagcaaaaagguguaccuugauaagcuggaccucaaaacagaggaaaaucugcuuccugauuccuuugucuguuucgagcacaagggccaguacaaagggaccauggacucuggacagacgaagcgcgaacugaaauccuuugauaucucccaaugccccaagauuggcgggcacggaagcaagaaauguacaggcgacgcugccuucugcucugccuaugaguguaccgcucaguacgccaacgcguauugcucccaugcuaaugggagcggaaucgugcagauccaaguuucuggcguguggaagaaaccccucugugucggcuacgagagagugguugugaagcgggaacugagcgccaaaccuauucagcgcgucgagccgugcacaaccuguaucaccaagugcgaaccccacgggcugguggucagauccacaggauuuaagauuucuagcgccguggcuugugccuccggcguuugcgugacggggagccagucuccuuccaccgagaucacacucaaauaucccggaauuagccagucuuccggcggggauaucggcguccauauggcucacgacgaucaaagcguguccucuaagaucguugcccauugcccuccccaggacccgugucuggugcacggaugcauugucugugcgcacggccuuaucaacuaccagugccauaccgcccugagcgcuuucguggugauuuucguuuuuagcucuacagccaucauuugucucgcuguccuguaucgggugcuuaaaugccugaagaucgccccuagaaaagugcucaauccccugauguggaucaccgcguucauucgcugggucuacaagaaaaugguggcccggguugcugacaacaucaaccaggugaauagagaaauuggguggauggagggaggccaacuggcccucgggaacccugcucccaucccucgccacgcccccauuccgcgguacagcacguaucugaugcuucugcucaucgucuccuacgccagcgcuuguucugagcugauucaggcguccagcagaaucacaaccugcucuaccgaaggagugaauacaaagugucgccuguccggcaccgcccuuauccgggcugggagcguuggcgccgaggccugccucaugcugaagggagugaaagaagaucagacaaaguuucugaaaauuaagacggucucuagcgagcucuccuguagagagggccagagcuauuggaccgggucuuucuccccuaaaugccugagcucccgccggugccaucuugugggagaaugucacguuaacagaugccugucuuggcgcgacaaugagacaagcgcugaauuuuccuucgugggcgagucuaccacaaugcgggaaaacaaguguuuugagcaaugcgggggauggggcugugggugcuucaaugucaaccccagcugucucuuugugcacaccuaccugcaguccgugagaaaggaggcccugcgggucuucaauugcaucgauuggguucauaaacuuacgcucgaaauuaccgacuuugauggcucugugagcacaaucgaccugggagcguccagcucucgcuucaccaacuggggcuccgugagccugucucucgaugcugaggggauuuccggaagcaauucuuuuuccuucaucgaaagccccggcaagggguaugccaucgucgacgagccuuucuccgaaauuccgagacagggauuucugggcgagauccgguguaacagcgagucuagcgugcuuuccgcccacgaaucuugccugagagcucccaaucucguuagcuacaaaccuaugauugaucagcuggaguguacaaccaaccugaucgaccccuucguggucuuugaacgcgggucccuuccucaaacgcggaaugauaagacauucgccgcgucuaaaggcaacagaggagugcaggcuuuuagcaagggcuccguucaggccgaccucacccugauguucgauaacuuugagguggacuucgucggggccgcugugucuugcgacgccgcuuuucugaaucucacaggaugcuauagcuguaacgccggcgcgcgcguuugccuguccauuaccagcaccgggacaggaacgcuuucugcccauaauaaggauggcucccugcacaucgugcuccccagcgaaaacggcaccaaagaccaaugucagauccugcauuucacagucccugagguggaggaagaguuuauguacucuugcgauggggacgaaagaccccugcuugugaagggaacccucauugcuaucgauccguucgacgaucggcgcgaggccggcggggaguccacagucguuaauccuaaaagcggauccuggaacuuuuucgacugguucucuggccugaugagcugguuugggggaccccugaagaccauucuccugaucugucuuuacguggcucuguccauuggccucuucuuucugcugaucuaucuuggcagaacggggcugagcaaaauguggcucgccgccacaaagaaggcuucuuga

SEQ ID NO: 14506 - RNA, 3480 nt, Artificial Sequence
  derived and/or modified CDS sequence (opt5) from RVFV(SA-75)__DQ380189.1__NSm-Gn-Gc
augaucgagggcgccugggacagccugagagaagaggaaaugcccgaggaacucuccugcucuauuagcgggauccgggaggugaagaccuccucucaggagcuguaccgcgcucuuaaagccauuaucgcggcugauggacugaauaauauuacaugucacggcaaggacccugaagauaaaaucagccucgucaaggggccgccccauaaaaagagaguuggaaucgugcggugcgagcgcagacgggacgccaagcaaauuggccgcgaaacgauggccagaaucgcuaugaccgugcugccugcccuugcugucuucgcccuggcgcccgugguuuuugccgaggauccucaccuccggaaccgccccgggaaaggacauaauuauauugacggcaugacacaggaggaugcuaccuguaagccugugacauacgccggcgcuugcuccucuuucgacguccugcuggaaaaagggaaguuuccccucuuccagagcuaugcccaccauagaacccugcuugaggcggugcacgauacaaucauugccaaagcugacccgccuuccugugaucugcagagcgcccacggaaaccccugcaugaaggaaaagcucguuaugaaaacccauuguccuaaugacuaccaaucugcucacuaucugaacaaugauggcaagauggccuccgugaaaugucccccgaaguacgagcuuacggaagacugcaacuuuugccggcagaugaccggggccagccugaaaaagggaucuuauccucuccaggaccuguucugucaguccagcgaggaugacggcucuaaacugaagacaaagaugaaaggggucugcgaggugggagugcaagcucucaagaaaugcgauggccagcuguccaccgcgcaugaagucguucccuuugccguguucaagaauagcaaaaagguguaccuugacaagcuggaucucaaaacagaggaaaaccugcuuccugacuccuuugucuguuucgagcacaagggccaguacaaagggaccauggauucuggacagacgaagcgcgaacugaaauccuuugacaucagccaaugccccaagauuggcgggcacggaagcaagaaauguacaggcgaugcugccuucugcucugccuaugaguguaccgcucaguacgccaaugcguauugcucccaugcuaacgggagcggagugguucagauccaagugucuggcgucuggaagaaaccccucugugugggcuacgagagaguuguggucaagcgggaacugagcgccaaaccuauccagcgcguggagccgugcacaaccuguauuaccaagugcgaaccccacgggcuggucgugagauccacaggauuuaagaucucuagcgccguugcuugugccuccggcgugugcgucacggggagccagucuccuuccaccgagauuacacucaaauaucccggaaucagccagucuuccggcggggacauuggcgugcauauggcucacgaugaccaaagcguuuccucuaagaucguggcccauugcccuccccaggacccgugucugguccacggaugcaucgugugugcgcacggccuuauuaauuaccagugccauaccgcccugagcgcuuucgugguugucuucguguuuuccucuguggccaucauuugucucgcuauccuguauaaaguccuuaagugccugaaaauugccccucggaaggugcucaacccccugauguggaucacaguuuucaucagauggguguacaaaaagauggucgcgcgcguggccgauaauauuaaccagguuaaccgggaaaucggguggauggagggaggccaacuggcucucgggaauccugcccccauuccuagacacgcucccaucccgcgcuacagcaccuaucugaugcuucugcucauuguguccuacgccagcgccuguucugagcugauccaggcuuccagccggauuacgacaugcucuaccgaaggagucaacaccaaguguagacuguccggcacagcgcuuauccgcgccgggagcgugggcgcugaggccugccucaugcugaaaggaguuaaggaagaccagaccaaauuucugaagaucaaaacagugucuagcgagcucuccugucgggagggccagagcuauuggacggggucuuucuccccuaagugccugagcuccagacgcugccaucuugucggagaaugucacgugaaucggugccugucuuggagagauaacgagaccagcgccgaauuuuccuucgugggcgagucuacaaccaugcgcgaaaauaaguguuuugagcaaugcgggggauggggcugugggugcuucaacgucaaucccagcugucucuuuguucacacauaccugcaguccgugcggaaagaggcucugagaguguucaacugcauugacuggguccauaaacuuacccucgaaaucacggauuuugacggcucugugagcaccauugaucugggagccuccagcucucgguucacaaauuggggcuccguuagccugucucucgacgcggaggggaucuccggaagcaacucuuuuuccuucauugaaagccccggcaagggguaugcuaucguggaugagccuuucuccgaaaucccgcgccagggauuucugggcgagauuagauguaauagcgagucuagcguccuuuccgcccacgaaucuugccugcgggcccccaaccucaucagcuacaagccuaugauugaccagcuggaguguaccacaaaucugaucgaucccuucgugguuuuugaaagagggucccuuccucaaacccgcaacgacaaaacguucgcugccucuaagggcaaucggggagugcaggcguuuagcaagggcuccguccaggcugaucucacacugauguucgacaacuuugagguggacuucguuggggccgccgugucuugcgaugcugccuuucugaaccucaccggaugcuauagcuguaaugcuggcgccagagucugccuguccauuacaagcaccgggaccggaacacuuucugcgcauaacaaagacggcucccugcacaucgugcuccccagcgaaaauggcacgaaggaucaaugucagauccugcauuucaccgugccugaggucgaggaagaguuuauguacucuugcgacggggaugaacgcccccugcuuguuaaaggaacacucauugccaucgacccguucgaugacagacgggaggcuggcggggaguccaccguggugaacccuaagagcggauccuggaacuuuuucgauugguucucuggccugaugagcugguuugggggaccccugaaaacaauucuccugaucugucuuuacgucgcccuguccauuggccucuucuuucugcugaucuaucuuggccgcaccgggcugagcaagauguggcucgcugccacgaagaaagccucuuga

SEQ ID NO: 14507 - RNA, 3480 nt, Artificial Sequence
  derived and/or modified CDS sequence (opt5) from RVFV(KEN07-KUR340)__EF460404.1__NSm-Gn-Gc
augaucgagggcgccugggacagccugagagaagaggaaaugcccgaggaacucuccugcucugugagcgggauucgggaggucaagaccuccucucaggagcuguaccgcgcucuuaaagccaucauugcggcugauggacugaacaauaucacaugucacggcaagaacccugaagacaaaauuagccucaucaaggggccgccccauaaaaagagaguuggaaucgugcggugcgagcgcagacgggaugccaagcaaauuggccgcgaaacgauggccgggaucgcuaugaccgugcugccugcccuugcugucuucgcccuggcgcccgugguuuuugccgaggacccucaccucagaaaucggcccggaaaaggccauaacuauauugauggcaugacacaggaggacgcuaccuguaagccugugacauacgccggggcuugcuccucuuucgauguccugcuggaaaaaggaaaguuuccccucuuccagagcuaugcccaccaucgcacccugcuugaggcggugcacgacacaaucauugccaaagcugaucccccuuccugugaccugcagagcgcccacggcaaucccugcaugaaggaaaagcucguuaugaaaacccauuguccuaacgauuaccaaucugcucacuaucugaauaacgacgggaagauggccuccgugaaaugcccgccgaaguacgagcuuacggaagauuguaauuuuugcagacagaugaccggagccagccugaaaaagggcucuuauccucuccaggaccuguucugucaguccagcgaggacgaugggucuaaacugaagacaaagaugaaaggagucugcgaggugggcgugcaagcucucaagaaaugcgacggccagcuguccaccgcgcaugaagucguucccuuugccguguucaagaacagcaaaaagguguaccuugauaagcuggaccucaaaacagaggaaaaucugcuuccugauuccuuugucuguuucgagcacaaggggcaguacaaaggaaccauggacucuggccagacgaagcgggaacugaaauccuuugauaucucccaaugccccaagauugggggacacggcagcaagaaauguacaggggacgcugccuucugcucugccuaugaguguaccgcucaguacgccaacgcguauugcucccaugcuaauggaagcggcaucgugcagauccaaguuucuggcguguggaagaaaccccucugugucggguacgagcgcgugguugugaagagagaacugagcgccaaaccuauucagcgggucgagccgugcacaaccuguaucaccaagugcgaaccccacggacuggugguccgcuccacaggcuuuaagauuucuagcgccguggcuugugccuccgggguuugcgugacgggaagccagucuccuuccaccgagaucacacucaaauaucccggcauuagccagucuuccgggggcgauaucggaguccauauggcucacgacgaucaaagcguguccucuaagaucguugcccauugcccuccccaggacccgugucuggugcacggcugcauugucugugcgcacgggcuuaucaacuaccagugccauaccgcccugagcgcuuucguggugauuuucguuuuuagcucuacagccaucauuugucucgcuguccuguauagaaugcuuaaaugccugaagaucgccccucggaucgugcucaauccccugauguggauuaccgcguucaucagauggguguacaaaaagauggucgcccgcguggcugacaacauuaaccagguuaaucgggaaaucggauggauggagggcgggcaacuggcccucggaaacccugcucccauuccuagacacgcccccaucccgcgcuacagcacguaucugaugcuucugcucauuguguccuacgccagcgcuuguucugagcugauccaggcguccagccggaucacaaccugcucuaccgaaggcgucaauacaaaauguagacuguccgggaccgcccuuauucgcgcuggcagcgugggagccgaggccugccucaugcugaagggcguuaaggaagaucagacaaaauuucugaagaucaaaacggugucuagcgagcucuccugucgggaggggcagagcuauuggaccggaucuuucuccccuaagugccugagcuccagacgcugccaucuugucggcgaaugucacgugaaccggugccugucuuggagagacaaugagacaagcgcugaauuuuccuucguuggggagucuaccacaaugcgcgaaaacaaauguuuugagcaaugcggaggcuggggguguggcugcuucaaugugaaccccagcugucucuuuguccacaccuaccugcaguccgugcggaaggaggcccugagaguguucaauugcauugauuggguccauaaacuuacgcucgaaaucaccgacuuugauggaucuguuagcacaauugaccugggcgcguccagcucucgguucaccaacuggggguccgugagccugucucucgaugcugagggaaucuccggcagcaauucuuuuuccuucaucgaaagccccgggaaaggauaugccauuguggacgagccuuucuccgaaaucccgcgccagggcuuucugggggagauuagauguaacagcgagucuagcguccuuuccgcccacgaaucuugccugcgggcucccaaucucgugagcuacaagccuaugaucgaucagcuggaguguacaaccaaccugauugaccccuucguuguguuugaaagaggcucccuuccucaaacgcgcaaugauaaaacauucgccgcgucuaagggaaaccggggcguccaggcuuuuagcaaaggguccgugcaggccgaccucacccugauguucgauaacuuugagguugacuucgugggagccgcugucucuugcgacgccgcuuuucugaaucucacaggcugcuauagcuguaacgccggggcgagagugugccuguccaucaccagcaccggaacaggcacgcuuucugcccauaauaaggauggcucccugcacaucguucuccccagcgaaaacgggaccaaggaccaaugucagauucugcauuucacagugccugaggucgaggaagaguuuauguacucuugcgauggagacgaacgcccccugcuugugaaaggcacccucaucgcuauugauccguucgacgauagacgggaggccgggggagaguccacaguggucaauccuaagagcggcuccuggaacuuuuucgacugguucucugggcugaugagcugguuuggaggcccccugaaaaccauccuccugauuugucuuuacguugcucuguccaucggccucuucuuucugcugaucuaucuugggcgcacgggacugagcaagauguggcucgccgccacaaagaaggcuucuuga

SEQ ID NO: 14508 - RNA, 3480 nt, Artificial Sequence
  derived and/or modified CDS sequence (opt5) from RVFV(35/74)__JF784387.1__NSm-Gn-Gc
augaucgagggcgccugggacagccugagagaagaggaaaugcccgaggaacucuccugcucuauuagcgggauccgggaggugaagaccuccucucaggagcuguaccgcgcucuuaaagccauuaucgcggcugauggacugaacaauauuacaugucacggcaaggacccugaagauaaaaucagccucgucaaggggccgccccauaaaaagagaguuggaaucgugcggugcgagcgcagacgggacgccaagcaaauuggccgcgaaacgauggccgggaucgcuaugaccgugcugccugcccuugcugucuucgcccuggcgcccgugguuuuugccgaggauccucaccucagaaaccggcccggaaaaggccauaauuauauugacggcaugacacaggaggaugcuaccuguaagccugugacauacgccggggcuugcuccucuuucgacguccugcuggaaaaaggaaaguuuccccucuuccagagcuaugcccaccaucgcacccugcuugaggcggugcacgauacaaucauugccaaagcugacccgccuuccugugaucugcagagcgcccacggcaaccccugcaugaaggaaaagcucguuaugaaaacccauuguccuaaugacuaccaaucugcucacuaucugaacaaugaugggaagauggccuccgugaaaugucccccgaaguacgagcuuacggaagacugcaacuuuugcagacagaugaccggagccagccugaaaaagggcucuuauccucuccaggaccuguucugucaguccagcgaggaugacgggucuaaacugaagacaaagaugaaaggagucugcgaggugggcgugcaagcucucaagaaaugcgauggccagcuguccaccgcgcaugaagucguucccuuugccguguucaagaauagcaaaaagguguaccuugacaagcuggaucucaaaacagaggaaaaccugcuuccugacuccuuugucuguuucgagcacaaggggcaguacaaaggaaccauggauucuggccagacgaagcgggaacugaaauccuuugacaucagccaaugccccaagauugggggacacggcagcaagaaauguacaggggaugcugccuucugcucugccuaugaguguaccgcucaguacgccaaugcguauugcucccaugcuaacggaagcggcgugguucagauccaagugucuggcgucuggaagaaaccccucugugugggguacgagcgcguuguggucaagagagaacugagcgccaaaccuauccagcggguggagccgugcacaaccuguauuaccaagugcgaaccccacggacuggucgugcgcuccacaggcuuuaagaucucuagcgccguugcuugugccuccggggugugcgucacgggaagccagucuccuuccaccgagauuacacucaaauaucccggcaucagccagucuuccgggggcgacauuggagugcauauggcucacgaugaccaaagcguuuccucuaagaucguggcccauugcccuccccaggacccgugucugguccacggcugcaucgugugugcgcacgggcuuauuaauuaccagugccauaccgcccugagcgcuuucgugguugucuucguguuuuccucuguggccaucauuugucucgcuauccuguauaaaguccuuaagugccugaaaauugccccuagaaaggugcucgauccccugauguggaucacaguuuucauccgguggguguacaaaaagauggucgcgagaguggccgacaacauuaaucagguuaaccgcgaaaucggauggauggagggcgggcaacuggcucucggaaacccugcccccauuccucggcacgcucccaucccgagauacagcaccuaucugaugcuucugcucauuguguccuacgccagcgccuguucugagcugauccaggcuuccagccgcauuacgacaugcucuaccgaaggcgucaauaccaagugucggcuguccgggacagcgcuuaucagagccggcagcgugggagcugaggccugccucaugcugaaaggcguuaaggaagaucagaccaaauuucugaagaucaaaacagugucuagcgagcucuccugucgcgaggggcagagcuauuggacgggaucuuucuccccuaagugccugagcucccggagaugccaucuugucggcgaaugucacgugaaccgcugccugucuuggcgggacaaugagaccagcgccgaauuuuccuucgugggggagucuacaaccaugagagaaaacaaguguuuugagcaaugcggaggcuggggguguggcugcuucaaugucaaccccagcugucucuuuguucacacauaccugcaguccgugcgcaaagaggcucugcggguguucaauugcauugauuggguccauaaacuuacccucgaaaucacggacuuugauggaucugugagcaccauugaccugggcgccuccagcucuagauucacaaacuggggguccguuagccugucucucgaugcggagggaaucuccggcagcaauucuuuuuccuucauugaaagccccgggaagggauaugcuaucguggacgagccuuucuccgaaaucccgcggcagggcuuucugggggagauucgcuguaacagcgagucuagcguccuuuccgcccacgaaucuugccugagagcccccaaucucaucagcuacaagccuaugauugaucagcuggaguguaccacaaaccugaucgaccccuucgugguuuuugaacggggcucccuuccucaaaccagaaaugauaaaacguucgcugccucuaagggaaaccgcggcgugcaggcguuuagcaagggguccguccaggcugaccucacacugauguucgacaauuuugagguggauuucguuggagccgccgugucuugcgacgcugccuuucugaaccucaccggcugcuauagcuguaacgcuggggcccgggucugccuguccauuacaagcaccggaaccggcacacuuucugcgcauaauaaagauggcucccugcacaucgugcuccccagcgaaaacgggacgaaggaccaaugucagauccugcauuucaccgugccugaggucgaggaagaguuuauguacucuugcgauggagacgaaagaccccugcuuguuaaaggcacacucauugccaucgauccguucgacgaucgcagagaggcugggggagaguccaccguggugaauccuaagagcggcuccuggaacuuuuucgacugguucucugggcugaugagcugguuuggaggcccccugaaaacaauucuccugaucugucuuuacgucgcccuguccauuggccucuucuuucugcugaucuaucuugggcggaccggacugagcaagauguggcucgcugccacgaagaaagccucuuga

SEQ ID NO: 14509 - RNA, 3480 nt, Artificial Sequence
  derived and/or modified CDS sequence (opt5) from RVFV(200803167)__JF311382.1__NSm-Gn-Gc
augaucgagggcgccugggacagccugagagaagaggaaaugcccgaggaacucuccugcucugugagcgggauucgggaggucaagaccuccucucaggagcuguaccgcgcucuuaaagccaucauugcggcugauggacugaacaauaucacaugucacggcaagaacccugaagacaaaauuagccucaucaaggggccgccccauaaaaagagaguuggaaucgugcggugcgagcgcagacgggaugccaagcaaauuggccgcgaaacgauggccgggaucgcuaugaccgugcugccugcccuugcugucuucgcccuggcgcccgugguuuuugccgaggaccuccaccugagaaaucggccuggaaaaggccauaacuauauugauggcaugacacaggaggacgcuaccuguaagcccgugacauacgccggggcuugcuccucuuucgauguccugcucgaaaaaggaaaguuuccucuguuccagagcuaugcccaccaucgcacccuucuggaggcggugcacgacacaaucauugccaaagcugauccgcccuccugugaccuccagagcgcccacggcaauccuugcaugaaggaaaagcugguuaugaaaacccauugucccaacgauuaccaaucugcucacuaucuuaauaacgacgggaagauggccuccgugaaaugcccucccaaguacgagcugacggaagauuguaauuuuugcagacagaugaccggagccagccucaaaaagggcucuuauccgcugcaggaccuguucugucaguccagcgaggacgaugggucuaaacucaagacaaagaugaaaggagucugcgaggugggcgugcaagcucugaagaaaugcgacggccagcuuuccaccgcgcaugaagucguuccuuuugccguguucaagaacagcaaaaagguguaccuggauaagcucgaccugaaaacagaggaaaaucuucugcccgauuccuuugucuguuucgagcacaaggggcaguacaaaggaaccauggacucuggccagacgaagcgggaacucaagagcuuugauaucucccaaugcccuaaaauugggggacacggcagcaagaaauguacaggggacgcugccuucugcucugccuaugaguguaccgcucaguacgccaacgcguauugcucccaugcuaauggaagcggcaucgugcagauccaaguuucuggcguguggaagaaaccccugugugucggguacgagcgcgugguugugaagagagaacugagcgccaaacccauucagcgggucgagccuugcacaaccuguaucaccaagugcgaaccgcacggacucgugguccgcuccacaggcuuuaagauuucuagcgccguggcuugugccuccgggguuugcgugacgggaagccagucucccuccaccgagaucgcucugaaauauccuggcauuagccagucuuccgggggcgauaucggaguccauauggcccacgacgaucaaagcguguccucuaagaucguugcgcauugucccccucaggaccccugccuugugcacggcugcauugucugugcccacgggcugaucaacuaccagugccauacagcucucagcgccuucguggugguuuucgucuuuuccucuauugcuaucauuugucuggccauccuuuauagagugcugaaaugccucaagaucgcgccgcggaaagugcugaauccucugauguggauuaccgccuucaucagaugggucuacaagaaaaugguggcucgcguugccgacaacauuaaccaggugaaucgggaaaucggauggauggagggcgggcaacucguccugggaaaccccgcuccuauucccagacacgccccuaucccccgcuacagcacauaucuuaugcugcuccugauuguguccuacgccagcgcuuguucugagcugauccaggcguccagccggaucaccacgugcucuacagaaggcguuaauaccaaguguagacuuuccgggaccgcccucauucgcgcuggcagcgugggagccgaggccugccugaugcugaagggcgucaaagaagaucagacaaaguuucucaaaaucaagaccgugucuagcgagcuguccugucgggaggggcagagcuauuggacaggaucuuucuccccgaaaugccuuagcuccagacgcugccaucugguuggcgaaugucacgugaaccggugccucucuuggagagacaaugagacgagcgcugaauuuuccuucgucggggagucuaccacaaugcgcgaaaacaaguguuuugagcaaugcggaggcuggggguguggcugcuucaaugugaacccuagcugucuguuugugcacaccuaccugcaguccguccggaaggaggcccuuagaguuuucaauugcauugauugggugcauaaacucacacuggaaaucaccgacuuugauggaucugugagcacgauugaccugggcgcguccagcucucgguucaccaacuggggguccgucagccucucucuggaugcugagggaaucuccggcagcaauucuuuuuccuucaucgaaagccccgggaagggauaugccauuguggacgagcccuucuccgaaaucccucgccagggcuuucuuggggagauuagauguaacagcgagucuagcguucuguccgcccacgaaucuugccuccgggcuccgaaucugaucagcuacaaacccaugauugaucagcuggaguguacaaccaaccuuaucgacccuuucguggucuuugaaagaggcucccucccccaaacacgcaaugauaagaccuucgccgcgucuaaaggaaaccggggcgugcaggcuuuuagcaagggguccguucaggccgaccugacgcugauguucgauaacuuugagguggacuucgucggagccgcugugucuugcgacgccgcuuuucucaaucugacaggcugcuauagcuguaacgccggggcgagaguuugccuuuccaucaccagcacaggaaccggcacccugucugcccauaauaaggauggcucccuccacauugugcugccuagcgaaaacgggacaaaagaccaaugucagauccugcauuucacgguccccgagguggaggaagaguuuauguacucuugcgauggagacgaacgcccucuucucgugaagggcacccugauugcuaucgaucccuucgacgauagacgggaggccgggggagaguccacagucguuaauccgaaaagcggcuccuggaacuuuuucgacugguucucugggcugaugagcugguuuggaggcccucucaagaccaugcugcuuauuugucuguacguggcucucuccaucggccuguucuuucugcuuaucuaucuggggcgcacaggacucagcaaaauguggcuggccgccaccaagaaggcuucuuga

SEQ ID NO: 14510 - RNA, 3480 nt, Artificial Sequence
  derived and/or modified CDS sequence (opt5) from RVFV(25010-24)__KM210509.1__NSm-Gn-Gc
augaucgagagagccugggacagccugcgggaagaggaaaugcccgaggaacucuccugcucuauuagcggcauccgcgaggugaagaccuccucucaggagcuguacagagcucuuaaagccauuaucgcggcugaugggcugaauaauauuacaugucacggaaaggacccugaagauaaaaucagccucaucaagggcccgccccauaaaaagcgggucgggauuguucgcugcgagagacggcgcgacgccaagcaagugggaagagaaacgauggccggcaucgcuaugaccgugcugccugcccuugcugucuucgcccuggcgcccgugguuuuugccgaggauccucaccuccggaaccgccccgggaaaggacauaauuauauugacggcaugacacaggaggaugcuaccuguaagccugugacauacgccggcgcuugcuccucuuucgacguccugcuggaaaaagggaaguuuccccucuuccagagcuaugcccaccauagaacccugcuugaggcggugcacgauacaaucauugccaaagcugacccgccuuccugugaucugcagagcgcccacggaaaccccugcaugaaggaaaagcucguuaugaaaacccauuguccuaaugacuaccaaucugcucacuaucugaacaaugauggcaagauggccuccgugaaaugucccccgaaguacgagcuuacggaagacugcaacuuuugccggcagaugaccggggccagccugaaaaagggaucuuauccucuccaggaccuguucugucaguccagcgaggaugacggcucuaaacugaagacaaagaugaaaggggucugcgaggugggagugcaagcucucaagaaaugcgauggccagcuguccaccgcgcaugaagucguucccuuugccguguucaagaauagcaaaaagguguaccuugacaagcuggaucucaaaacagaggaaaaccugcuuccugacuccuuugucuguuucgagcacaagggccaguacaaagggaccauggauucuggacagacgaagcgcgaacugaaauccuuugacaucucccaaugccccaagauuggcgggcacggaagcaagaaauguacaggcgaugcugccuucugcucugccuaugaguguaccgcucaguacgccaaugcguauugcucccaugcuaacgggagcggaaucgugcagauccaaguuucuggcguguggaagaaaccccucugugucggcuacgagagagugguugugaagcgggaacugagcgccaaaccuauucagcgcgucgagccgugcacaaccuguaucaccaagugcgaaccccacgggcugauugugagauccacaggauuuaagaucucuagcgccgucgcuugugccuccggcgugugcguuacggggagccagucuccuuccaccgagauuacacucaaauaucccggaaucagccagucuuccggcggggacaucggcgugcauauggcucacgaugaccaaagcgucuccucuaagauuguggcccauugcccuccccaggacccgugucugguucacggaugcaucgugugugcgcacggccuuauuaauuaccagugccauaccgcccugagcgcuuucgucgugguguucguuuuuagcucugucgccaucauuugucucgcuauccuguauaaagugcuuaagugccugaaaaucgccccuaagaaagugcucaacccccugauguggauuacagcguucauccggugggucuacaagaagaugguggccagaguugcugauaauauuaaccaggugaaccgcgaaaucggguggauggagggaggccaacuggcccucgggaauccugcucccauuccucggcacgcccccaucccgagauacagcaccuaucugaugcuucugcucauugucuccuacgccagcgcuuguucugagcugauccaggcguccagccgcaucacgacaugcucuaccgaaggagugaacaccaaaugucggcuguccggcacagcccuuauuagagcugggagcguuggcgccgaggccugccucaugcugaagggagugaaagacgaucagaccaaguuucugaaaaucaagacagucucuagcgaacucuccugucgcgagggccagagcuauuggacggggucuuucuccccuaagugccugagcucccggagaugccaucuugugggagagugucacguuaaucgcugccugucuuggcgggacaacgaaaccagcgcugaguuuuccuucgugggcgaaucuacaaccaugagagagaauaaauguuuugaacaaugcgggggauggggcugugggugcuucaacgucaaucccagcugucucuuugugcacacauaccugcaguccgugcgcaaggaggcccugcgggucuucaacugcauugauuggguucauaaacuuacccucgagaucacggacuuugauggcucugugagcaccauugaccugggagcguccagcucuagauucacaaauuggggcuccgugagccugucucucgaugcugaagggaucuccggaagcaacucuuuuuccuucaucgagagccccggcaagggguaugccauugucgacgaaccuuucuccgagaucccgcggcagggauuucugggcgaaauucgcuguaauagcgagucuagcgugcuuuccgcccacgagucuugccugagagcucccaaccucaucagcuacaaaccuaugauugaucagcuggaauguaccacaaaucugaucgaccccuucguuguguuugagcgggggucccuuccucaaaccagaaacgauaagacguucgccgcgucuaagggcaaucgcggaguccaggcuuuuagcaaaggcuccgugcaggccgaccucacacugauguucgacaacuuugaaguugauuucgugggggccgcugucucuugcgacgccgcuuuucugaaccucaccggaugcuauagcuguaaugccggcgcgcgggugugccuguccaucacaagcaccgggaccggaacacuuucugcccauaacaaggauggcucccugcacauuguucuccccagcgagaauggcacgaaagaccaaugucagauccugcauuucaccgugccugaagucgaggaggaauuuauguacucuugcgauggggacgagagaccccugcuugugaagggaacacucauugcuaucgauccguucgacgaucgcagagaagccggcggggaguccaccguggucaacccuaaaagcggauccuggaacuuuuucgacugguucucuggccugaugagcugguuugggggaccccugaagacaauucuccugaucugucuuuacguugcucuguccaucggccucuucuuucugcugauuuaucuuggccggaccgggcugagcaagauguggcucgccgccacgaaaaaggcuucuuga

SEQ ID NO: 14511 - RNA, 3480 nt, Artificial Sequence
  derived and/or modified CDS sequence (opt5) from RVFV(Sudan 2V-2007)__JQ820490.1__NSm-Gn-Gc
augaucgagggcgccugggacagccugagagaagaggaaaugcccgaggaacucuccugcucugugagcgggauucgggaggucaagaccuccucucaggagcuguaccgcgcucuuaaagccaucauugcggcugauggacugaacaauaucacaugucacggcaagaacccugaagacaaaauuagccucaucaaggggccgccccauaaaaagagaguuggaaucgugcggugcgagcgcagacgggaugccaagcaaauuggccgcgaaacgauggccgggaucgcuaugaccgugcugccugcccuugcugucuucgcccuggcgcccgugguuuuugccgaggacccucaccucagaaaucggcccggaaaaggccauaacuauauugauggcaugacacaggaggacgcuaccuguaagccugugacauacgccggggcuugcuccucuuucgauguccugcuggaaaaaggaaaguuuccccucuuccagagcuaugcccaccaucgcacccugcuugaggcggugcacgacacaaucauugccaaagcugaucccccuuccugugaccugcagagcgcccacggcaaucccugcaugaaggaaaagcucguuaugaaaacccauuguccuaacgauuaccaaucugcucacuaucugaauaacgacgggaagauggccuccgugaaaugcccgccgaaguacgagcuuacggaagauuguaauuuuugcagacagaugaccggagccagccugaaaaagggcucuuauccucuccaggaccuguucugucaguccagcgaggacgaugggucuaaacugaagacaaagaugaaaggagucugcgaggugggcgugcaagcucucaagaaaugcgacggccagcuguccaccgcgcaugaagucguucccuuugccguguucaagaacagcaaaaagguguaccuugauaagcuggaccucaaaacagaggaaaaucugcuuccugauuccuuugucuguuucgagcacaaggggcaguacaaaggaaccauggacucuggccagacgaagcgggaacugaaaucuuuugauaucucccaaugccccaagauugggggacacggcagcaagaaauguacaggggacgcugccuucugcucugccuaugaguguaccgcucaguacgccaacgcguauugcucccaugcuaauggaagcggcaucgugcagauccaaguuucuggcguguggaagaaaccccucugugucggguacgagcgcgugguugugaagagagaacugagcgccaaaccuauucagcgggucgagccgugcacaaccuguaucaccaagugcgaaccccacggacuggugguccgcuccacaggcuuuaagauuucuagcgccguggcuugugccuccgggguuugcgugacgggaagccagucuccuuccaccgagaucacacucaaauaucccggcauuagccagucuuccgggggcgauaucggaguccauauggcucacgacgaucaaagcguguccucuaagaucguugcccauugcccuccccaggacccguguagcgugcacggcugcauugucugugcgcacgggcugaucaacuaccagugccauaccgcccuuuccgcuuucguggugguuuucgucuuuucuagcauugccaucauuugucuggcuauccucuauagagugcugaaaugccuuaagaucgccccucggaaagugcugaauccccucauguggauuacagcguucaucagaugggucuacaagaaaaugguggcccgcguugcugacaacauuaaccaggugaaucgggaaaucggauggauggagggcgggcaacugguccugggaaacccugcccccauuccuagacacgcucccaucccgcgcuacuccaccuaucucaugcugcuucugauugugagccaugccucugccuguuccgagcucauccaggcuagcucucggaucacgacaugcuccaccgaaggcguuaauaccaaguguagacugagcgggacagcgcugauucgcgccggcucugugggagcugaggccugccuuaugcucaagggcgucaaagaagaucagaccaaguuucugaaaaucaagacagugagcuccgagcugagcugucgggaggggcagucuuacuggacgggauccuucagcccuaaaugccucuccucuagacgcugccaccugguuggcgaaugucacgugaaccggugccuuagcuggagagacaaugagaccuccgccgaauuuucuuucgucggggagagcacaaccaugcgcgaaaacaaguguuuugagcaaugcggaggcuggggguguggcugcuucaaugugaaccccuccugucuguuugugcauacauaucuccagucuguccggaaggaggcucugagaguuuucaauugcauugauugggugcacaaacugacccuugaaaucacggacuuugauggaagcguguccaccauugaccucggcgccagcagcucccgguucacaaacugggggagcgucucucugucccuggaugcggagggaaucagcggcucuaauuccuuuagcuucaucgaaucccccgggaagggauacgcuauuguggacgagccuuucagcgaaaucccgcgccagggcuuucucggggagauuagauguaacucugagagcuccguucugucugcccaugaaagcugccuucgggcccccaaucugaucuccuauaaaccuaugauugaucagcucgaguguaccacaaaccugaucgaccccuucguggucuuugaaagaggcucucugccucaaacccgcaaugauaagacguucgcugccagcaaaggaaaccggggcgugcaggcguuuuccaaggggucuguucaggcugaccuuacacucauguucgauaacuuugagguggacuucgucggagccgccgugagcugcgacgcugccuuucugaaucugaccggcugcuacuccuguaacgcuggggccagaguuugccucagcaucacaucuaccggaaccggcacacuguccgcgcacaauaaggauggcagccuucauauugugcugcccucugaaaacgggacgaaagaccaaugucagauccuccacuucaccgucccugagguggaggaagaguuuauguauuccugcgauggagacgaacgcccccugcuggugaagggcacacuuauggccauugauccguucgacgauagacgggaggcugggggagagagcaccgucguuaauccuaaauccggcucuuggaacuuuuucgacugguucagcgggcucauguccugguuuggaggcccccugaagacaauccugcucauuugucuguacguggcccuuagcaucggccuguucuuucuccugaucuaccuggggcgcaccggacuuucuaaaauguggcuggcugccacgaagaaggccuccuga

SEQ ID NO: 14512 - RNA, 3480 nt, Artificial Sequence
  derived and/or modified CDS sequence (opt5) from RVFV(SAUDI 200010901)__KU978778.1__NSm-Gn-Gc
augaucgagggcgccugggacagccugagagaagaggaaaugcccgaggaacucuccugcucugugagcgggauucgggaggucaagaccuccucucaggagcuguaccgcgcucuuaaagccaucauugcggcugauggacugaacaauaucacaugucacggcaagaacccugaagacaaaauuagccucaucaaggggccgccccauaaaaagagaguuggaaucgugcggugcggccgcagacgggauacgaagcaaauugggcgcgagaccauggccggaaucgccaugacagugcugccugcucuugccgucuucgcucuggcccccgugguuuuugcggaagacccucaccucagaaaucggcccggcaaaggccauaacuauauugaugggaugacccaggaggacgccacauguaagccugugaccuacgcuggagccugcuccucuuucgauguccugcuggagaaaggcaaguuuccccucuuccagagcuaugcucaccaucgcacacugcuugaagccgugcacgacaccaucauugcgaaagccgaucccccuuccugugaccugcagagcgcucacgggaaucccugcaugaaggagaagcucguuaugaaaacgcauuguccuaacgauuaccaaucugcccacuaucugaauaacgacggaaagauggcuuccgugaaaugcccgccgaaguacgaacuuaccgaggauuguaauuuuugcagacagaugacaggcgccagccugaaaaaggggucuuauccucuccaggaccuguucugucaguccagcgaagacgauggaucuaaacugaagaccaagaugaaaggcgucugcgaggugggcgugcaagcccucaagaaaugcgacgggcagcuguccacagcucaugaggucguucccuuugcgguguucaagaacagcaaaaagguguaccuugauaagcuggaccucaaaaccgaagagaaucugcuuccugauuccuuugucuguuucgaacacaagggacaguacaaaggcacgauggacucugggcagacaaagcgggagcugaaauccuuugauaucagccaaugccccaagauuggaggccacgggagcaagaaauguaccggagacgccgcuuucugcucugccuaugaauguacagcccaguacgcuaacgccuuuugcucccaugcgaauggcagcggcaucgugcagauccaaguuucugggguguggaagaaaccccucugugucggauaugagcgcgugguugugaagagagagcugagcgcuaaaccuauucagcgggucgaaccgugcaccaccuguaucacaaagugcgagccccacggccuggugguccgcuccacgggguucaagauuucuagcgccguggccugugcuuccggaguuugcgugaccggcagccagucuccuuccacagaaaucacccucaaauaccccgggauuagccagucuuccggcggagauaucggcguccauauggcccacgacgaucaaagcguguccucuaagaucguugcucauugcccuccccaggacccgugucuggugcacgggugcauugucugugcccacggacuuaucaacuaucagugccauacagcgcugagcgccuucguggugguuuuugucuucuccucuauugcuaucauuugucucgccauccuguacagagugcuuaaaugccugaagaucgcuccucggaaagugcucaauccccugauguggauuaccgccuuuaucagaugggucuauaagaaaaugguggcgcgcguugccgacaacauuaaccaggugaaucgggagaucggcuggauggaagggggacaacugguccucggcaacccugcucccauuccuagacacgcccccaucccgcgcuacagcacguaccugaugcuucugcucauuaucuccuaugcuagcgccuguucugagcugauccaggccuccagccggauuacaaccugcucuaccgagggggugaauacaaaguguagacuguccggcaccgcucuuauccgcgcgggaagcguuggcgccgaggcuugccucaugcugaagggggugaaagaagaucagacaaaguuccugaaaauuaagacggucucuagcgaacucuccugucgggagggacagagcuacuggaccggcucuuuuuccccuaaaugccugagcuccagacgcugccaucuugugggggagugucacguuaaccggugccugucuuggagagacaaugaaacaagcgccgaguucuccuuugugggagaaucuaccacaaugcgcgagaacaaguguuucgaacaaugcggcggguggggcuguggaugcuuuaaugucaaccccagcugucucuucgugcacaccuaucugcaguccgugcggaaggaggcccugagagucuuuaauugcaucgauuggguucauaaacuuacgcucgagauuaccgacuucgauggcucugugagcacaaucgaccugggggcuuccagcucucgguuuaccaacuggggauccgugagccugucucucgaugccgaaggcaucuccgggagcaauucuuucuccuucauugagagccccggaaagggcuacgcgaucgucgacgaaccuuuuuccgagauuccgcgccagggguuccugggcgaaaucagauguaacagcgagucuagcgugcuuuccgcucacgagucuugccugcgggcccccaaucucauuagcuauaaaccuaugaucgaucagcuggaauguacaaccaaccugaucgaccccuuuguuguguucgagagaggaucccuuccucaaacgcgcaaugaaaagacauuugccgcuucuaaaggcaacagagggguccaggccuucagcaagggauccgugcaggcggaucucacccugauguuugacaacuucgagguugauuuugugggcgcugccgucucuugcgacgccgcuuuccugaaucucacagggugcuacagcuguaacgccggagcucgggugugccuguccauuaccagcaccggcacaggcacgcuuucugcccauaauaaggacgggucccugcacaucguucuccccagcgaaaacggaaccaaagaucaaugucagauucugcauuuuacagugccugaggucgaggaagaguucauguauucuugcgacggcgaugaacgcccccugcuugugaaggggacccucaucgcgauugacccguuugaugacagacgggaggccggaggcgaguccacaguggucaauccuaaaagcggguccuggaacuucuucgauugguuuucuggacugaugagcugguucggcggcccccugaagaccauccuccugaucugucuuuacguugcucuguccauugggcucuuuuuccugcugaucuaccuuggacgcacgggccugagcaaaauguggcucgccgcuacaaagaaggccucuuga

SEQ ID NO: 14513 - RNA, 3480 nt, Artificial Sequence
  derived and/or modified CDS sequence (opt5) from RVFV(2373/74)__DQ380194.1__NSm-Gn-Gc
augaucgagggcgccugggacagccugagagaagaggaaaugcccgaggaacucuccugcucuauuagcgggauccgggaggugaagaccuccucucaggagcuguaccgcgcucuuaaagccauuaucgcggcugauggacugaauaauauuacauguuauggcaaggacccugaagauaaaaucagccucaucaaggggccgccccacaaaaagagagucggaauuguucggugcgagcgcagacgggacgccaagcaaaucggccgcgaaacgauggccgggauugcuaugaccgugcugccugcccuugcuguguucgcccuggcgcccgucguguuugccgaggauccucaucucagaaaccggcccggaaaaggccacaauuacaucgacggcaugacacaggaggaugcuaccuguaagccuguuacauaugccggggcuugcuccucuuucgacgugcugcuggaaaaaggaaaguuuccccucuuccagagcuacgcccaucaccgcacccugcuugaggcgguccaugauacaauuaucgccaaagcugacccgccuuccugugaucugcagagcgcccacggcaaccccugcaugaaggaaaagcucgugaugaaaacccacuguccuaaugacuaucaaucugcucauuaccugaacaaugaugggaagauggccuccguuaaaugucccccgaaguaugagcuuacggaagacugcaacuuuugcagacagaugaccggagccagccugaaaaagggcucuuacccucuccaggaccuguucugucaguccagcgaggaugacgggucuaaacugaagacaaagaugaaaggagugugcgaggucggcgugcaagcucucaagaaaugcgauggccagcuguccaccgcgcacgaagugguccccuuugccguuuucaagaauagcaaaaagguguaccuugacaagcuggaucucaaaacagaggaaaaccugcuuccugacuccuuuguguguuucgagcauaaggggcaguauaaaggaaccauggauucuggccagacgaagcgggaacugaaauccuuugacauuucccaaugccccaagaucgggggacacggcagcaagaaauguacaggggaugcugccuucugcucugccuacgaguguaccgcucaguaugccaaugcguacugcucccacgcuaacggaagcggcaucguccagauucaagugucuggcguuuggaagaaaccccucugugugggguaugagcgcgucgugguuaagagagaacugagcgccaaaccuauccagcggguggagccgugcacaaccuguauuaccaagugcgaaccccauggacuggucgugcgcuccacaggcuuuaagaucucuagcgccgucgcuugugccuccggggugugcguuacgggaagccagucuccuuccaccgagauuacacucaaauaccccggcaucagccagucuuccgggggcgacaucggagugcacauggcucaugaugaccaaagcgucuccucuaagaugguggcccacugcccuccccaggacccgugucugguucauggcugcauugugugugcgcacgggcuuaucaauuaucagugccacaccgcccugagcgcuuucgucgugguguucguuuuuagcucugucgccauuaucugucucgcuauucuguacaaagugcuuaagugccugaaaaucgccccuagaaaggugcucaacccccugauguggaucacagcguucauucggugggucuacaaaaagaugguggccagaguugcugauaauaucaaccaggugaaccgcgaaauuggauggauggagggcgggcaacuggcccucggaaauccugcucccaucccucggcaugcccccauuccgagauauagcaccuaccugaugcuucugcucaucgucuccuaugccagcgcuuguucugagcugauucaggcguccagccgcaucacgacaugcucuaccgaaggcgugaacaccaagugucggcuguccgggacagcccuuaucagagcuggcagcguuggagccgaggccugccucaugcugaaaggcgugaaggaagaccagaccaaauuucugaagauuaaaacagucucuagcgagcucuccugucgcgaggggcagagcuacuggacgggaucuuucuccccuaagugccugagcucccggagaugccaccuugugggcgaaugucauguuaaucgcugccugucuuggcgggauaacgagaccagcgcugaauuuuccuucgugggggagucuacaaccaugagagaaaauaaguguuuugagcaaugcggaggcuggggguguggcugcuucaacgucaaucccagcugucucuuugugcacacauaucugcaguccgugcgcaaagaggcccugcgggucuucaacugcaucgacuggguucacaaacuuacccucgaaauuacggauuuugacggaucugugagcacccuggaucugggcgcguccagcucuagauucacaaauuggggguccgugagccucucucuggacgcugagggaaucuccggcagcaacucuuuuuccuucauugaaagccccgggaaaggauacgccaucgucgaugagccuuucuccgaaaucccgcggcagggcuuucuuggggagauucgcuguaauagcgagucuagcgugcuguccgcccaugaaucuugccucagagcucccaaccugaucagcuauaagccuaugauugaccagcuggaguguaccacaaaucuuaucgaucccuucguuguguuugaacggggcucccucccucaaaccagaaacgagaaaacguucgccgcgucuaagggaaaucgcggcguccaggcuuuuagcaagggguccgugcaggccgaccugacacugauguucgauaacuuugaaguugacuucgugggagccgcugucucuugcgacgccgcuuuucucaaccugaccggcugcuacagcuguaaugccggggcgcgggugugccuuuccauuacaagcaccggaaccggcacacugucugcccacaacaaagauggcucccuccauaucguucugcccagcgagaaugggacgaaggaccaaugucagauccugcacuucaccgugccugaggucgaagaggaauuuauguacucuugcgauggagacgagagaccccuucucgugaaaggcacacugauugcuaucgauccguucgacgaucgcagagaggccgggggagaauccaccguggucaacccuaagagcggcuccuggaacuuuuucgacugguucucugggcugaugagcugguuuggaggcccccucaaaacaauucugcuuaucugucuguauguugcucucuccauuggccuguucuuucugcuuaucuaccuggggcggaccggacucagcaagauguggcuggccgccacgaagaaggcuucuuga

SEQ ID NO: 14514 - RNA, 3480 nt, Artificial Sequence
  derived and/or modified CDS sequence (opt5) from RVFV(KEN/Kil-006/07)__HM586966.1__NSm-Gn-Gc
augaucgagggcgccugggacagccugagagaagaggaaaugcccgaggaacucuccugcucugugagcgggauucgggaggucaagaccuccucucaggagcuguaccgcgcucuuaaagccaucauugcggcugauggacugaacaauaucacaugucacggcaagaacccugaagacaaaauuagccucaucaaggggccgccccauaaaaagagaguuggaguggugcggugcgagcgcagacgggaugccaagcaaaucggccgcgaaacgauggccgggauugcuaugaccguccugccugcccuugcuguguucgcccuggcgcccguuguguuugccgaggacccucaccucagaaaucggcccggaaaaggccauaacuauaucgauggcaugacacaggaggacgcuaccuguaagccugucacauacgccggggcuugcuccucuuucgaugugcugcuggaaaaaggaaaguuuccgcuguuccagagcuaugcccaccaucgcacccugcuugaggcgguucacgacacaauuaucgccaaagcugaucccccuuccugugaccugcagagcgccgauggcaauaagugcaugaaggaaaaacucgugaugaagacccacugucccaacgacuaccaaucugcucauuaucugaauaacgaugggaaaauggccuccgucaagugcccucccaaauacgagcuuacggaagacuguaauuuuugcagacagaugaccggagccagccugaagaaaggcucuuauccgcuccaggaccuguucugucaguccagcgaggaugacgggucuaagcugaagacaaaaaugaagggagugugcgaggugggcguccaagcucucaaaaagugcgauggccagcuguccaccgcgcacgaaguugugccuuuugccguguucaaaaacagcaagaaggucuaccuugacaaacuggaucucaagacagaggaaaaucugcuucccgacuccuuuguguguuucgagcauaaagggcaguacaagggaaccauggauucuggccagacgaaacgggaacucaagagcuuugacauuucccaaugcccuaagaucgggggacacggcagcaaaaaguguacaggggaugcugccuucugcucugccuaugaguguaccgcucaguacgccaacgcguauugcucccacgcuaauggaagcggcauuguucagauccaagugucuggcgucuggaaaaagccccucugugugggguacgagcgcguuguggucaaaagagaacugagcgccaagcccauccagcggguggagccuugcacaaccuguauuaccaagugcgaaccgcauggacuggucgugcgcuccacaggcuuuaaaaucucuagcgccguugcuugugccuccggggugugcgucacgggaagccagucucccuccaccgagauuacacucaaguauccuggcaucagccagucuuccgggggcgacauuggagugcacauggcucaugaugaccaaagcguuuccucuaaaaucguggcccacugcccgccucaggaccccugucugguccauggcugcaucgugugugcgcacgggcuuauuaacuaccagugccacaccgcccugagcgcuuucgugguuaucuucgucuuuuccucuacagccauuaucugucucgcugugcuguauagagugcuuaagugccugaaaauugccccgcggaagguccucaauccucugauguggaucaccgcguucaucagauggguguacaaaaagaugguugcccgcguggcugauaacauuaaccaggucaaucgggaaaucggauggauggagggcgggcaacuggcccucggaaaccccgcuccuauucccagacaugccccuaucccccgcuacagcacguaucugaugcuucugcucauuguguccuacgccagcgcuuguucugagcugauccaggcguccagccggauuacaaccugcucuaccgaaggcguuaauacaaaguguagacuguccgggaccgcccuuauccgcgcuggcagcgugggagccgaggccugccucaugcugaaaggcgucaaggaagaccagacaaaauuucugaagaucaaaacggugucuagcgagcucuccugucgggaggggcagagcuauuggaccggaucuuucuccccgaagugccugagcuccagacgcugccaccuuguuggcgaaugucaugugaaccggugccugucuuggagagauaaugagacaagcgcugaauuuuccuucgucggggagucuaccacaaugcgcgaaaacaaguguuuugagcaaugcggaggcuggggguguggcugcuucaaugugaacccuagcugucucuuugugcacaccuaccugcaguccguccggaaagaggcccugagaguuuucaauugcauugacugggugcacaaacuuacgcucgaaaucaccgauuuugacggaucugugagcacaauugaucugggcgcguccagcucucgguucaccaacuggggguccgucagccugucucucgacgcugagggaaucuccggcagcaauucuuuuuccuucauugaaagccccgggaaaggauaugccaucguggaugagcccuucuccgaaaucccucgccagggcuuucugggggagauuagauguaacagcgagucuagcguucuuuccgcccaugaaucuugccugcgggcuccgaaucucgugagcuacaagcccaugaucgaccagcuggaguguacaaccaaccugauugauccuuucgucguguuugaaagaggcucccuuccccaaacgcgcaaugacaaaacauucgccgcgucuaagggaaaccggggcguucaggcuuuuagcaagggguccgugcaggccgaucucacccugauguucgacaacuuugaggucgacuucgugggagccgcuguuucuugcgaugccgcuuuucugaaucucacaggcugcuauagcuguaacgccggggcgagagugugccuguccaucaccagcaccggaacaggcacgcuuucugcccacaauaaagacggcucccugcauauuguccucccuagcgaaaacgggaccaaggaucaaugucagauccugcacuucacagugcccgagguggaggaagaguuuauguacucuugcgacggagaugaacgcccucugcuugucaaaggcacccucaucgcuauugaccccuucgaugacagacgggaggccgggggagaguccacaguugugaaucccaagagcggcuccuggaacuuuuucgauugguucucugggcugaugagcugguuuggaggcccucugaaaaccauccuccugauuugucuuuacguggcucuguccaucggccucuucuuucugcugauuuaucuugggcgcacgggacugagcaagauguggcucgccgccacaaagaaggcuucuuga

SEQ ID NO: 14515 - RNA, 3480 nt, Artificial Sequence
  derived and/or modified CDS sequence (opt5) from RVFV(MgH824)__DQ380210.1__NSm-Gn-Gc
augaucgagggcgccugggacagccugagagaagaggaaaugcccgaggaacucuccugcucuauuagcgggauccgggaggugaagaccuccucucaggagcuguaccgcgcucuuaaagccauuaucgcggcugauggacugaacaauauuacaugucacggcaaggacccugaagauaaaaucagccucaucaaggggccgccccauaaaaagagagucggaauuguucggugcgagcgcagacgggacgccaagcaaaucggccgcgaaacgauggccgggauugcuaugaccgugcugccugcccuugcuguguucgcccuggcgcccgucguguuugccgaggauccucaccucagaaaccggcccggaaaaggcuauaauuacaucgacggcaugacacaggaggaugcuaccuguaagccuguuacauaugccggggcuugcuccucuuucgacgugcugcuggaaaaaggaaaguuuccccucuuccagagcuacgcccaucaccgcacccugcuugaggcgguccaugauacaauuaucgccaaagcugacccgccuuccugugaucugcagagcgcccacggcaaccccugcaugaaggaaaagcucgugaugaaaacccacuguccuaaugacuaucaaucugcucauuaccugaacaaugaugggaagauggccuccguuaaaugucccccgaaguaugagcuuacggaagacugcaacuuuugcagacagaugaccggagccagccugaaaaagggcucuuacccucuccaggaccuguucugucaguccagcgaggaugacgggucuaaacugaagacaaagaugaaaggagugugcgaggucggcgugcaagcucucaagaaaugcgauggccagcuguccaccgcgcacgaagugguccccuuugccguuuucaagaauagcaaaaagguguaccuugacaagcuggaucucaaaacagaggaaaaccugcuuccugacuccuuuguguguuucgagcggaaggggcaguauaaaggaaccauggauucuggccagacgaagcgcgaacugaaauccuuugacauuagccaaugccccaagaucgggggacauggcagcaagaaauguacaggggaugcugccuucugcucugccuacgaguguaccacacaguaugcuaaugccuacugcucccacgcgaacggaagcggcgucgugcagauccaaguuucuggcguguggaagaaaccccucugugucggguaugagagagugguugugaagcgggaacugagcgcuaaaccuauucagcgcgucgagccgugcaccaccuguaucacaaagugcgaaccccacggacugguggucagauccacgggcuuuaagauuucuagcgccguggccugugcuuccgggguuugcgugaccggaagccagucuccuuccacagagaucacccucaaauaccccggcauuagccagucuuccgggggcgacaucggaguccauauggcccacgaugaccaaagcguguccucuaagaucguugcucauugcccuccccaggacccgugucuggugcacggcugcauugucugugcccaugggcuuaucaauuaucagugccacacagcgcugagcgccuucguggugguuuucgucuuuuccucuauugcuaucauuugucucgccauccuguaccgggugcuuaaaugccugaagaucgcuccuagaaaagugcucaacccccugauguggauuaccgccuucauccgcuggauuuacaagaaaauggucgcgcggguggccgauaauaucaaccagguuaacagagaaauuggauggauggagggcgggcaacuggugcucggaaauccugcucccaucccucgccacgcccccauuccgcgguauagcacguaccugaugcuucugcucaucgucuccuaugcuagcgccuguucugagcugauccaggccuccagcagaauuacaaccugcucuaccgaaggcguggacacaaagugucgccuguccgggaccgcucuuauccgggcgggcagcguuggagccgaggcuugccucaugcugaagggcgugaaagaagaucagacaaaguuucugaaaauuaagacggucucuagcgagcucuccuguagagaggggcagagcuacuggaccggaucuuucuccccuaaaugccugagcucccgccggugccaucuugugggcgaaugucacguuaacagaugccugucuuggcgcgacaaugagacaagcgccgaauuuuccuucgugggggagucuaccacaaugcgggaaaacaaguguuuugagcaaugcggaggcuggggguguggcugcuucaaugucaaccccagcugucucuuugugcauaccuaucugcaguccgugagaaaggaggcccugcgggucuucaauugcaucgauuggguucacaaacuuacgcucgaaauuaccgacuuugauggaucugugagcacaaucgaccugggcgcuuccagcucucgcuucaccaacuggggguccgugagccugucucucgaugccgagggaaucuccggcagcaauucuuuuuccuucauugaaagccccgggaagggauacgcgaucgucgacgagccuuucccggaaauucccagacagggcuuucugggggagauccgguguaacuccgagagcucugugcuuagcgcucacgaauccugccugagagccccuaaucucauuucuuauaaacccaugaucgaucagcuggaguguacaaccaaccugaucgacccuuucguuguguuugaacgcggcagccuuccccaaacgcggaaugauaagacauucgccgcuuccaaaggaaacagaggcguccaggccuuuucuaaggggagcgugcaggcggaccucacccugauguucgacaauuuugagguugauuucgugggagcugccgucuccugcgacgccgcuuuucugaaccucacaggcugcuacucuuguaacgccggggcucgcgugugccugagcauuaccuccaccggaacaggcagccuuucugcccauaauaaggauggcucccugcacaucguucucccuagcgaaaacgggacgaaagaccaaugucagauucugcauuucaccgugcccgaggucgaggaagaguuuauguacucuugcgauggagacgaaagaccgcugcuugugaagggcacacucaucgcgauugauccuuucgacgaucggcgcgaggccgggggagaguccaccguggucaaucccaaaagcggcuccuggaacuuuuucgacugguucucugggcugaugagcugguuuggaggcccucugaagacaauccuccugaucugucuuuauguugcucuguccauuggccucuucuuucugcugaucuaccuugggagaaccggacugagcaaaauguggcucgccgcuacgaagaaggccucuuga

SEQ ID NO: 14516 - RNA, 3480 nt, Artificial Sequence
  derived and/or modified CDS sequence (opt5) from RVFV(SA01-1322)__KX096942.1__NSm-Gn-Gc
augaucgagggcgccugggacagccugagagaagaggaaaugcccgaggaacucuccugcucugugagcgggauucgggaggucaagaccuccucucaggagcuguaccgcgcucuuaaagccaucauugcggcugauggacugaacaauaucacaugucacggcaagaacccugaagacaaaauuagccucaucaaggggccgccccauaaaaagagaguuggaaucgugcggugcggccgcagacgggauacgaagcaaauugggcgcgagaccauggccggaaucgccaugacagugcugccugcucuugccgucuucgcucuggcccccgugguuuuugcggaagacccucaccucagaaaucggcccggcaaaggccauaacuauauugaugggaugacccaggaggacgccacauguaagccugugaccuacgcuggagccugcuccucuuucgauguccugcuggagaaaggcaaguuuccccucuuccagagcuaugcucaccaucgcacacugcuugaagccgugcacgacaccaucauugcgaaagccgaucccccuuccugugaccugcagagcgcucacgggaaucccugcaugaaggagaagcucguuaugaaaacgcauuguccuaacgauuaccaaucugcccacuaucugaauaacgacggaaagauggcuuccgugaaaugcccgccgaaguacgaacuuaccgaggauuguaauuuuugcagacagaugacaggcgccagccugaaaaaggggucuuauccucuccaggaccuguucugucaguccagcgaagacgauggaucuaaacugaagaccaagaugaaaggcgucugcgaggugggcgugcaagcccucaagaaaugcgacgggcagcuguccacagcucaugaggucguucccuuugcgguguucaagaacagcaaaaagguguaccuugauaagcuggaccucaaaaccgaagagaaucugcuuccugauuccuuugucuguuucgaacacaagggacaguacaaaggcacgauggacucugggcagacaaagcgggagcugaaauccuuugauaucagccaaugccccaagauuggaggccacgggagcaagaaauguaccggagacgccgcuuucugcucugccuaugaauguacagcccaguacgcuaacgccuuuugcucccaugcgaauggcagcggcaucgugcagauccaaguuucugggguguggaagaaaccccucugugucggauaugagcgcgugguugugaagagagagcugagcgcuaaaccuauucagcgggucgaaccgugcaccaccuguaucacaaagugcgagccccacggccuggugguccgcuccacgggguucaagauuucuagcgccguggccugugcuuccggaguuugcgugaccggcagccagucuccuuccacagaaaucacccucaaauaccccgggauuagccagucuuccggcggagauaucggcguccauauggcccacgacgaucaaagcguguccucuaagaucguugcucauugcccuccccaggacccgugucuggugcacgggugcauugucugugcccacggacuuaucaacuaucagugccauacagcgcugagcgccuucguggugguuuuugucuucuccucuauugcuaucauuugucucgccauccuguacagagugcuuaaaugccugaagaucgcuccucggaaagugcucaauccccugauguggauuaccgccuuuaucagaugggucuauaagaaaaugguggcgcgcguugccgacaacauuaaccaggugaaucgggagaucggcuggauggaagggggacaacugguccucggcgauccugcucccauuccuagacacgcccccaucccgcgcuacagcacguaccugaugcuucugcucauuaucuccuaugcuagcgccuguucugagcugauccaggccuccagccggauuacaaccugcucuaccgagggggugaacacaaaguguagacuguccggcaccgcucuuauccgcgcgggaagcguuggcgccgaggcuugccucaugcugaagggggugaaagaagaccagacaaaguuccugaaaauuaagacggucucuagcgaacucuccugucgggagggacagagcuacuggaccggcucuuuuuccccuaaaugccugagcuccagacgcugccaucuugugggggagugucacguuaaucggugccugucuuggagagauaacgaaacaagcgccgaguucuccuuugugggagaaucuaccacaaugcgcgagaauaaguguuucgaacaaugcggcggguggggcuguggaugcuuuaacgucaaucccagcugucucuucgugcacaccuaucugcaguccgugcggaaggaggcccugagagucuuuaacugcaucgacuggguucauaaacuuacgcucgagauuaccgauuucgacggcucugugagcacaaucgaucugggggcuuccagcucucgguuuaccaauuggggauccgugagccugucucucgacgccgaaggcaucuccgggagcaacucuuucuccuucauugagagccccggaaagggcuacgcgaucgucgaugaaccuuuuuccgagauuccgcgccagggguuccugggcgaaaucagauguaauagcgagucuagcgugcuuuccgcucacgagucuugccugcgggcccccaaccucauuagcuauaaaccuaugaucgaccagcuggaauguacaaccaaucugaucgaucccuuuguuguguucgagagaggaucccuuccucaaacgcgcaacgaaaagacauuugccgcuucuaaaggcaauagagggguccaggccuucagcaagggauccgugcaggcggaccucacccugauguuugauaacuucgagguugacuuugugggcgcugccgucucuugcgacgccgcuuuccugaaccucacagggugcuacagcuguaaugccggagcucgggugugccuguccauuaccagcaccggcacaggcacgcuuucugcccauaacaaggaugggucccugcacaucguucuccccagcgaaaauggaaccaaagaccaaugucagauucugcauuuuacagugccugaggucgaggaagaguucauguauucuugcgauggcgacgaacgcccccugcuugugaaggggacccucaucgcgauugauccguuugacgauagacgggaggccggaggcgaguccacaguggucaacccuaaaagcggguccuggaauuucuucgacugguuuucuggacugaugagcugguucggcggcccccugaagaccauccuccugaucugucuuuacguugcucuguccauugggcucuuuuuccugcugaucuaccuuggacgcacgggccugagcaaaauguggcucgccgcuacaaagaaggccucuuga

SEQ ID NO: 14517 - RNA, 3480 nt, Artificial Sequence
  derived and/or modified CDS sequence (opt5) from RVFV(Kenya 56 (IB8))__DQ380190.1__NSm-Gn-Gc
augaucgagggcgccugggacagccugagagaagaggaaaugcccgaggaacucuccugcucuauuagcgggauccgggaggugaagaccuccucucaggagcuguaccgcgcucuuaaagccauuaucgcggcugauggacugaacaauauuacaugucacggcaaggacccugaagauaaaaucagccucaucaaggggccgccccauaaaaagcaagucggaauuguuagaugcgagcggcgcagagacgccaagcagaucggccgggaaacgauggccgggauugcuaugaccgugcugccugcccuugcuguguucgcccuggcgcccgucguguuugccgaggauccucaccuccgcaacagacccggaaaaggccauaauuauaucgacggcaugacacagggggaugcuaccuguaagccuguuacauacgccggagcuugcuccucuuucgacgugcugcuggagaaaggcaaguuuccccucuuccagagcuaugcccaccaucggacccugcuugaagcgguccacgauacaauuaucgccaaagcugacccgccuuccugugaucugcaaagcgcccacgggaaccccugcaugaaggagaagcucgugaugaaaacccauuguccuaaggacuaccagucugcucacuaucugaauaacgauggaaaaauggccuccguuaagugucccccgaaauacgaacuuacggaggacugcaauuuuugccgccagaugaccggcgccagccugaagaaagggucuuauccucuccaggaccuguucugucaauccagcgaagaugacggaucuaagcugaagacaaaaaugaagggcgugugcgaggucggcgugcaggcucucaaaaagugcgaugggcagcuguccaccgcgcaugaggugguccccuuugccguuuucaaaaacagcaagaagguguaccuugacaaacuggaucucaagacagaagagaaucugcuuccugacuccuuuguguguuucgaacacaaaggacaguacaagggcaccauggauucugggcaaacgaaaagagagcugaaguccuuugacauuucccagugccccaagaucggaggccacgggagcaaaaaguguacaggagaugcugccuucugcucugccuaugaauguaccgcucaguacgccaacgcguauugcucccaugcuaauggcagcggcaucguccaaauucaggugucugggguuuggaaacggccccucugugugggauacgagcgcgucgugguuaagagagagcugagcgccaaaccuauccagcggguggaaccgugcacaaccuguauuaccaagugcgagccccacggccuggucgugcgcuccacaggguuuaagaucucuagcgccgucgcuugugccuccggagugugcguuacgggcagccagucuccuuccaccgaaauuacacucaaauaucccgggaugagccaaucuuccggcggagacaucggcgugcauauggcucacgaugaccagagcgucuccucuaagaucguggcccauugcccuccccaggacccgugucugguucacgggugcauugugugugcgcacggacuuaucaacuaccagugccauaccgcccugagcgcuuucgucgugguguucguuuuuagcucugucgccauuaucugucucgcuauucuguauaaagugcuuaagugccugaaaaucgccccuagaaaggugcucaauccccugauguggaucacagcguucauucggugggucuacaaaaagaugguggccagaguugcugauaacaucaaucaagugaaccgcgagauuggcuggauggaagggggacagccugcccugggcaaccccgcuccuaucccccggcacgccccgauuccuagauacagcaccuaucucaugcugcuucugaucgucuccuacgccagcgcuuguucugagcucauucaggcguccagccgcaucacgacaugcucuaccgagggggugaauaccaagugucggcuguccggcacagcccugaucagagcuggaagcguuggcgccgaagccugccuuaugcucaaaggggugaaggaggaccagaccaaauuucugaagauuaaaacagucucuagcgaacuguccugucgcgagggacaaagcuauuggacgggcucuuucucccccaagugccucagcucccggagaugccaucuggugggggagugucacguuaaccgcugccuuucuuggcgggauaaugaaaccagcgcugaguuuuccuucgugggagaaucuacaaccaugagagagaacaaguguuuugaacagugcggcggguggggcuguggaugcuucaaugucaaccccagcugucuguuugugcacacauaccuccaguccgugcgcaaagaggcccugcgggucuucaauugcaucgacuggguucauaagcugacccuugagauuacggauuuugacggcucugugagcaccaucgaucucggggcguccagcucuagauucacaaacuggggauccgugagccugucucuggacgcugaaggcauuuccgggagcaauucuuuuuccuucaucgagagcccuggaaaaggcuaugccaucgucgaugaaccguucuccgagauuccccggcagggguuucucggcgaaauccgcuguaacagcgagucuagcgugcuguccgcccacgagucuugccuuagagcuccuaaucugauuagcuacaagcccaugaucgaccaacucgaauguaccacaaaccugauugauccuuucguugccuuugagcggggaucccugccccagaccagaaaugacaaaacguucgcggcuucuaagggcaaccgcggggugcaggccuuuagcaagggauccguccaagccgaucuuacacucauguucgacaauuuugaaguggacuucguuggcgcugccgugucuugcgaugcugccuuucugaaccugaccgggugcuauagcuguaacgcgggagcccgggucugccucuccaucacaagcaccggcaccggcacacugucugcucauaauaaagacgggucccuucacaucgugcugccuagcgagaacggaacgaaggaucagugucagauucuccauuucaccguucccgaaguggaggaggaauuuauguacucuugcgacggcgaugagagaccgcugcuggucaaagggacacuuaucgccauugacccuuucgaugaccgcagagaagcuggaggcgaguccaccguggugaaucccaagagcggguccuggaacuuuuucgauugguucucuggacucaugagcugguuuggcggcccucugaaaacaauccugcucauuugucuguacgucgcccuuuccaucgggcuguucuuucuccugaucuaucugggacggaccggccuuagcaagauguggcuggccgcuacgaagaaagcgucuuga

SEQ ID NO: 14518 - RNA, 3480 nt, Artificial Sequence
  derived and/or modified CDS sequence (opt5) from RVFV(KEN/Mal-032/07)__HM586967.1__NSm-Gn-Gc
augaucgagggcgccugggacagccugagagaagaggaaaugcccgaggaacucuccugcucugugagcgggauucgggaggucaaaaccuccucucaggagcuguaccgcgcucuuaaagccaucauugcggcugauggacugaacaauaucacaugucacggcaagaacccugaagacaaaauuagccucaucaaggggccgccccauaaaaagagaguuggaaucgugcggugcgagcgcagacgggaugccaagcaaauuggccgcgaaacgauggccgggaucgcuaugaccgugcugccugcccuugcugucuucgcccuggcgcccgugguuuuugccgaggacccucaccucagaaaucggcccggaaaaggccauaacuauauugauggccgccugcaggaggacgcuacauguaagccugugaccuacgccggggcuugcuccucuuucgauguccugcucgaaaaaggaaaguuuccgcuguuccagagcuaugcccaccauagaacacuucuggaggcggugcacgacaccaucauugccaaagcugaucccccuuccugugaccuccagagcgccgauggcaauaagugcaugaaggaaaaacugguuaugaagacacacugucccaacgacuaccaaucugcucauuaucuuaauaacgaugggaaaauggccuccgugaagugcccucccaaauacgagcugaccgaagacuguaauuuuugccggcagaugacgggagccagccucaagaaaggcucuuauccgcugcaggaccuguucugucaguccagcgaggaugacgggucuaagcucaagaccaaaaugaagggagucugcgaggugggcgugcaagcucugaaaaagugcgauggccagcuuuccacagcgcacgaagucguuccuuuugccguguucaaaaacagcaagaagguguaccuggacaaacucgaucugaagaccgaggaaaaucuucugcccgacuccuuugucuguuucgagcauaaagggcaguacaagggaacaauggauucuggccagaccaaacgcgaacucaagagcuuugacaucucccaaugcccuaagauugggggacacggcagcaaaaaguguacgggggaugcugccuucugcucugccuaugaguguacagcucaguacgccaacgcguauugcucccacgcuaauggaagcggcaucgugcagauccaaguuucuggcguguggaaaaagccccugugugucggguacgagagagugguugugaaacgggaacugagcgccaagcccauucagcgcgucgagccuugcaccacauguaucaccaagugcgaaccgcauggacucguggucagauccaccggcuuuaaaauuucuagcgccguggcuugugccuccgggguuugcgugacaggaagccagucucccuccacggagaucacccugaaguauccuggcauuagccagucuuccgggggcgacaucggaguccacauggcucaugaugaccaaagcguguccucuaaaaucguugcccacugcccgccucaggaccccugucuugugcauggcugcauugucugugcgcacgggcugaucaacuaccagugccacacagcccucagcgcuuucguggugauuuucgucuuuuccucuaccgccaucauuugucuggcuguucuuuaucgggugcugaagugccucaaaaucgccccgagaaaggugcugaauccucugauguggaucacagcguucauucgcugggucuacaaaaagaugguggcccggguugcugauaacaucaaccaggugaauagagaaauuggauggauggagggcgggcaacucgcccugggaaaccccgcuccuaucccccgccaugccccuauuccccgguacagcaccuaucuuaugcugcuccugaucgucuccuacgccagcgcuuguucugagcugauucaggcguccagcagaaucacgacaugcucuaccgaaggcgugaauaccaagugucgccuuuccgggacagcccucauccgggcuggcagcguuggagccgaggccugccugaugcugaaaggcgugaaggaagaccagaccaaauuucucaagauuaaaacagucucuagcgagcuguccuguagagaggggcagagcuauuggacgggaucuuucuccccgaagugccuuagcucccgccggugccaccuggugggcgaaugucauguuaacagaugccucucuuggcgcgauaaugagaccagcgcugaauuuuccuucgugggggagucuacaaccaugcgggaaaacaaguguuuugagcaaugcggaggcuggggguguggcugcuucaaugucaacccuagcugucuguuugugcacacauaccugcaguccgugagaaaagaggcccuucgggucuucaauugcaucgacuggguucacaagcucacccuggaaauuacggauuuugacggaucugugagcaccaucgaucugggcgcguccagcucucgcuucacaaacuggggguccgugagccucucucuggacgcugagggaauuuccggcagcaauucuuuuuccuucaucgaaagccccgggaaaggauaugccaucgucgaugagcccuucuccgaaauuccuagacagggcuuucuuggggagauccgguguaacagcgagucuagcgugcuguccgcccaugaaucuugccucagagcuccgaaucugguuagcuacaagcccaugauugaccagcuggaguguaccacaaaccuuaucgauccuuucguggucuuugaacgcggcucccucccccaaacccggaaugacaaaacguucgccgcgucuaagggaaacagaggcgugcaggcuuuuagcaagggguccguucaggccgaucugacacugauguucgacaacuuugagguggacuucgucggagccgcugugucuugcgaugccgcuuuucucaaucugaccggcugcuauagcuguaacgccggggcgcgcguuugccuuuccauuacaagcaccggaaccggcacacugucugcccacaauaaagacggcucccuccauaucgugcugccuagcgaaaacgggacgaaggaucaaugucagauccugcacuucaccguccccgagguggaggaagaguuuauguacucuugcgacggagaugaaagaccucuucucgugaaaggcacacugauugcuaucgaccccuucgaugaccggcgcgaggccgggggagaguccaccgucguuaaucccaagagcggcuccuggaacuuuuucgauugguucucugggcugaugagcugguuuggaggcccucucaaaacaauucugcuuaucugucuguacguggcucucuccauuggccuguucuuucugcuuaucuaucuggggagaaccggacucagcaagauguggcuggccgccacgaagaaggcuucuuga

SEQ ID NO: 14519 - RNA, 3480 nt, Artificial Sequence
  derived and/or modified CDS sequence (opt5) from RVFV(KEN/Gar-008/06)__HM586965.1__NSm-Gn-Gc
augaucgagggcgccugggacagccugagagaagaggaaaugcccgaggaacucuccugcucugugagcgggauucgggaggucaagacauccucucaggagcuguaccgcgcucuuaaagccaucauugcggcugauggacugaacaauaucacaugucacggcaagaacccugaagacaaaauuagccucaucaaggggccgccccauaaaaagagaguuggaaucgugcggugcgagcgcagacgggaugccaagcaaauuggccgcgaaacgauggccgggaucgcuaugaccgugcugccugcccuugcugucuucgcccuggcgcccgugguuuuugccgaggacccucaccucagaaaucggcccggaaaaggccauaacuauauugauggcaugacacaggaggacgcuaccuguaagccugugacauacgccggggcuugcuccucuuucgauguccugcuggaaaaaggaaaguuuccccucuuccagagcuaugcccaccaucgcacccugcuugaggcggugcacgacacaaucauugccaaagcugaucccccuuccugugaccugcagagcgcccacggcaaucccugcaugaaggaaaagcucguuaugaaaacccauuguccuaacgauuaccaaucugcucacuaucugaauaacgacgggaagauggccuccgugaaaugcccgccgaaguacgagcuuacggaagauuguaauuuuugcagacagaugaccggagccagccugaaaaagggcucuuauccucuccaggaccuguucugucaguccagcgaggacgaugggucuaaacugaagacaaagaugaaaggagucugcgaggugggcgugcaagcucucaagaaaugcgacggccagcuguccaccgcgcaugaagucguucccuuugccguguucaagaacagcaaaaagguguaccuugauaagcuggaccucaaaacagaggaaaaucugcuuccugauuccuuugucuguuucgagcacaaggggcaguacaaaggaaccauggacucuggccagacgaagcgggaacugaaauccuuugauaucucccaaugccccaagauugggggacacggcagcaagaaauguacaggggacgcugccuucugcucugccuaugaguguaccgcucaguacgccaacgcguauugcucccaugcuaauggaagcggcaucgugcagauccaaguuucucgcguguggaagaaaccccucugugucggcuacgagagagugguugugaagcgggaacugagcgccaaaccuauucagcgcgucgagccgugcacaaccuguaucaccaagugcgaaccccacgggcugguggucagauccacaggauuuaagauuucuagcgccguggcuugugccuccggcguuugcgugacggggagccagucuccuuccaccgagaucacacucaaauaucccggaauuagccagucuuccggcggggauaucggcguccauauggcucacgacgaucaaagcguguccucuaagaucguugcccauugcccuccccaggacccgugucuggugcacggaugcauugucugugcgcacggccuuaucaacuaccagugccauaccgcccugagcgcuuucguggugauuuucguuuuuagcucuacagccaucauuugucucgcuguccuguaucgggugcuuaaaugccugaagaucgccccuagaaaagugcucaauccccugauguggaucaccgcguucauucgcugggucuacaagaaaaugguggcccggguugcugacaacaucaaccaggugaauagagaaauuggguggauggagggaggccaacuggcccucgggaacccugcucccaucccucgccacgcccccauuccgcgguacagcacguaucugaugcuucugcucaucgucuccuacgccagcgcuuguucugagcugauucaggcguccagcagaaucacaaccugcucuaccgaaggagugaauacaaagugucgccuguccggcaccgcccuuauccgggcugggagcguuggcgccgaggccugccucaugcugaagggagugaaagaagaucagacaaaguuucugaaaauuaagacggucucuagcgagcucuccuguagagagggccagagcuauuggaccgggucuuucuccccuaaaugccugagcucccgccggugccaucuugugggagaaugucacguuaacagaugccugucuuggcgcgacaaugagacaagcgcugaauuuuccuucgugggcgagucuaccacaaugcgggaaaacaaguguuuugagcaaugcgggggauggggcugugggugcuucaaugucaaccccagcugucucuuugugcacaccuaccugcaguccgugagaaaggaggcccugcgggucuucaauugcaucgauuggguucauaaacuuacgcucgaaauuaccgacuuugauggcucugugagcacaaucgaccugggagcguccagcucucgcuucaccaacuggggcuccgugagccugucucucgaugcugaggggauuuccggaagcaauucuuuuuccuucaucgaaagccccggcaagggguaugccaucgucgacgagccuuucuccgaaauuccgagacagggauuucugggcgagauccgguguaacagcgagucuagcgugcuuuccgcccacgaaucuugccugagagcucccaaucucguuagcuacaaaccuaugauugaucagcuggaguguacaaccaaccugaucgaccccuucguggucuuugaacgcgggucccuuccucaaacgcggaaugauaagacauucgccgcgucuaaaggcaacagaggagugcaggcuuuuagcaagggcuccguucaggccgaccucacccugauguucgauaaccugaagguggacuuugucggggccgcugugucuugcgacgccgcuuuccucaaucugacaggaugcuauagcuguaacgccggcgcgcgcguuugccuuuccauuaccagcaccgggacaggaacgcugucugcccauaauaaagauggcucccuccacaucgugcugcccagcgagaacggcaccaaggaccaaugucagauccugcauuuuacagucccugaagugaaagaggaguucauguacucuugcgauggggacgaaagagcccuucucaugaagggaacccugauugcuaucgaucccuuugacgaucggcgcgaggcuggcggggaauccacaguggucaauccgaaaagcggauccuggaacuucuuugacugguucucuggccugaugagcugguucgggggaccucucaagaccauucugcuuaucugucuguacguugcccucuccauuggccuguuuuuccugcuuaucuaucugggcagaacggggcucagcaagauguggcuggccgcuaccaaaaaggcgucuuga

SEQ ID NO: 14520 - RNA, 3480 nt, Artificial Sequence
  derived and/or modified CDS sequence (opt5) from RVFV(Beijing-01)__KX611606.1__NSm-Gn-Gc
augaucgagggcgccugggacagccugagagaagaggaaaugcccgaggaacucuccugcucuauuagcgggauccgggaggugaagaccuccucucaggagcuguaccgcgcucuuaaagccauuaucgcggcugauggacugaacaauauuacaugucacggcaaggacccugaagauaaaaucagccucaucaaggggccgccccauaaaaagagagucggaauuguucggugcgagcgcagacgggacgccaagcaaaucggccgcgaaacgauggccgggauugcuaugaccgugcugccugcccuugcuguguucgcccuggcgcccgucguguuugccgaggauccucaccucagaaaccggcccggaaaaggccauaauuauaucgacggcguuacacaggaggaugcuaccuguaagccugugacauacgccggggcuugcuccucuuucgacguccugcuggaaaaaggaaaguuuccccucuuccagagcuaugcccaccaucgcacccugcuugaggcggugcacgauacaauuaucgccaaagcugacccgccuuccugugaucugcagagcgcccacggcaaccccugcaugaaggaaaagcucguuaugaaaacccauuguccuaaugacuaccaaucugcucacuaucugaacaaugaugggaagauggccuccgugaaaugucccccgaaguacgagcuuacggaagacugcaacuuuugcagacagaugaccggagccagccugaaaaagggcucuuauccucuccaggaccuguucugucaguccagcgaggaugacgggucuaaacugaagacaaagaugaaaggagucugcgaggugggcgugcaagcucucaagaaaugcgauggccggcuguccaccgcgcaugaagucguucccuuugccguguucaagaauagcaaaaagguguaccuugacaagcuggaucucaaaacagaggaaaaccugcuuccugacuccuuugucuguuucgagcacaaggggcaguacaaaggaaccauggauucuggccagacgaagcgcgaacugaaauccuuugacauuucccagugccccaagaucgggggacacggcagcaagaaauguacaggggaugcugccuucugcucugccuaugaguguaccgcucaauacgccaaugcguauugcucccaugcuaacggaagcggcaucgugcagauucagguuucuggcguguggaagaaaccccucugugucggguacgagagagugguugugaagcgggaacugagcgccaaaccuauccaacgcgucgagccgugcacaaccuguauuaccaagugcgaaccccacggacugguggucagauccacaggcuuuaagaucucuagcgccguggcuugugccuccgggguuugcgugacgggaagccagucuccuuccaccgagauuacacucaaauaucccggcaucagccagucuuccgggggcgacaucggaguccauauggcucacgaugaccagagcguguccucuaagauuguuuucgacugcccuccccaagauccgugucuggugcauggcugcaucgucugugcccacgggcuuauuaauuaccagugccacaccgcgcugagcgccuucguggugguuuuugucuucuccucuguggcuaucauuugucucgccauccuguauaaagugcuucggugccugaagaucgcuccuaaaaagguccucaacccccugauguggauuacagccuuuaucagauggguguacaaaaagaugguugcgcgcguggccgacaauauuaaccaggucaaccgggaaaucggauggauggagggcgggcagcuggcucucggaaauccugcccccauuccuagacaugcucccaucccgcgcuacagcaccuaucugaugcuucugcucauuaucuccuacgccagcgccuguucugagcugauccaagcuagcagccggauuacgacaugcucuaccgaaggcgugaacaccaaguguagacuguccgggacagcgcuuauccgcgccggcagcguuggagcugaggccugccucauguucgaaggcgugaaagaggaucagaccaaguuucugaaaauuaagacagucucuagcgagcuguccugucgggaagggcagagcuauuggacgggaucuuucuccccuaaaugccucagcuccagacgcugccaccuggugggcgagugucauguuaaucggugccuuucuuggagagacaacgaaaccagcgccgaguuuuccuucgugggggaaucuacaaccaugcgcgagaauaaguguuuugagcagugcggaggcuggggguguggcugcuucaacgucaaucccagcugucuguuugugcacacauaccuccaauccgugcggaaggaagcucugagagucuucaacugcaucgauuggguucacaaacugacccuugagauuacggacuuugauggaucugugagcaccaucgaccucggcgccuccagcucucgguucacaaauuggggguccgugagccugucucuggaugcggaaggaaucuccggcagcaacucuuucuccuuuauugagagccccgggaagggauaugcuaucgucgacgaaccuuucuccgagauuccgcgccagggcuuucucggggagaucagauguaauagcgaaucuagcgugcuguccgcccaugagucuugccuucgggcccccaaccugauuagcuacaaaccuaugaucgaucagcucgaauguaccacaaaucugaucgaccccuucguuguguuugagagaggcucccugccucagacccgcaacgauaagacguucgcugccucuaaaggaaaucggggcguccaagcguuuagcaagggguccgugcaggcugaccuuacacucauguucgacaacuuugaaguugauuucgugggagccgccgucucuugcgacgcugccuuucugaaccugaccggcugcuauagcuguaaugcuggggccagagugugccucuccauuacaagcaccggaaccggcacacugucugcgcacaacaaggauggcucccuucauaucguucugcccagcgagaaugggacgaaagaccagugucaaauucuccacuucaccgugccugaggucgaagaggaauuuauguacucuugcgauggagacgagcgcccccugcuggugaagggcacacuuaucgccauugauccguucgacgauagacgggaggcugggggagaauccaccguggucaacccuaaaagcggcuccuggaauuucuuugacugguucucugggcucaugagcugguuuggaggcccccugaagacaauccugcucaucugucuguacguugcccuuuccauuggccuguucuuucuccugaucuaucuggggcgcaccggacuuagcaaaauguggcuggcugccacgaagaaggccucuuga

SEQ ID NO: 14521 - RNA, 3480 nt, Artificial Sequence
  derived and/or modified CDS sequence (opt5) from RVFV(KEN/Bar-035/07)__HM586969.1__NSm-Gn-Gc
augaucgagggcgccugggacagccugagagaagaggaaaugcccgaggaacucuccugcucugugagcgggauucgggaggucaaaaccuccucucaggagcuguaccgcgcucuuaaagccaucauugcggcugauggacugaacaauaucacaugucacggcaagaacccugaagacaaaauuagccucaucaaggggccgccccauaaaaagagaguuggaaucgugcggugcgagcgcagacgggaugccaagcaaauuggccgcgaaacgauggccgggaucgcuaugaccgugcugccugcccuugcugucuucgcccuggcgcccgugguuuuugccgaggacccucaccucagaaaucggcccggaaaaggccauaacuauauugauggccgccugcaggaggacgcuacauguaagccugugaccuacgccggggcuugcuccucuuucgauguccugcucgaaaaaggaaaguuuccgcuguuccagagcuaugcccaccauagaacacuucuggaggcggugcacgacaccaucauugccaaagcugaucccccuuccugugaccuccagagcgccgauggcaauaagugcaugaaggaaaaacugguuaugaagacacacugucccaacgacuaccaaucugcucauuaucuuaauaacgaugggaaaauggccuccgugaagugcccucccaaauacgagcugaccgaagacuguaauuuuugccggcagaugacgggagccagccucaagaaaggcucuuauccgcugcaggaccuguucugucaguccagcgaggaugacgggucuaagcucaagaccaaaaugaagggagucugcgaggugggcgugcaagcucugaaaaagugcgauggccagcuuuccacagcgcacgaagucguuccuuuugccguguucaaaaacagcaagaagguguaccuggacaaacucgaucugaagaccgaggaaaaucuucugcccgacuccuuugucuguuucgagcauaaagggcaguacaagggaacaauggauucuggccagaccaaacgcgaacucaagagcuuugacaucucccaaugcccuaagauugggggacacggcagcaaaaaguguacgggggaugcugccuucugcucugccuaugaguguacagcucaguacgccaacgcguauugcucccacgcuaauggaagcggcaucgugcagauccaaguuucuggcguguggaaaaagccccugugugucggguacgagagagugguugugaaacgggaacugagcgccaagcccauucagcgcgucgagccuugcaccacauguaucaccaagugcgaaccgcauggacucguggucagauccaccggcuuuaaaauuucuagcgccguggcuugugccuccgggguuugcgugacaggaagccagucucccuccacggagaucacccugaaguauccuggcauuagccagucuuccgggggcgacaucggaguccacauggcucaugaugaccaaagcguguccucuaaaaucguugcccacugcccgccucaggaccccugucuugugcauggcugcauugucugugcgcacgggcugaucaacuaccagugccacacagcccucagcgcuuucguggugauuuucgucuuuuccucuaccgccaucauuugucuggcuguucuuuaucgggugcugaagugccucaaaaucgccccgagaaaggugcugaauccucugauguggaucacagcguucauucgcugggucuacaaaaagaugguggcccggguugcugauaacaucaaccaggugaauagagaaauuggauggauggagggcgggcaacucgcccugggaaaccccgcuccuaucccccgccaugccccuauuccccgguacagcaccuaucuuaugcugcuccugaucgucuccuacgccagcgcuuguucugagcugauucaggcguccagcagaaucacgacaugcucuaccgaaggcgugaauaccaagugucgccuuuccgggacagcccucauccgggcuagaagcguuggcgccgaggccugccugaugcugaaaggagugaaggaagaccagaccaaauuucucaagauuaaaacagucucuagcgagcuguccugucgcgagggccagagcuauuggacggggucuuucuccccgaagugccuuagcucccggagaugccaccuggugggagaaugucauguuaaccgcugccucucuuggcgggauaaugagaccagcgcugaauuuuccuucgugggcgagucuacaaccaugagagaaaacaaguguuuugagcaaugcgggggauggggcugugggugcuucaaugucaacccuagcugucuguuugugcacacauaccugcaguccgugcggaaagaggcccuucgcgucuucaauugcaucgacuggguucacaagcucacccuggaaauuacggauuuugacggcucugugagcaccaucgaucugggagcguccagcucuagauucacaaacuggggcuccgugagccucucucuggacgcugaggggauuuccggaagcaauucuuuuuccuucaucgaaagccccggcaaaggguaugccaucgucgaugagcccuucuccgaaauuccucggcagggauuucuuggcgagaucagauguaacagcgagucuagcgugcuguccgcccaugaaucuugccuccgcgcuccgaaucugguuagcuacaagcccaugauugaccagcuggaguguaccacaaaccuuaucgauccuuucguggucuuugaacgggggucccucccccaaaccagaaaugacaaaacguucgccgcgucuaagggcaaccgcggagugcaggcuuuuagcaagggcuccguucaggccgaucugacacugauguucgacaacuuugagguggacuucgucggggccgcugugucuugcgaugccgcuuuucucaaucugaccggaugcuauagcuguaacgccggcgcgagaguuugccuuuccauuacaagcaccgggaccggaacacugucugcccacaauaaagacggcucccuccauaucgugcugccuagcgaaaacggcacgaaggaucaaugucagauccugcacuucaccguccccgagguggaggaagaguuuauguacucuugcgacggggaugaacggccucuucucgugaaaggaacacugauugcuaucgaccccuucgaugaccgcagagaggccggcggggaguccaccgucguuaaucccaagagcggauccuggaacuuuuucgauugguucucuggccugaugagcugguuugggggaccucucaaaacaauucugcuuaucugucuguacguggcucucuccauuggccuguucuuucugcuuaucuaucugggccggaccgggcucagcaagauguggcuggccgccacgaagaaggcuucuuga

SEQ ID NO: 14522 - RNA, 3480 nt, Artificial Sequence
  derived and/or modified CDS sequence (opt5) from RVFV(KEN/Bar-032/07)__HM586968.1__NSm-Gn-Gc
augaucgagggcgccugggacagccugagagaagaggaaaugcccgaggaacucuccugcucugugagcgggauucgggaggucaaaaccuccucucaggagcuguaccgcgcucuuaaagccaucauugcggcugauggacugaacaauaucacaugucacggcaagaacccugaagacaaaauuagccucaucaaggggccgccccauaaaaagagaguuggaaucgugcggugcgagcgcagacgggaugccaagcaaauuggccgcgaaacgauggccgggaucgcuaugaccgugcugccugcccuugcugucuucgcccuggcgcccgugguuuuugccgaggacccucaccucagaaaucggcccggaaaaggccauaacuauauugauggccgccugcaggaggacgcuacauguaagccugugaccuacgccggggcuugcuccucuuucgauguccugcucgaaaaaggaaaguuuccgcuguuccagagcuaugcccaccauagaacacuucuggaggcggugcacgacaccaucauugccaaagcugaucccccuuccugugaccuccagagcgccgauggcaauaagugcaugaaggaaaaacugguuaugaagacacacugucccaacgacuaccaaucugcucauuaucuuaauaacgaugggaaaauggccuccgugaagugcccucccaaauacgagcugaccgaagacuguaauuuuugccggcagaugacgggagccagccucaagaaaggcucuuauccgcugcaggaccuguucugucaguccagcgaggaugacgggucuaagcucaagaccaaaaugaagggagucugcgaggugggcgugcaagcucugaaaaagugcgauggccagcuuuccacagcgcacgaagucguuccuuuugccguguucaaaaacagcaagaagguguaccuggacaaacucgaucugaagaccgaggaaaaucuucugcccgacuccuuugucuguuucgagcauaaagggcaguacaagggaacaauggauucuggccagaccaaacgcgaacucaagagcuuugacaucucccaaugcccuaagauugggggacacggcagcaaaaaguguacgggggaugcugccuucugcucugccuaugaguguacagcucaguacgccaacgcguauugcucccacgcuaauggaagcggcaucgugcagauccaaguuucuggcguguggaaaaagccccugugugucggguacgagagagugguugugaaacgggaacugagcgccaagcccauucagcgcgucgagccuugcaccacauguaucaccaagugcgaaccgcauggacucguggucagauccaccggcuuuaaaauuucuagcgccguggcuugugccuccgggguuugcgugacaggaagccagucucccuccacggagaucacccugaaguauccuggcauuagccagucuuccgucggggacaucggcgugcacauggcucaugaugaccaaagcguuuccucuaaaaucguggcccacugcccgccucaggaccccugucuuguccauggaugcauugugugugcgcacggccugaucaacuaccagugccacacagcccucagcgcuuucgugguuauuuucgucuuuuccucuaccgccaucauuugucuggcugugcuuuaucgggugcugaagugccucaaaaucgccccgagaaagguccugaauccucugauguggaucacagcguucauucgcuggguguacaaaaagaugguugcccggguggcugauaacaucaaccaggucaauagagaaauuggguggauggagggaggccaacucgcccuggggaaccccgcuccuaucccccgccaugccccuauuccccgguacagcaccuaucuuaugcugcuccugaucguguccuacgccagcgcuuguucugagcugauucaggcguccagcagaaucacgacaugcucuaccgaaggaguuaauaccaagugucgccuuucccacacagcccucauccgggcuggcagcgugggggccgaggccugccugaugcugaaaggcgucaaggaagaccagaccaaauuucucaagauuaaaacagugucuagcgagcuguccuguagagagggacagagcuauuggacgggcucuuucuccccgaagugccuuagcucccgccggugccaucugguuggggaaugucacgugaacagaugccucucuuggcgcgauaaugagaccagcgcugaauuuuccuucgucggagagucuacaaccaugcgggaaaacaaguguuuugagcaaugcggcggguggggauguggcugcuucaaugugaacccuagcugucuguuugugcacacauaccugcaguccgucagaaaagaggcccuucggguuuucaauugcaucgacugggugcauaagcucacccuggaaauuacggauuuugacgggucugugagcaccaucgaucugggcgcguccagcucucgcuucacaaacuggggauccgucagccucucucuggacgcugagggcauuuccgggagcaauucuuuuuccuucaucgaaagccccggaaaaggcuaugccaucguggaugagcccuucuccgaaauuccuagacagggguuucuuggagagauccgguguaacagcgagucuagcguucuguccgcccacgaaucuugccucagagcuccgaaucuggugagcuacaagcccaugauugaccagcuggaguguaccacaaaccuuaucgauccuuucgucguguuugaacgcggcucccucccccaaacccggaaugacaaaacguucgccgcgucuaaggggaacagaggcguucaggcuuuuagcaagggauccgugcaggccgaucugacacugcgcuucgacaacuuugaggucgacuucgugggcgccgcuguuucuugcgaugccgcuuuucucaaucugaccgggugcuauagcuguaacgccggagcgagagugugccuuuccauuacaagcaccggcaccgggacacugucugcccauaauaaagacggaucccuccacaucguccugccuagcgaaaacggcacgaaggaucaaugucagauccugcauuucaccgugcccgagguggaggaagaguuuauguacucuugcgacggcgaugaacggccucuucucgucaaagggacacugauugcuaucgaccccuucgaugaccgcagagaggccggaggcgaguccaccguugugaaucccaagagcggguccuggaacuuuuucgauugguucucuggacugaugagcugguuuggcgggccucucaaaacaauucugcuuaucugucuguacguggcucucuccauuggacuguucuuucugcuuaucuaucugggccggaccggccucagcaagauguggcuggccgccacgaagaaggcuucuuga

SEQ ID NO: 14523 - RNA, 3480 nt, Artificial Sequence
  derived and/or modified CDS sequence (opt5) from RVFV(TAN/Dod-002/07)__HM586971.1__NSm-Gn-Gc
augaucgagggcgccugggacagccugagagaagaggaaaugcccgaggaacucuccugcucugugagcgggauucgggaggucaagaccuccucucaggagcuguaccgcgcucuuaaagccaucauugcggcugauggacugaauaauaucacaugucacggcaagaacccugaagacaaaauuagccucaucaaggggccgccccauaaaaagagaguuggaaucgugcggugcgagcgcagacgggaugccaagcaaauuggccgcgaaacgauggccgggaucgcuaugaccgugcugccugcccuugcugucuucgcccuggcgcccgugguuuuugccgaggacccucaccucagaaaucggcccggaaaaggccauaacuauauugauggcaugacacaggaggacgcuaccuguaagccugugacauacgccggggcuugcuccucuuucgauguccugcuggaaaaaggaaaguuuccccucuuccagagcuaugcccaccaucgcacccugcuugaggcggugcacgacacaaucauugccaaagcugaucccccuuccugugaccugcagagcgcccacggcaaucccugcaugaaggaaaagcucguuaugaaaacccauuguccuaacgauuaccaaucugcucacuaucugaauaacgacgggaagauggccuccgugaaaugcccgccgaaguacgagcuuacggaagauuguaauuuuugcagacagaugaccggagccagccugaaaaagggcucuuauccucuccaggaccuguucugucaguccagcgaggacgaugggucuaaacugaagacaaagaugaaaggagucugcgaggugggcgugcaagcucucaagaaaugcgacggccagcuguccaccgcgcaugaagucguucccuuugccguguucaagaacagcaaaaagguguaccuugauaagcuggaccucaaaacagaggaaaaucugcuuccugauuccuuugucuguuucgagcacaaggggcaguacaaaggaaccauggacucuggccagacgaagcgggaacugaaauccuuugauaucucccaaugccccaagauugggggacacggccgcaagaaauguacaggggacgcugccuucugcagcgccuaugaguguaccgcucaguacgccaacgcguauugcucucaugcuaauggauccggcaucgugcagauccaaguuagcggcguguggaagaaaccccucugugucggguacgagagagugguugugaagcgggaacugucugccaaaccuauucagcgcgucgagccgugcacaaccuguaucaccaagugcgaaccccacggacugguggucagaagcacaggcuuuaagauuuccucugccguggcuugugccagcgggguuugcgugacgggaucccagagcccuucuaccgagaucacacucaaauaucccggcauuucccagagcucugggggcgauaucggaguccauauggcucacgacgaucaauccgugagcuccaagaucguugcccauugcccuccccaggacccgugucuggugcacggcugcauugucugugcgcaggccuggaucauuucucaguggcacaccgcucuuagcgccuucguggugaucuucguuuuuagcucuacagcuauuaucugccuggccguccucuaccgggugcugaaaugucuuaagaucgcgccuagaaaagugcugaacccccucauguggauuaccgccuucauccgcugggucuauaagaaaaugguggcucggguugccgacaauauuaaccaagugaacagagaaaucggguggauggagggaggccagcuggcucuggggaauccugcccccauuccucgccaugcccccaucccgcgguacagcacguaccucaugcugcuucugauugucuccuaugcuagcgcgugcucugagcucauccaggccuccagcagaaucacaaccuguucuaccgaaggagugaacacaaagugccgccuguccggcaccgcucugauucgggccgggagcguuggcgccgaggcuugucuuaugcucaagggagugaaagaagaucagacaaaguuucugaaaaucaagacggucucuagcgagcuguccugcagagagggccaaagcuacuggaccgggucuuucuccccuaaaugucucagcucccgccggugccaccuggugggagaaugccauguuaauagaugucuuucuuggcgcgacaacgagacaagcgccgaauuuuccuucgugggcgagucuaccacaaugcgggaaaauaagugcuuugagcagugugggggauggggcugcggguguuucaacgucaaucccagcugccuguuugugcacaccuaucuccaguccgugagaaaggaggcgcugcgggucuucaacuguauugauuggguucacaaacugacgcuugaaaucaccgacuuugauggcucugugagcacaauugaccucggagcuuccagcucucgcuucaccaauuggggcuccgugagccugucucuggaugccgaggggaucuccggaagcaacucuuuuuccuucaucgaaagccccggcaagggguacgccauugucgacgagccuuucuccgaaaucccgagacagggauuucucggcgagauucggugcaauagcgagucuagcgugcuguccgcucaugaaucuugucuuagagcccccaaccugguuagcuauaaaccuaugaucgaucaacucgagugcacaaccaaucugauugaccccuucguggucuuugaacgcgggucccugccucagacgcggaacgauaagacauucgcggcuucuaaaggcaauagaggagugcaggccuuuagcaagggcuccguucaagccgaccuuacccucauguucgauaacuuugagguggacuucgucggggcugccgugucuugugacgcugccuuucugaaccugacaggaugcuacagcugcaaugcgggcgcccgcguuugucucuccaucaccagcaccgggacaggaacgcugucugcucacaacaaggauggcucccuucauaucgugcugcccagcgaaaauggcaccaaagaccagugccagauucuccacuucacagucccugagguggaggaagaguuuauguauucuugugauggggacgaaagaccccugcuggugaagggaacccuuaucgccauugauccguucgacgaucggcgcgaggcuggcggggaguccacagucguuaacccuaaaagcggauccuggaacuuuuucgacugguucucuggccucaugagcugguuugggggaccccugaagaccauccugcucauuugccuguacguggcccuuuccaucggccuguucuuucuccugaucuaccugggcagaacggggcuuagcaaaauguggcuggccgcuacaaagaaggcgucuuga

SEQ ID NO: 14524 - RNA, 3480 nt, Artificial Sequence
  derived and/or modified CDS sequence (opt5) from RVFV(Smithburn)__DQ380193.1__NSm-Gn-Gc
augaucgagggcgccugggacagccugagagaagaggaaaugcccgaggaacucuccugcucuauuagcgggauccgggaggugaagaccuccucucaggagcuguaccgcgcucuuaaagccacaauugcggcugauggacugaacaauaucacgugucacggcaaggacccugaagauaaaauuagccucaucaaggggccgccccauaaaaagagagucggaguugugcggugcgagcgccaaagagacgccaagcagaucggccgggggaccauggccggaauugcuaugacaguguucccugcccuggucguguuugcucuugcccccguuguguucgcggaagauccucaccuucgcaacagacccggcaaaggccauaauuauaucgacgggaugacccaggaggaugccacauguaagccugucaccuacgcuggagccugcuccucuuuugacgugcuccuggagaaaggcaaguucccgcuguuucagagcuaugcucaccaucggacacuccuggaagccguucacgauauuaucauugcgaaagccgaucccccuuccuguaaccuucaaagcgcucacgggaaucccugcaugaaggagaagcuggugaugaaaaccuacuguccuaacgacuaucagucugcccauuaccucaauaacgacggaaagauggcuuccgucaaaugucccccgaagcacgaacugacggaggauugcaauuucugccgccagaugaccggcgccagccuuaaagaagggucuuauccucugcaggaccucuuuugucaauccagcgaggacgauggaucuaagcugaaaacaaagaugaagggcgugugcgaggugggcguccagguucugaaaaagugcgacgggcagcucuccaccgcccaugaaguggugcccuucgcugucuuuaaaaacagcaagaaaguguaccuggauaagcuggaccugaagacagaggaaaaucuccugccugauuccuucguuuguuuugagcacaaaggacaguacaagggcaccauggacucugggcaaaucaaaagagaacuuaagagcuucgauauuucccagugccccaaaaucggaggccacgggagcaagaaguguacgggagacgcggccuuuugcucugcuuaugaguguacagcccaguacgccaacgcuuauugcucccaugccaauggcagcggcaucgugcaaauucaggucucugggguguggaaaaagccccuguguguuggauacgagcggguggucgugaaacgcgaacucagcgcgaagccuauccagagagucgagccgugcaccacauguauuaccaaaugcgaaccccacggccuggugguucgguccaccggguucaagaucucuagcgcuguggccugugccuccggagucugcgugacaggcagccagucuccuuccacggagauuacccugaaguaucccgggaucagccaaucuuccggcggagauaucggcguucauauggcucacgacgaucagagcguguccucuaaaauugucgcccauugcccuccccaggacccgugucucgugcacgggugcaucgugugugcucacggacugauuaacuaccagugccauacagccuucagcgcguuuguugucguguucguguuuuccucugucgugaucauuugucuugccauccuguauaagguucucaaaugccugaagaucgcuccucgcaaagugcuuaauccccugauguggauuaccgccuucaucagaugggucuacaagaaaaugguggcucggguugccgacaacauuaaccaagugaauagagaaaucggcuggauggaagggggacagcucguccugggcaacccugcgcccauuccucgccacgcccccaucccgcgguacagcacauaucugaugcuccugcuuauuguguccuacgcuagcgccuguucugagcugauccaggcuuccagcagaaucaccacgugcucuacagaggggguuaauaccaagugucgccucuccggcaccgcccugauucgggccggaagcgugggcgcugaggcgugccugaugcuuaagggggucaaagaagaucagacaaaguuucucaaaaucaagaccgugucuagcgagcuguccuguagagagggacaaagcuauuggacaggcucuuucuccccuaaaugccugagcucccgccggugccaucucgugggggaaugucacgucaacagaugccugucuuggcgcgacaaugagacgagcgccgaauuuuccuucguuggagagucuaccacaaugcgggaaaacaaguguuuugagcagugcggcggguggggcuguggaugcuucaaugugaaccccagcugucuuuuugugcacaccuaccugcaguccgucagaaaggaggcucuccgcguguucaauugcauugauuggguucauaaacugacacuggaaaucaccgacuuugauggcucugugagcacggucgaccuuggggccuccagcucucgguucaccaacuggggauccgugagccucucucuggaugccgagggcauuuccgggagcaauucuuucuccuuuaucgaaagccccggaaagggcuaugcuaucguugacgagccuuucuccgaaauuccgagacagggguuucugggcgagauccgguguaacagcgagucuagcgugcucuccgcccacgaaucuugccugcgcgcgcccaaucuuauuagcuacaaaccuaugaucgaucaacuggaguguacaaccaaccucauugaccccuucgucguguuugaaagaggaucccugccucagacacggaaugauaagaccuucgcugccucuaaaggcaacagagggguucaggccuuuagcaagggauccgugcaagcugaccugacgcuuauguucgauaacuuugaggucgacuucgugggcgccgcggugucuugcgacgcugccuuucucaaucugacagggugcuauagcuguaacgccggagcucgcgucugccuguccaucaccagcacaggcaccggcacccucucugcccauaauaaggaugggucccugcacaucguucuucccagcgaaaacggaacaaaagaccagugucagauucugcauuucacggugccugagguggaggaagaguuuauguacucuugcgauggcgacgaacggccccuccuggucaaggggacccugaucgcuauugauccguucgacgauagacgcgaggccggaggcgaguccacagugguuaauccuaaaagcggguccuggaacuucuuugacugguucucuggacuuaugagcugguuuggcggcccccucaagaccauccugcugauuugucucuacguggcgcuguccaucgggcuuuucuuuuuccugaucuaucucggaagaacaggccugagcaaaauguggcuggccgcuaccaagaaggccucuuga

SEQ ID NO: 14525 - RNA, 3480 nt, Artificial Sequence
  derived and/or modified CDS sequence (opt5) from RVFV(KEN/Gar-004/06)__HM586964.1__NSm-Gn-Gc
augaucgagggcgccugggacagccugagagaagaggaaaugcccgaggaacucuccugcucugugagcgggauucgggaggucaagaccuccucucaggagcuguaccgcgcucuuaaagccaucauugcggcugauggacugaauaauaucacaugucacggcaagaacccugaagacaaaauuagccucaucaaggggccgccccauaaaaagagaguuggaaucgugcggugcgagcgcagacgggaugccaagcaaauuggccgcgaaacgauggccgggaucgcuaugaccgugcugccugcccuugcugucuucgcccuggcgcccgugguuuuugccgaggacccucaccucagaaaucggcccggaaaaggccauaacuauauugauggcaugacacaggaggacgcuaccuguaagccugugacauacgccggggcuugcuccucuuucgauguccugcuggaaaaaggaaaguuuccccucuuccagagcuaugcccaccaucgcacccugcuugaggcggugcacgacacaaucauugccaaagcugaucccccuuccugugaccugcagagcgcccacggcaaucccugcaugaaggaaaagcucguuaugaaaacccauuguccuaacgauuaccaaucugcucacuaucugaauaacgacgggaagauggccuccgugaaaugcccgccgaaguacgagcuuacggaagauuguaauuuuugcagacagaugaccggagccagccugaaaaagggcucuuauccucuccaggaccuguucugucaguccagcgaggacgaugggucuaaacugaagacaaagaugaaaggagucugcgaggugggcgugcaagcucucaagaaaugcgacggccagcuguccaccgcgcaugaagucguucccuuugccguguucaagaacagccagaaaguguaccuugauaagcuggaccucaagacagaggaaaaucugcuuccugauuccuuugucuguuucgagcacaaagggcaguacaagggaaccauggacucuggccaaacgaaacgggaacuuaagagcuuugauaucucccagugccccaaaauugggggacacggccgcaagaagagaacaggggacgcugccuucuguagcgccuaugagugcaccgcucaguacgccaacgcguauuguucucgggcuaauggauccggcaucgugcaaauccagguuagccgcguguggaaaaagccccucugcgucggcuacgagagagugguugugaaacgggaacugucugccaagccuauucagagagucgagccguguacaaccugcaucaccaaaugugaaccccaugggcuggugguccgcagcacaggauuuaagauuuccucugccguggcuugcgccagcggcguuugugugacggggucccagagcccuucuaccgagaucacacucaaguaucccggaauuucccaaagcucuggcggggauaucggcguccacauggcucaugacgaucaguccgugagcuccaaaaucguugcccacugcccuccccaggacccgugccuggugcauggauguauugucugcgcgcacggccuuaucaacaaucagucucacagcgcccuguccgcuuucguggugauuuucguuuuuagcagcaccgccaucauuugucucgcuguccuguaccgggugcuuaagugccugaaaaucgccccuagaaaggugcucaacccccugauguggaucacagcguucauucgcugggucuauaaaaagaugguggcccggguugcugacaacaucaaucaagugaacagagaaauuggguggauggagggaggccagcuggcccucgggaauccugcucccaucccucgccaugcccccauuccgcgguacuccaccuaccugaugcuucugcucaucgucagcuaugccucugcuuguuccgagcugauucaggcgagcucuagaaucacgacaugcuccaccgaaggagugaacaccaaaugucgccugagcggcacagcccuuauccgggcugggucuguuggcgccgaggccugccucaugcugaagggagugaaggaagaucagaccaaauuucugaagauuaaaacagucagcuccgagcucagcuguagagagggccaaucuuacuggacgggguccuucagcccuaagugccuguccucucgccggugucaccuugugggagaaugccauguuaauagaugccugagcuggcgggacaacgagaccuccgcugaauuuucuuucgugggcgagagcacaaccaugcgcgaaaauaaauguuuugagcagugcgggggauggggcugugggugcuucaacgucaaucccuccugucucuuugugcacacauaucugcagucugugagaaaggaggcccugcgggucuucaacugcaucgauuggguucacaagcugacccucgaaauuacggacuuugauggcagcguguccaccaucgaccugggagcgucuucuuccagauucacaaauuggggcagcgugucucugucccucgaugcugaggggauuagcggaucuaacuccuuuagcuucaucgaaucccccggcaaaggguacgccaucgucgacgagccuuucagcgaaauuccgcgccagggauuucugggcgagauccgguguaauucugagagcuccgugcuuucugcccaugaaagcugccugagagcucccaaccucguuuccuauaagccuaugauugaucaacuggaguguaccacaaaucugaucgaccccuucguggucuuugaacgcgggucucuuccucagaccagaaacgauaaaacguucgccgcgagcaagggcaaccggggagugcaggcuuuuuccaaaggcucuguucaagccgaccucacacugcgcuucgauaauuuugagguggacuucgucggggccgcugugagcugcgacgccgcuuuucugaaccucaccggauguuacuccugcaaugccggcgcgagaguuugccugagcauuacaucuaccgggaccggaacacuuuccgcccacaacaaggauggcagccugcauaucgugcuccccucugaaaauggcacgaaggaccagugucagauccugcacuucaccgucccugagguggaggaagaguuuauguauuccugcgauggggacgaacggccccugcuugugaaaggaacacucauugcuaucgauccguucgacgaucgcagagaggccggcggggagagcaccgucguuaacccuaaguccggaucuuggaacuuuuucgacugguucagcggccugauguccugguuugggggaccccugaaaacaauucuccugaucugucuuuacguggcucugagcauuggccucuucuuucugcugaucuaccuuggccggaccgggcugucuaagauguggcucgccgccacgaaaaaggcuuccuga

SEQ ID NO: 14526 - RNA, 3204 nt, Artificial Sequence
  derived and/or modified CDS sequence (opt5) from RVFV(ZH-548)__DQ380206.1__Gn-Gc
auggccggcaucgcuaugaccgugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccuguccgcccauggcaacccuuguaugaaagagaagcugguuaugaagacacacugcccgaaugauuaucagucugcucacuaccucaacaaugacgggaaaauggccagcgugaagugucccccuaaauaugaacugaccgaggauugcaacuuuuguagacagaugacaggagcgucccuuaagaaaggcucuuacccccugcaggaccucuucugccaaagcuccgaggaugacggcagcaagcugaagaccaaaaugaagggggucugugaagugggaguucaggcccuuaaaaagugcgauggccagcugucuacggcucaugagguggucccuuuugccguguucaaaaauuccaagaaaguguaucucgacaagcuggaccugaagaccgaagagaaccuccugcccgauagcuuugucuguuucgagcacaaagggcaguacaagggaacaauggacucuggccaaaccaaacgggaacuuaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucagauccaagugucuggcguguggaaaaagccucugugcgucggguaugaacgcgugguugugaaaagagagcucagcgccaagcccauucagcgggucgaaccuuguacgacaugcaucaccaaaugugagccccacggacuggugguucgcuccacaggcuuuaagauuagcucugccguggcuugcgccuccggggucugugugaccggaagccagucucccagcaccgagaucacacuuaaguacccuggcauuucccaaucuagcggcggggauaucggaguccauauggcgcacgacgaucaguccgugagcucuaaaauuguugcucauugcccgccccaggacccuugucuggugcacgauugcaucgucugcgcccauggccucaucaauuaucagugucacacggcccuguccgcuuucgugguuguguucgucuuuagcucuauugccaucauuugccuggcuauccucuacagagugcugaagugucuuaaaauugcgccccggaaggugcugaacccucucauguggaucaccgccuucauccgcuggauuuauaaaaagaugguugccagagucgcugacaauaucaaccaagugaaucgggaaauuggguggauggagggaggccagcuggugcuugggaaccccgccccgaucccucgccacgcucccauuccuagauacuccacauaccugaugcuccugcugaucgucagcuaugccuccgcgugcucugaacucauccaggccagcucccggauuaccacauguucuaccgagggcgugaacacgaagugccgccugagcggaacagcucuuaucagagccggcuccguuggggcugaagccugucugaugcucaaaggagugaaggaggaucagaccaaauuucugaagauuaaaaccgucagcucugagcuguccugccgggaaggccaaagcuacuggacagggucuuucucccccaagugucuuagcucuagacgcugccaucucgugggagagugucacguuaaucggugccugagcuggagagacaacgaaaccuccgccgaguuuagcuucgugggcgaaucuacaacgaugcgcgagaauaaaugcuuugagcagugugggggcuggggaugcggcuguuucaacgucaauccuuccugccuguuugugcauaccuaucuccagagcguucggaaggaagcucugagaguguucaacuguaucgacuggguccacaaacuuacacuggagauuaccgauuuugacggguccgugucuacaaucgaucucggagcgagcuccucucgcuucaccaauuggggcagcgugucccugucucuggacgccgaagggauuagcggauccaacagcuuuucuuucaucgagucccccggcaaaggguacgcuaucgucgaugagccguucagcgaaauuccucggcagggcuuucuuggagagaucagaugcaauucugaauccagcguucucucugcccacgaguccugucugcgcgcccccaaccugauuagcuauaagcccaugaucgaccaacucgaaugcacgaccaaucugauugauccuuucgugguguuugagcggggcucccuuccgcagacaagaaacgacaaaaccuucgcugccagcaaggggaaucgcggaguccaggcguuuucuaaaggcagcgugcaggcugaucugacacucauguucgacaacuuugagguugauuucgugggggccgccgucuccugugacgcugccuuucugaaucugaccggaugcuacucuuguaacgcgggcgcucgggugugccuuagcaucacguccacagggaccggcucucucagcgcccauaacaaggauggaucccugcacaucguucugcccucugaaaauggcacaaaggaccaaugccagauucuccauuucaccgugccugaggucgaagaggaauuuauguauagcugugacggggaugagagaccccugcuugugaaaggaacccugaucgccauugacccuuucgaugaccggcgcgaggcuggcggggaauccacaguugugaaccccaagagcggaucuuggaacuuuuucgauugguucuccggccucaugagcugguuuggcgggccucugaaaacgauccugcuuauuugccucuacgucgcccugucuaucggacuguucuuucuccugaucuaccuuggcagaaccgggcuguccaagauguggcucgcugccacaaagaaggcgagcuga

SEQ ID NO: 14527 - RNA, 3204 nt, Artificial Sequence
  derived and/or modified CDS sequence (opt5) from RVFV(2007000094)__EU574055.1__Gn-Gc
auggccggcaucgcuaugaccgugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucaaauccaggugucuggcguguggaaaaagccucuuugcgucggguaugaacgcgugguugugaaaagagagcugagcgccaagcccauucagcgggucgaaccuuguacgacaugcaucaccaaaugugagccccacggacucgugguucgcuccacaggcuuuaagauuagcucugccguggcuugcgccuccggggucugugugaccggaagccaaucucccagcaccgagaucacacugaaguacccuggcauuucccagucuagcggcggggauaucggaguccauauggcgcacgacgaucaguccgugagcucuaaaauuguugcucauugcccgccccaggacccuugucuugugcacggcugcaucgucugcgcccaugggcugaucaauuaucaaugucacacggcccucuccgcuuucgugguuguguucgucuuuagcucuauugccaucauuugccuggcuauccuguacagagugcucaagugucugaaaauugcgccccggaaggugcuuaacccucugauguggaucaccgccuucauccgcuggguuuauaaaaagauggucgccagaguggcugauaauauuaaccaggugaaucgggaaaucggauggauggagggcgggcagcucguccugggcaaccccgccccgauuccucgccacgcucccaucccuagauacuccacauaccuuaugcugcuccugauugugagcuaugccuccgcgugcucugaacugauccaggccagcucccggaucaccacauguucuaccgagggaguuaacacgaagugccgccucagcggcacagcucugauuagagccggguccgugggagcugaagccugucuuaugcugaaaggcgucaaggaggaccaaaccaaauuucucaagaucaaaaccgugagcucugagcuguccugccgggaagggcagagcuacuggacaggaucuuucucccccaagugucugagcucuagacgcugccaucuuguuggcgagugucacgugaaucggugccucagcuggagagauaacgaaaccuccgccgaguuuagcuucgucggggaaucuacaacgaugcgcgagaauaaaugcuuugagcaguguggcggauggggcugcggguguuucaacgugaauccuuccugccuguuuguucauaccuaucugcagagcgugcggaaggaagcucucagagucuucaacuguauugacugggugcacaagcugacacuugagaucaccgacuuugauggauccgugucuacaauugaccugggcgcgagcuccucucgcuucaccaauugggggagcgucucccucucucuggaugccgaaggaaucagcggcuccaacagcuuuucuuucauugagucccccgggaaaggcuacgcuaucguugacgagccguucagcgaaaucccucggcaaggauuucugggcgagauuagaugcaauucugaauccagcgugcuuucugcccacgaguccugucuccgcgcccccaaccugaucagcuauaagcccaugauugaucagcuggaaugcacgaccaaucucaucgacccuuucguggucuuugagcgggggucccugccgcagacaagaaacgauaaaaccuucgcugccagcaagggaaaucgcggcgugcaggcguuuucuaaagggagcguucaagcugaccuuacacugauguucgauaacuuugagguggacuucgucggagccgccguguccugugaugcugccuuucucaaucugaccggcugcuacucuuguaacgcgggggcucggguuugccugagcauuacguccacaggcaccggaacacuuucugcccauaacaaggacggcagccuccacaucgugcugcccuccgaaaaugggaccaaggaucagugccagauccugcauuucaccgucccugagguggaagaggaauuuauguauucuugugacggagacgagagaccccuccugguuaaaggcacacuuauugccaucgauccuuucgacgaucggcgcgaggcugggggagaaagcacgguggucaaccccaaguccggcagcuggaacuuuuucgacugguucucuggccugauguccugguuugggggaccucucaaaaccauucugcugaucugccuuuacguggcccucagcauuggccuguucuuucugcucaucuaccuggggagaacaggacuuucuaagauguggcuggcugccaccaaaaaggcguccuga

SEQ ID NO: 14528 - RNA, 3204 nt, Artificial Sequence
  derived and/or modified CDS sequence (opt5) from RVFV(ZH-548M12)__M25276.1__Gn-Gc
auggccggcaucgcuaugacagugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccuguccgcccauggcaacccuuguaugaaagagaagcugguuaugaagacacacugcccgaaugauuaucagucugcucaccaucucaacaaugacgggaaaauggccagcgugaagugucccccuaaauacgaacugaccgaggauugcaacuuuuguagacagaugacaggagcgucccuuaagaaaggcucuuauccccugcaggaccucuucugccaaagcuccgaggaugacggcagcaagcugaagaccaaaaugaagggggucugugaagugggaguucaggcccuuaaaaagugcgauggccagcugucuacggcucacgagguggucccuuuugccguguucaaaaauuccaagaaaguguaccucgacaagcuggaccugaagaccgaagagaaccuccugcccgauagcuuugucuguuucgagcauaaagggcaguauaagggaacaauggacucuggccaaaccaaacgggaacuuaaguccuuugauaucagccagugcccgaaaauugggggacacggcucuaagaagugcacaggcgacgcugccuucuguuccgccuacgagugcaccgcucaguacgcgaaugccuauuguagccacgcuaacggguccggaaucguucagauccaagugucuggcguguggaaaaagccucugugcgucggguacgaacgcgugguugugaaaagagagcucagcgccaagcccauucagcgggucgaaccuuguacgacaugcaucaccaaaugugagccccauggacuggugguucgcuccacaggcuuuaagauuagcucugccguggcuugcgccuccggggucugugugaccggaagccagucucccagcaccgagaucacacuuaaguauccuggcauuucccaaucuagcggcggggauaucggaguccacauggcgcaugacgaucaguccgugagcucuaaaauuguugcucacugcccgccccaggacccuugucuggugcaugauugcaucgucugcgcccacggccucaucaauuaccagugucacacggcccuguccgcuuucgugguuguguucgucuuuagcucuauugccaucauuugccuggcuauccucuauagagugcugaagugucuuaaaauugcgccccggaaggugcugaacccucucauguggaucaccgccuucauccgcuggauuuacaaaaagaugguugccagagucgcugacaauaucaaccaagugaaucgggaaauuggguggauggagggaggccagcuggugcuugggaaccccgccccgaucccucgccaugcucccauuccuagauauuccacauaccugaugcuccugcugaucgucagcuacgccuccgcgugcucugaacucauccaggccagcucccggauuaccacauguucuaccgagggcgugaacacgaagugccgccugagcggaacagcucuuaucagagccggcuccguuggggcugaagccugucugaugcucaaaggagugaaggaggaucagaccaaauuucugaagcugaaaaccgucagcucugagcuuuccugccgggaaggccaaagcuauuggacagggucuuucucccccaagugucucagcucuagacgcugccaccuggugggagagugucauguuaaucggugccugagcuggagagacaacgaaaccuccgccgaguuuagcuucgugggcgaaucuacaacgaugcgcgagaauaaaugcuuugagcagugugggggcuggggaugcggcuguuucaacgucaauccuuccugccucuuugugcacaccuaccugcagagcguucggaaggaagcucuuagaguguucaacuguauugacuggguccacaagcugacacucgagaucaccgauuuugacggguccgugucuacaauugaucugggagcgagcuccucucgcuucaccaauuggggcagcgugucccugucucuugacgccgaagggaucagcggauccaacagcuuuucuuucauugagucccccggcaaaggguaugcuaucgucgaugagccguucagcgaaaucccucggcagggcuuucucggagagauuagaugcaauucugaauccagcguucugucugcccaugaguccugucugcgcgcccccaaccucaucagcuacaagcccaugauugaccaacuggaaugcacgaccaaucuuaucgauccuuucgugguguuugagcggggcucccugccgcagacaagaaacgacaaaaccuucgcugccagcaaggggaaucgcggaguccaggcguuuucuaaaggcagcgugcaggcugaucucacacugauguucgacaacuuugagguugauuucgugggggccgccgucuccugugacgcugccuuucugaaucuuaccggaugcuauucuuguaacgcgggcgcucgggugugccucagcauuacguccacagggaccggcucucugagcgcccacaacaaggauggaucccugcauaucguucuccccucugaaaauggcacaaaggaccaaugccagauccugcacuucaccgugccugaggucgaagaggaauuuauguacagcugugacggggaugagagaccccuucuggugaaaggaacccucauugccaucgacccuuucgaugaccggcgcgaggcuggcggggaauccacaguugugaaccccaagagcggaucuuggaacuuuuucgauugguucuccggccugaugagcugguuuggcgggccucugaaaacgauucuucucaucugccuguaugucgcccugucuauuggacucuucuuucugcuuaucuaccugggcgggaccggacucuccaagauguggcuggcugccaccaaaaaggcgagcuga

SEQ ID NO: 14529 - RNA, 3204 nt, Artificial Sequence
  derived and/or modified CDS sequence (opt5) from RVFV(Sudan 86-2010)__JQ820489.1__Gn-Gc
auggccggcaucgcuaugaccgugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucaaauccaggugucuggcguguggaaaaagccucuuugcgucggguaugaacgcgugguugugaaaagagagcugagcgccaagcccauucagcgggucgaaccuuguacgacaugcaucaccaaaugugagccccacggacucgugguucgcuccacaggcuuuaagauuagcucugccguggcuugcgccuccggggucugugugaccggaagccaaucucccagcaccgagaucacacugaaguacccuggcauuucccagucuagcggcggggauaucggaguccauauggcgcacgacgaucaguccgugagcucuaaaauuguugcucauugcccgccccaggacccuugucuugugcacggcugcaucgucugcgcccaugggcugaucaauuaucaaugucacacggcccucuccgcuuucgugguuguguucgucuuuagcucuauugccaucauuugccuggcuauccuguacagagugcucaagugucugaaaauugcgccccggaaggugcuuaacccucugauguggaucaccgccuucauccgcuggguuuauaaaaagauggucgccagaguggcugauaauauuaaccaggugaaucgggaaaucggauggauggagggcgggcagcucguccugggcaaccccgccccgauuccucgccacgcucccaucccuagauacuccacauaccuuaugcugcuccugauugugagcuaugccuccgcgugcucugaacugauccaggccagcucccggaucaccacauguucuaccgagggaguuaacacgaagugccgccucagcggcacagcucugauuagagccggguccgugggagcugaagccugucuuaugcugaaaggcgucaaggaggaccaaaccaaauuucucaagaucaaaaccgugagcucugagcuguccugccgggaagggcagagcuacuggacaggaucuuucucccccaagugucugagcucuagacgcugccaucuuguuggcgagugucacgugaaucggugccucagcuggagagauaacgaaaccuccgccgaguuuagcuucgucggggaaucuacaacgaugcgcgagaauaaaugcuuugagcaguguggcggauggggcugcggguguuucaacgugaauccuuccugccuguuuguucauaccuaucugcagagcgugcggaaggaagcucucagagucuucaacuguauugacugggugcacaagcugacacuugagaucaccgacuuugauggauccgugucuacaauugaccugggcgcgagcuccucucgcuucaccaauugggggagcgucucccucucucuggaugccgaaggaaucagcggcuccaacagcuuuucuuucauugagucccccgggaaaggcuacgcuaucguugacgagccguucagcgaaaucccucggcaaggauuucugggcgagauuagaugcaauucugaauccagcgugcuuucugcccacgaguccugucuccgcgcccccaaccugaucagcuauaagcccaugauugaucagcuggaaugcacgaccaaucucaucgacccuuucgugauuuuugagcgggggucccugccgcagacaagaaacgauaaaaccuucgcugccagcaagggaaaucgcggcguccaggcguuuucuaaagggagcgugcaagcugaccuuacacugauguucgauaacuuugagguugacuucgugggagccgccgucuccugugaugcugccuuucucaaucugaccggcugcuacucuuguaacgcgggggcucgggugugccugagcaucacguccacaggcaccggaacacuuucugcccauaacaaggacggcagccuccacaucguucugcccuccgaaaaugggaccaaggaucagugccagauucugcauuucaccgugccugaggucgaagaggaauuuauguauucuugugacggagacgagagaccccuccuggugaaaggcacacuuaucgccauugauccuuucgacgaucggcgcgaggcugggggagaaagcacgguugugaaccccaaguccggcagcuggaacuuuuucgacugguucucuggccugauguccugguuugggggaccucucaaaaccauccugcugauuugccuuuacgucgcccucagcaucggccuguucuuucugcucaucuaccuggggagaacaggacuuucuaagauguggcuggcugccaccaaaaaggcguccuga

SEQ ID NO: 14530 - RNA, 3204 nt, Artificial Sequence
  derived and/or modified CDS sequence (opt5) from RVFV(ZS-6365)__DQ380205.1__Gn-Gc
auggccggcaucgcuaugacagugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucaaauccaggugucuggcguguggaaaaagccucuuugcgucggguaugaacgcgugguugugaaaagagagcugagcgccaagcccauucagcgggucgaaccuuguacgacaugcaucaccaaaugugagccccacggacucgugguucgcuccacaggcuuuaagauuagcucugccguggcuugcgccuccggggucugugugaccggaagccaaucucccagcaccgagaucacacugaaguacccuggcauuucccagucuagcggcggggauaucggaguccauauggcgcacgacgaucaguccgugagcucuaaaauuguugcucauugcccgccccaggacccuugucuugugcacggcugcaucgucugcgcccaugggcugaucaauuaucaaugucacacggcccucuccgcuuucgugguuguguucgucuuuagcucuauugccaucauuugccuggcuauccuguacagagugcucaagugucugaaaauugcgccccggaaggugcuuaacccucugauguggaucaccgccuucauccgcuggauuuauaaaaagaugguugccagagucgcugauaauaucaaccaggugaaucgggaaauuggauggauggagggcgggcagcucgugcugggcaaccccgccccgaucccucgccacgcucccauuccuagauacuccacauaccuuaugcugcuccugaucgucagcuaugccuccgcgugcucugaacugauccaggccagcucccggauuaccacauguucuaccgagggagugaacacgaagugccgccucagcggcacagcucugaucagagccggguccguuggagcugaagccugucuuaugcugaaaggcgugaaggaggaccaaaccaaauuucucaagauuaaaaccgucagcucugagcuguccugccgggaagggcagagcuacuggacaggaucuuucucccccaagugucugagcucuagacgcugccaucuugugggcgagugucacguuaaucggugccucagcuggagagauaacgaaaccuccgccgaguuuagcuucgugggggaaucuacaacgaugcgcgagaauaaaugcuuugagcaguguggcggauggggcugcggguguuucaacgucaauccuuccugccuguuugugcauaccuaucugcagagcguucggaaggaagcucucagaguguucaacuguaucgacuggguccacaagcugacacuugagauuaccgacuuugauggauccgugucuacaaucgaccugggcgcgagcuccucucgcuucaccaauugggggagcgugucccucucucuggaugccgaaggaauuagcggcuccaacagcuuuucuuucaucgagucccccgggaaaggcuacgcuaucgucgacgagccguucagcgaaauuccucggcaaggauuucugggcgagaucagaugcaauucugaauccagcguucuuucugcccacgaguccugucuccgcgcccccaaccugauuagcuauaagcccaugaucgaucagcuggaaugcacgaccaaucucauugacccuuucgugguguuugagcgggggucccugccgcagacaagaaacgauaaaaccuucgcugccagcaagggaaaucgcggcguccaggcguuuucuaaagggagcgugcaagcugaccuuacacugauguucgauaacuuugagguugacuucgugggagccgccgucuccugugaugcugccuuucucaaucugaccggcugcuacucuuguaacgcgggggcucgggugugccugagcaucacguccacaggcaccggaucucuuagcgcccauaacaaggacggcucccuccacaucguucugcccucugaaaaugggacaaaggaucagugccagauucugcauuucaccgugccugaggucgaagaggaauuuauguauagcugugacggagacgagagaccccuccuggugaaaggcacccuuaucgccauugauccuuucgacgaucggcgcgaggcugggggagaauccacaguugugaaccccaagagcggcucuuggaacuuuuucgacugguucuccggccugaugagcugguuugggggaccucucaaaacgauccugcugauuugccuuuacgucgcccucucuaucggccuguucuuucugcucaucuaccuggggagaaccggacuuuccaagauguggcuggcugccaccaaaaaggcgagcuga

SEQ ID NO: 14531 - RNA, 3204 nt, Artificial Sequence
  derived and/or modified CDS sequence (opt5) from RVFV(1853/78)__DQ380220.1__Gn-Gc
auggccggcaucgcuaugaccgugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaguugugcaaauccaggugucuggcgucuggaaaaagccucuuugcgugggguaugaacgcguuguggucaaaagagagcugagcgccaagcccauccagcggguggaaccuuguacgacaugcauuaccaaaugugagccccacggacucguugugcgcuccacaggcuuuaagaucagcucugccgucgcuugcgccuccggggugugugucaccggaagccaaucucccagcaccgagauuacacugaaguacccuggcaucucccagucuagcggcggggauauuggagugcauauggcgcacgacgaucaguccguuagcucuaaaaucguggcucauugcccgccccaggacccuugucuuguccacggcugcauugugugcgcccaugggcugaucaauuaucaaugucacacggcccucuccgcuuucguuguggucuucguguuuagcucuaucgccauuaucugccuggcuauucuguacagagugcucaagugucugaaaaucgcgccccggaagguucuuaacccucugauguggauuaccgccuucauccgcugggucuauaaaaagaugguggccagaguggcugauaauaucaaccaggucaaucgggaaauuggauggauggagggcgggcagcucgugcugggcaaccccgccccgaucccucgccacgcucccauuccuagauacuccacauaccuuaugcugcuccugaucguuagcuaugccuccgcgugcucugaacugauucaggccagcucccggaucaccacauguucuaccgagggagugaacacgaagugccgccucagcggcacagcucugaucagagccggguccgucggagcugaagccugucuuaugcugaaaggcgugaaggaggaccaaaccaaauuucucaagauuaaaaccguuagcucugagcuguccugccgggaagggcagagcuacuggacaggaucuuucucccccaagugucugagcucuagacgcugccaucuugugggcgagugucacgucaaucggugccucagcuggagagauaacgaaaccuccgccgaguuuagcuucgugggggaaucuacaacgaugcgcgagaauaaaugcuuugagcaguguggcggauggggcugcggguguuucaacguuaauccuuccugccuguuugugcauaccuaucugcagagcguccggaaggaagcucucagaguguucaacuguaucgacugggugcacaagcugacacuugagauuaccgacuuugauggauccgucucuacaaucgaccugggcgcgagcuccucucgcuucaccaauugggggagcguuucccucucucuggaugccgaaggaauuagcggcuccaacagcuuuucuuucaucgagucccccgggaaaggcuacgcuauuguggacgagccguucagcgaaaucccucggcaaggauuucugggcgagaucagaugcaauucugaauccagcgugcuuucugcccacgaguccugucuccgcgcccccaaccugauuagcuauaagcccaugaucgaucagcuggaaugcacgaccaaucucauugacccuuucgucguguuugagcgggggucccugccgcagacaagaaacgauaaaaccuucgcugccagcaagggaaaucgcggcguucaggcguuuucuaaagggagcgugcaagcugaccuuacacugauguucgauaacuuugaggucgacuucgugggagccgccguuuccugugaugcugccuuucucaaucugaccggcugcuacucuuguaacgcgggggcucgggugugccugagcaucacguccacaggcaccggaacacuuucugcccauaacaaggacggcagccuccacauuguccugcccuccgaaaaugggaccaaggaucagugccagauccugcauuucaccgugccugagguugaagaggaauuuauguauucuugugacggagacgagagaccccuccuggugaaaggcacacuuaucgccauugauccuuucgacgaucggcgcgaggcugggggagaaagcacggucgugaaccccaaguccggcagcuggaacuuuuucgacugguucucuggccugauguccugguuugggggaccucucaaaaccauccugcugauuugccuuuacguggcccucagcaucggccuguucuuucugcucauuuaccuggggagaacaggacuuucuaagauguggcuggcugccaccaaaaaggcguccuga

SEQ ID NO: 14532 - RNA, 3204 nt, Artificial Sequence
  derived and/or modified CDS sequence (opt5) from RVFV(T1)__DQ380201.1__Gn-Gc
auggccggcaucgcuaugacagugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucaaauccaggugucuggcguguggaaaaagccucuuugcgucggguaugaacgcgugguugugaaaagagagcugagcgccaagcccauucagcgggucgaaccuuguacgacaugcaucaccaaaugugagccccacggacucgugguucgcuccacaggcuuuaagauuagcucugccguggcuugcgccuccggggucugugugaccggaagccaaucucccagcaccgagaucacacugaaguacccuggcauuucccagucuagcggcggggauaucggaguccauauggcgcacgacgaucaguccgugagcucuaaaauuguugcucauugcccgccccaggacccuugucuugugcacggcugcaucgucugcgcccaugggcugaucaauuaucaaugucacacggcccucuccgcuuucgugguuguguucgucuuuagcucuauugccaucauuugccuggcugugcuguacagagugcucaagugucugaaaaucgcgccccggaagguucuuaacccucugauguggauuaccgccuucauccgcuggaucuauaaaaagauggucgccagaguggcugauaauauuaaccaggugaaucgggaaaucggauggauggagggcgggcagcucguccugggcaaccccgccccgauuccucgccacgcucccaucccuagauacuccacauaccuuaugcugcuccugauugugagcuaugccuccgcgugcucugaacugauccaggccagcucccggaucaccacauguucuaccgagggaguuaacacgaagugccgccucagcggcacagcucugauuagagccggguccgugggagcugaagccugucuuaugcugaaaggcgucaaggaggaccaaaccaaauuucucaagaucaaaaccgugagcucugagcuguccugccgggaagggcagagcuacuggacaggaucuuucucccccaagugucugagcucuagacgcugccaucuuguuggcgagugucacgugaaucggugccucagcuggagagauaacgaaaccuccgccgaguuuagcuucgucggggaaucuacaacgaugcgcgagaauaaaugcuuugagcaguguggcggauggggcugcggguguuucaacgugaauccuuccugccuguuuguucauaccuaucugcagagcgugcggaaggaagcucucagagucuucaacuguauugacugggugcacaagcugacacuugagaucaccgacuuugauggauccgugucuacaauugaccugggcgcgagcuccucucgcuucaccaauugggggagcgucucccucucucuggaugccgaaggaaucagcggcuccaacagcuuuucuuucauugagucccccgggaaaggcuacgcuaucguugacgagccguucagcgaaaucccucggcaaggauuucugggcgagauuagaugcaauucugaauccagcgugcuuucugcccacgaguccugucuccgcgcccccaaccugaucagcuauaagcccaugauugaucagcuggaaugcacgaccaaucucaucgacccuuucguggucuuugagcgggggucccugccgcagacaagaaacgauaaaaccuucgcugccagcaagggaaaucgcggcgugcaggcguuuucuaaagggagcguucaagcugaccuuacacugauguucgauaacuuugagguggacuucgucggagccgccguguccugugaugcugccuuucucaaucugaccggcugcuacucuuguaacgcgggggcucggguuugccugagcauuacguccacaggcaccggaucucuuagcgcccauaacaaggacggcucccuccacaucgugcugcccucugaaaaugggacaaaggaucagugccagauccugcauuucaccgucccugagguggaagaggaauuuauguauagcugugacggagacgagagaccccuccugguuaaaggcacccuuauugccaucgauccuuucgacgaucggcgcgaggcugggggagaauccacaguggucaaccccaagagcggcucuuggaacuuuuucgacugguucuccggccugaugagcugguuugggggaccucucaaaacgauucugcugaucugccuuuacguggcccucucuauuggccuguucuuucugcucaucuaccuggggagaaccggacuuuccaagauguggcuggcugccaccaaaaaggcgagcuga

SEQ ID NO: 14533 - RNA, 3204 nt, Artificial Sequence
  derived and/or modified CDS sequence (opt5) from RVFV(Kenya 83 (21445))__DQ380198.1__Gn-Gc
auggccggcaucgcuaugaccgugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucaaauccaggugucuggcguguggaaaaagccucuuugcgucggguaugaacgcgugguugugaaaagagagcugagcgccaagcccauucagcgggucgaaccuuguacgacaugcaucaccaaaugugagccccacggacucgugguucgcuccacaggcuuuaagauuagcucugccguggcuugcgccuccggggucugugugaccggaagccaaucucccagcaccgagaucacacugaaguacccuggcauuucccagucuagcggcggggauaucggaguccauauggcgcacgacgaucaguccgugagcucuaaaauuguugcucauugcccgccccaggacccuugucuugugcacggcugcaucgucugcgcccaugggcugaucaauuaucaaugucacacggcccucuccgcuuucgugguuguguucgucuuuagcucuauugccaucauuugccuggcuauccuguacagagugcucaagugucugaaaauugcgccccggaaggugcuuaacccucugauguggaucaccgccuucauccgcuggguuuauaaaaagauggucgccagaguggcugauaauauuaaccaggugaaucgggaaaucggauggauggagggcgggcagcucgcccugggcaaccccgcuccgauuccucgccacgcccccaucccuagauacuccacauaccuuaugcugcuccugauugucagcuaugcguccgccugcucugaacugauccaggcuagcucccggaucaccacauguucuaccgagggagugaacacgaagugccgccucagcggcacagcccugauuagagcuggguccguuggagccgaagccugucuuaugcugaaaggcgugaaggaggaccaaaccaaauuucucaagaucaaaaccgucagcucugagcuguccugccgggaagggcagagcuacuggacaggaucuuucucccccaagugucugagcucuagacgcugccaucuugugggcgagugucacguuaaucggugccucagcuggagagauaacgaaaccuccgcugaguuuagcuucgugggggaaucuacaacgaugcgcgagaauaaaugcuuugagcaguguggcggauggggcugcggguguuucaacgucaauccuuccugccuguuugugcauaccuaucugcagagcguucggaaggaagcgcucagaguguucaacuguauugacuggguccacaagcugacacuugagaucaccgacuuugauggauccgugucuacaauugaccugggcgccagcuccucucgcuucaccaauugggggagcgugucccucucucuggaugcugaaggaaucagcggcuccaacagcuuuucuuucauugagucccccgggaaaggcuacgccaucgucgacgagccguucagcgaaaucccucggcaaggauuucugggcgagauuagaugcaauucugaauccagcguucuuucugcccacgaguccugucuccgcgcucccaaccugaucagcuauaagcccaugauugaucagcuggaaugcacgaccaaucucaucgacccuuucgugguguuugagcgggggucccugccgcagacaagaaacgauaaaaccuucgccgcgagcaagggaaaucgcggcguccaggcuuuuucuaaagggagcgugcaagccgaccuuacacugauguucgauaacuuugagguugacuucgugggagccgcugucuccugugaugccgcguuucucaaucugaccggcugcuacucuuguaacgcuggggcccgggugugccugagcauuacguccacaggcaccggaacacuuucugcccauaacaaggacggcagccuccacaucguucugcccuccgaaaaugggaccaaggaucagugccagauccugcauuucaccgugccugaggucgaagaggaauuuauguauucuugugacggagacgagagaccccuccuggugaaaggcacacuuauugcuaucgauccuuucgacgaucggcgcgaggccgggggagaaagcacgguugugaaccccaaguccggcagcuggaacuuuuucgacugguucucuggccugauguccugguuugggggaccucucaaaaccauucugcugaucugccuuuacgucgcucucagcauuggccuguucuuucugcucaucuaccuggggagaacaggacuuucuaagauguggcuggccgcgaccaaaaaggccuccuga

SEQ ID NO: 14534 - RNA, 3204 nt, Artificial Sequence
  derived and/or modified CDS sequence (opt5) from RVFV(Sudan 85-2010)__JQ820488.1__Gn-Gc
auggccggcaucgcuaugaccgugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucaaauccaggugucuggcguguggaaaaagccucuuugcgucggguaugaacgcgugguugugaaaagagagcugagcgccaagcccauucagcgggucgaaccuuguacgacaugcaucaccaaaugugagccccacggacucgugguucgcuccacaggcuuuaagauuagcucugccguggcuugcgccuccggggucugugugaccggaagccaaucucccagcaccgagaucacacugaaguacccuggcauuucccagucuagcggcggggauaucggaguccauauggcgcacgacgaucaguccgugagcucuaaaauuguugcucauugcccgccccaggacccuugucuugugcacggcugcaucgucugcgcccaugggcugaucaauuaucaaugucacacggcccucuccgcuuucgugguuguguucgucuuuagcucuauugccaucauuugccuggcuauccuguacagagugcucaagugucugaaaauugcgccccggaaggugcuuaacccucugauguggaucaccgccuucauccgcuggguuuauaaaaagauggucgccagaguggcugauaauauuaaccaggugaaucgggaaaucggauggauggagggcgggcagcucguccugggcaaccccgccccgauuccucgccacgcucccaucccuagauacuccacauaccuuaugcugcuccugauugugagcuaugccuccgcgugcucugaacugauccaggccagcucccggaucaccacauguucuaccgagggaguuaacacgaagugccgccucagcggcacagcucugauuagagccggguccgugggagcugaagccugucuuaugcugaaaggcgucaaggaggaccaaaccaaauuucucaagaucaaaaccgugagcucugagcuguccugccgggaagggcagagcuacuggacaggaucuuucucccccaagugucugagcucuagacgcugccaucuuguuggcgagugucacgugaaucggugccucagcuggagagauaacgaaaccuccgccgaguuuagcuucgucggggaaucuacaacgaugcgcgagaauaaaugcuuugagcaguguggcggauggggcugcggguguuucaacgugaauccuuccugccuguuuguucauaccuaucugcagagcgugcggaaggaagcucucagagucuucaacuguauugacugggugcacaagcugacacuugagaucaccgacuuugauggauccgugucuacaauugaccugggcgcgagcuccucucgcuucaccaauugggggagcgucucccucucucuggaugccgaaggaaucagcggcuccaacagcuuuucuuucauugagucccccgggaaaggcuacgcuaucguugacgagccguucagcgaaaucccucggcaaggauuucugggcgagauuagaugcaauucugaauccagcgugcuuucugcccacgaguccugucuccgcgcccccaaccugaucagcuauaagcccaugauugaucagcuggaaugcacgaccaaucucaucgacccuuucguggucuuugagcgggggucccugccgcagacaagaaacgagaaaaccuucgcugccagcaagggaaaucgcggcgugcaggcguuuucuaaagggagcguucaagcugaucuuacacugauguucgacaacuuugaaguggauuucgucggagccgccguguccugugacgcugccuuucucaaucugaccggcugcuacucuuguaacgcgggggcucggguuugccugagcauuacguccacaggcaccggaacacuuucugcccauaacaaggauggcagccuccacaucgugcugcccuccgagaaugggaccaaggaccagugccagauccugcauuucaccgucccugaaguggaggaagaguuuauguauucuugugauggagacgagagaccccuccugguuaaaggcacacuuauugccaucgacccuuucgaugaccggcgcgaagcugggggagagagcacgguggucaaccccaaguccggcagcuggaacuuuuucgauugguucucuggccugauguccugguuugggggaccucucaaaaccauucugcugaucugccuuuacguggcccucagcauuggccuguucuuucugcucaucuaccuggggagaacaggacuuucuaagauguggcuggcugccaccaaaaaggcguccuga

SEQ ID NO: 14535 - RNA, 3204 nt, Artificial Sequence
  derived and/or modified CDS sequence (opt5) from RVFV(2007004194)__EU574031.1__Gn-Gc
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugagcaacgacgggaaaauggccuccgugaagugucccccuaaauaugaacucaccgaggauugcaauuuuuguagacagaugacaggagcgucucugaagaaaggcagcuacccccuucaagaccuguucugccaguccagcgaggaugacggcucuaagcucaagaccaaaaugaagggggucugugaagugggaguucaggcccugaaaaagugcgauggccagcuuuccacggcucaugagguggucccuuuugccguguucaaaaacagcaagaaaguguaucuggacaagcucgaccugaagaccgaagagaaucugcuccccgauucuuuugucuguuucgagcacaaagggcaauacaagggaacaauggacuccggccagaccaaacgggaacuuaagagcuuugauaucucucagugcccgaaaauugggggacauggcuccaagaagugcacaggcgacgcugccuucuguagcgccuacgagugcaccgcucaguaugcgaacgccuacuguucccacgcuaaugggucuggaaucguucaaauccaggugagcggcguguggaaaaagccucugugcgucggguaugaacgcgugguugugaaaagagagcuguccgccaagcccauucagcgggucgaaccuuguacgacaugcaucaccaaaugugagccccacggacucgugguucgcagcacaggcuuuaagauuucuuccgccguggcuugcgccagcggggucugugugaccggaucucaaagccccuccaccgagaucacacugaaguacccuggcauuucucagagcuccggcggggauaucggaguccauauggcgcacgacgaucagagcgugucuuccaaaauuguugcucauugcccgccccaggacccuugucuugugcacggcugcaucgucugcgcccaugggcugaucaacuaucaaugucacacggcccucagcgcuuucgugguuguguucgucuuuucuuccauugccaucauuugccuggcuauccuguacagagugcucaagugucugaaaauugcgccccggaaggugcuuaauccucugauguggaucaccgccuucauccgcuggguuuauaaaaagauggucgccagaguggcugauaacauuaaucaggugaaccgggaaaucggauggauggagggcgggcagcucguccugggcaaucccgccccgauuccucgccacgcucccaucccuagauacagcacauaccuuaugcugcuccugauuguguccuaugccucugcgugcagcgaacugauccaggccuccucucggaucaccacauguagcaccgagggaguuaacacgaagugccgccucuccggcacagcucugauuagagccgggagcgugggagcugaagccugucuuaugcugaaaggcgucaaggaggaccaaaccaaauuucucaagaucaaaaccgugucuuccgagcugagcugccgggaagggcagucuuacuggacaggauccuucagccccaagugucugucuagcagacgcugccaucuuguuggcgagugucacgugaaccggugccucuccuggagagauaaugaaaccagcgccgaguuuucuuucgucggggaauccacaacgaugcgcgagaacaaaugcuuugagcaguguggcggauggggcugcggguguuucaaugugaacccuagcugccuguuuguucauaccuaucugcaguccgugcggaaggaagcucucagagucuucaauuguauugacugggugcacaagcugacacuugagaucaccgacuuugauggaucugugagcacaauugaccugggcgcguccucuagccgcuucaccaacuggggguccgucucucucagccuggaugccgaaggaaucuccggcagcaauucuuuuuccuucauugagagccccgggaaaggcuacgcuaucguugacgagccguucucugaaaucccucggcaaggauuucugggcgagauuagaugcaacuccgaaagcucugugcuuuccgcccacgagagcugucuccgcgcccccaaucugaucuccuauaagcccaugauugaucagcuggaaugcacgaccaaccucaucgacccuuucguggucuuugagcgggggagccugccgcagacaagaaaugauaaaaccuucgcugccucuaagggaaaccgcggcgugcaggcguuuagcaaaggguccguucaagcugaccuuacacugauguucgauaauuuugagguggacuucgucggagccgccgugucuugugaugcugccuuucucaaccugaccggcugcuacagcuguaaugcgggggcucggguuugccuguccauuacgucuacaggcaccggaacacuuagcgcccauaacaaggacggcucccuccacaucgugcugcccucugaaaacgggaccaaggaucagugccagauccugcauuucaccgucccugagguggaagaggaauuuauguauagcugugacggagacgagagaccccuccugguuaaaggcacacuuauugccaucgauccuuucgacgaucggcgcgaggcugggggagaauccacgguggucaaucccaagagcggcucuuggaacuuuuucgacugguucuccggccugaugagcugguuugggggaccucucaaaaccauucugcugaucugccuuuacguggcccucucuauuggccuguucuuucugcucaucuaccuggggagaacaggacuuuccaagauguggcuggcugccaccaaaaaggcgagcuga

SEQ ID NO: 14536 - RNA, 3204 nt, Artificial Sequence
  derived and/or modified CDS sequence (opt5) from RVFV(2250/74)__DQ380209.1__Gn-Gc
auggccggcaucgcuaugaccgugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucaaauccaggugucuggcguguggaaaaagccucuuugcgucggguaugaacgcgugguugugaaaagagagcugagcgccaagcccauucagcgggucgaaccuuguacgacaugcaucaccaaaugugagccccacggacucgugguucgcuccacaggcuuuaagauuagcucugccguggcuugcgccuccggggucugugugaccggaagccaaucucccagcaccgagaucacacugaaguacccuggcauuucccagucuagcggcggggauaucggaguccauauggcgcacgacgaucaguccgugagcucuaaaauuguugcucauugcccgccccaggacccuugucuugugcacggcugcaucgucugcgcccaugggcugaucaauuaucaaugucacacggcccucuccgcuuucgugguuguguucgucuuuagcucuauugccaucauuugccuggcuauccuguacagagugcucaagugucugaaaauugcgccccggaaggugcuuaacccucugauguggaucaccgccuucauccgcuggauuuauaaaaagaugguugccagagucgcugauaauaucaaccaggugaaucgggaaauuggauggauggagggcgggcagcucgugcugggcaaccccgccccgaucccucgccacgcucccauuccuagauacuccacauaccuuaugcugcuccugaucgucagcuaugccuccgcgugcucugaacugauccaggccagcucccggauuaccacauguucuaccgagggagugaacacgaagugccgccucagcggcacagcucugaucagagccggguccguuggagcugaagccugucuuaugcugaaaggcgugaaggaggaccaaaccaaauuucucaagauuaaaaccgucagcucugagcuguccugccgggaagggcagagcuacuggacaggaucuuucucccccaagugucugagcucuagacgcugccaucuugugggcgagugucacguuaaucggugccucagcuggagagauaacgaaaccuccgccgaguuuagcuucgugggggaaucuacaacgaugcgcgagaauaaaugcuuugagcaguguggcggauggggcugcggguguuucaacgucaauccuuccugccuguuugugcauaccuaucugcagagcguucggaaggaagcucucagaguguucaacuguaucgacuggguccacaagcugacacuugagauuaccgacuuugauggauccgugucuacaaucgaccugggcgcgagcuccucucgcuucaccaauugggggagcgugucccucucucuggaugccgaaggaauuagcggcuccaacagcuuuucuuucaucgagucccccgggaaaggcuacgcuaucgucgacgagccguucagcgaaauuccucggcaaggauuucugggcgagaucagaugcaauucugaauccagcguucuuucugcccacgaguccugucuccgcgcccccaaccugauuagcuauaagcccaugaucgaucagcuggaaugcacgaccaaucucauugacccuuucgugguguuugagcgggggucccugccgcagacaagaaacgauaaaaccuucgcugccagcaagggaaaucgcggcguccaggcguuuucuaaagggagcgugcaagcugaccuuacacugauguucgauaacuuugagguugacuucgugggagccgccgucuccugugaugcugccuuucucaaucugaccggcugcuacucuuguaacgcgggggcuaaggugugccugagcaucacguccacaggcaccggaucucuuagcgcccauaacaaggacggcucccuccacaucguucugcccucugaaaaugggacaaaagaucagugccagauucugcauuucaccgugccugaggucgaagaggaauuuauguauagcugugacggagacgagcggccccuccuggugaagggcacccuuaucgccauugauccuuucgacgauagacgggaggcugggggagaauccacaguugugaaccccaaaagcggcucuuggaacuuuuucgacugguucuccggccugaugagcugguuugggggaccucucaagacgauccugcugauuugccuuuacgucgcccucucuaucggccuguucuuucugcucaucuaccuggggcgcaccggacuuuccaaaauguggcuggcugccacaaagaaggcgagcuga

SEQ ID NO: 14537 - RNA, 3204 nt, Artificial Sequence
  derived and/or modified CDS sequence (opt5) from RVFV(Sudan 28-2010)__JQ820491.1__Gn-Gc
auggccggcaucgcuaugaccgugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucaaauccaggugucuggcguguggaaaaagccucuuugcgucggguaugaacgcgugguugugaaaagagagcugagcgccaagcccauucagcgggucgaaccuuguacgacaugcaucaccaaaugugagccccacggacucgugguucgcuccacaggcuuuaagauuagcucugccguggcuugcgccuccggggucugugugaccggaagccaaucucccagcaccgagaucacacugaaguacccuggcauuucccagucuagcggcggggauaucggaguccauauggcgcacgacgaucaguccgugagcucuaaaauuguugcucauugcccgccccaggacccuugucuugugcacggcugcaucgucugcgcccaugggcugaucaauuaucaaugucacacggcccucuccgcuuucgugguuguguucgucuuuagcucuauugccaucauuugccuggcuauccuguacagagugcucaagugucugaaaauugcgccccggaaggugcuuaacccucugauguggaucaccgccuucauccgcuggguuuauaaaaagauggucgccagaguggcugauaauauuaaccaggugaaucgggaaaucggauggauggagggcgggcagcucguccugggcaaccccgccccgauuccucgccacgcucccaucccuagauacuccacauaccuuaugcugcuccugauugugagcuaugccuccgcgugcucugaacugauccaggccagcucccggaucaccacauguucuaccgagggaguuaacacgaagugccgccucagcggcacagcucugauuagagccggguccgugggagcugaagccugucuuaugcugaaaggcgucaaggaggaccaaaccaaauuucucaagaucaaaaccgugagcucugagcuguccugccgggaagggcagagcuacuggacaggaucuuucucccccaagugucugagcucuagacgcugccaucuuguuggcgagugucacgugaaucggugccucagcuggagagauaacgaaaccuccgccgaguuuagcuucgucggggaaucuacaacgaugcgcgagaauaaaugcuuugagcaguguggcggauggggcugcggguguuucaacgugaauccuuccugccuguuuguucauaccuaucugcagagcgugcggaaggaagcucucagagucuucaacuguauugacugggugcacaagcugacacuugagaucaccgacuuugauggauccgugucuacaauugaccugggcgcgagcuccucucgcuucaccaauugggggagcgucucccucucucuggaugccgaaggaaucagcggcuccaacagcuuuucuuucauugagucccccgggaaaggcuacgcuaucguugacgagccguucagcgaaaucccucggcaaggauuucugggcgagauuagaugcaauucugaauccagcgugcuuucugcccacgaguccugucuccgcgcccccaaccugaucagcuauaagcccaugauugaucagcuggaaugcacgaccaaucucaucgacccuuucguggucuuugagcgggggucccugccgcagacaagaaacgauaaaaccuucgcugccagcaagggaaaucgcggcgugcaggcguuuucuaaagggagcguucaagcugaccuuacacugauguucgauaacuuugagguggacuucgucggagccgccguguccugugaugcugccuuucucaaucugaccggcugcuacucuuguaacgcgggggcucggguuugccugagcauuacguccacaggcaccggaacacuuucugcccauaacaaggacggcagccuccacaucgugcugcccuccgaaaaugggaccaaggaucagugccagauccugcauuucaccgucccugagguggaagaggaauuuauguauucuugugacggagacgagagaccccuccugguuaaaggcacacuuauugccaucgauccuuucgacgaucggcgcgaggcugggggagaaagcacgguggucaaccccaaguccggcagcuggaacuuuuucgacugguucucuggccugauguccugguuugggggaccucucaaaaccauucugcugaucugccuuuacguggugcucagcauuggccuguucuuucugcucaucuaccuggggagaacaggacuuucuaagauguggcuggccgcuaccaaaaaggccuccuga

SEQ ID NO: 14538 - RNA, 3204 nt, Artificial Sequence
  derived and/or modified CDS sequence (opt5) from RVFV(2007000324)__JF326195.1__Gn-Gc
auggccggcaucgcuaugacagugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucaaauccaggugucuggcguguggaaaaagccucuuugcgucggguaugaacgcgugguugugaaaagagagcugagcgccaagcccauucagcgggucgaaccuuguacgacaugcaucaccaaaugugagccccacggacucgugguucgcuccacaggcuuuaagauuagcucugccguggcuugcgccuccggggucugugugaccggaagccaaucucccagcaccgagaucacacugaaguacccuggcauuucccagucuagcggcggggauaucggaguccauauggcgcacgacgaucaguccgugagcucuaaaauuguugcucauugcccgccccaggacccuugucuugugcacggcugcaucgucugcgcccaugggcugaucaauuaucaaugucacacggcccucuccgcuuucgugguuauuuucguguuuagcucuaccgccaucauuugccuggcuguccuguacagagugcucaagugucugaaaaucgcgccccggaaggugcuuaacccucugauguggauuacagccuucauccgcuggguuuauaaaaagauggucgccagaguggcugauaauaucaaccaggugaaucgggaaauuggauggauggagggcgggcagcucgcccugggcaaccccgcuccgaucccucgccacgcccccauuccuagauacuccaccuaccuuaugcugcuccugaucgucagcuaugcguccgccugcucugaacugauucaggcuagcucccggaucacaaccuguucuacggagggagugaacacaaagugccgccucagcggcaccgcccugaucagagcuggguccguuggagccgaagccugucuuaugcugaaaggcgugaaggaggaccaaaccaaauuucucaagauuaaaacagucagcucugagcuguccugccgggaagggcagagcuacuggaccggaucuuucucccccaagugucugagcucuagacgcugccaucuugugggcgagugucacguuaaucggugccucagcuggagagauaacgaaacauccgcugaguuuagcuucgugggggaaucuacgaccaugcgcgagaauaaaugcuuugagcaguguggcggauggggcugcggguguuucaacgucaauccuuccugccuguuugugcauacauaucugcagagcguucggaaggaagcgcucagaguguucaacuguaucgacuggguccacaagcugacccuugagauuacagacuuugauggauccgugucuaccaucgaccugggcgccagcuccucucgcuucacgaauugggggagcgugucccucucucuggaugcugaaggaauuagcggcuccaacagcuuuucuuucaucgagucccccgggaaaggcuacgccauugucgacgagccguucagcgaaaucccucggcaaggauuucugggcgagaucagaugcaauucugaauccagcguucuuucugcccacgaguccugucuccgcgcucccaaccuggugagcuauaagcccaugauugaucagcuggaaugcaccacaaaucucaucgacccuuucguggucuuugagcgggggucccugccgcagaccagaaacgauaaaacauucgccgcgagcaagggaaaucgcggcgugcaggcuuuuucuaaagggagcguucaagccgaccuuacccugauguucgauaacuuugagguggacuucgucggagccgcuguguccugugaugccgcguuucucaaucugacgggcugcuacucuuguaacgcuggggcccggguuugccugagcauuacauccaccggcacaggaacccuuucugcccauaacaaggacggcagccuccacaucgugcugcccuccgaaaaugggaccaaggaucagugccagauucugcauuucacagucccugagguggaagaggaauuuauguauucuugugacggagacgagagaccccuccugguuaaaggcacgcuuaucgcuaucgauccuuucgacgaucggcgcgaggccgggggagaaagcaccguggucaaccccaaguccggcagcuggaacuuuuucgacugguucucuggccugauguccugguuugggggaccucucaaaacaauucugcugaucugccuuuacguggcucucagcauuggccuguucuuucugcucaucuaccuggggagaaccggacuuucuaagauguggcuggccgcgaccaaaaaggccuccuga

SEQ ID NO: 14539 - RNA, 3204 nt, Artificial Sequence
  derived and/or modified CDS sequence (opt5) from RVFV(ZM-657)__DQ380204.1__Gn-Gc
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaagccuacuguagccacgcuaauggguccggaaucguucaaauccaggugucuggcguguggaagaaaccucuuugcgucggguaugaacgcgugguugugaagagagagcugagcgccaaacccauucagcgggucgaaccuuguacgacaugcaucaccaagugugagccccacggacucgugguucgcuccacaggcuuuaagauuagcucugccguggcuugcgccuccggggucugugugaccggaagccaaucucccagcaccgagaucacacugaaauacccuggcauuucccagucuagcggcggggauaucggaguccauauggcgcacgacgaucaguccgugagcucuaagauuguugcucauugcccgccccaggacccuugucuugugcacggcugcaucgucugcgcccaugggcugaucaacuaucaaugucacacggcccucuccgcuuucgugguuguguucgucuuuagcucuauugccaucauuugccuggcuauccuguacagagugcucaaaugucugaagauugcgccccggaaagugcuuaauccucugauguggaucaccgccuucauccgcuggauuuauaagaagaugguugccagagucgcugauaacaucaaucaggugaaccgggaaauuggauggauggagggcgggcagcucgugcugggcaaucccgccccgaucccucgccacgcucccauuccuagauacuccacauaccuuaugcugcuccugaucgucagcuaugccuccgcgugcucugaacugauccaggccagcucccggauuaccacauguucuaccgagggagugaacacgaaaugccgccucagcggcacagcucugaucagagccggguccguuggagcugaagccugucuuaugcugaagggcgugaaagaggaccaaaccaaguuucucaaaauuaagaccgucagcucugagcuguccugccgggaagggcagagcuacuggacaggaucuuucucccccaaaugucugagcucuagacgcugccaucuugugggcgagugucacguuaaccggugccucagcuggagagauaaugaaaccuccgccgaguuuagcuucgugggggaaucuacaacgaugcgcgagaacaagugcuuugagcaguguggcggauggggcugcggguguuucaaugucaacccuuccugccuguuugugcauaccuaucugcagagcguucggaaggaagcucucagaguguucaauuguaucgacuggguccacaaacugacacuugagauuaccgacuuugauggauccgugucuacaaucgaccugggcgcgagcuccucucgcuucaccaacugggggagcgugucccucucucuggaugccgaaggaauuagcggcuccaauagcuuuucuuucaucgagucccccgggaagggcuacgcuaucgucgacgagccguucagcgaaauuccucggcaaggauuucugggcgagaucagaugcaacucugaauccagcguucuuucugcccacgaguccugucuccgcgcccccaaucugauuagcuauaaacccaugaucgaucagcuggaaugcacgaccaaccucauugacccuuucgugguguuugagcgggggucccugccgcagacaagaaaugauaagaccuucgcugccagcaaaggaaaccgcggcguccaggcguuuucuaaggggagcgugcaagcugaccuuacacugauguucgauaauuuugagguugacuucgugggagccgccgucuccugugaugcugccuuucucaaccugaccggcugcuacucuuguaaugcgggggcucgggugugccugagcaucacguccacaggcaccggaucucuuagcgcccauaacaaggacggcucccuccacaucguucugcccucugaaaacgggacaaaagaucagugccagauucugcauuucaccgugccugaggucgaagaggaauuuauguauagcugugacggagacgagagaccccuccuggugaagggcacccuuaucgccauugauccuuucgacgaucggcgcgaggcugggggagaauccacaguugugaaucccaaaagcggcucuuggaacuuuuucgacugguucuccggccugaugagcugguuugggggaccucucaagacgauccugcugauuugccuuuacgucgcccucucuaucggccuguucuuucugcucaucuaccuggggagaaccggacuuuccaaaauguggcuggcugccacaaagaaggcgagcuga

SEQ ID NO: 14540 - RNA, 3204 nt, Artificial Sequence
  derived and/or modified CDS sequence (opt5) from RVFV(T-46 (228113))__DQ380199.1__Gn-Gc
auggccggcaucgcuaugaccgugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaaaagacucuggccagaccaagcgggaacugaaauccuuugauaucagccagugcccgaagauugggggacauggcucuaagaaaugcacaggcgacgcugccuucuguuccgccuacgagugcaccgcucaguaugcgaaugccuacuguagccacgcuaacggguccggaaucguucaaauccaggugucuggcguguggaagaaaccucuuugcgucggguaugaacgcgugguugugaagagagagcugagcgccaaacccauucagcgggucgaaccuuguacgacaugcaucaccaagugugagccccacggacucgugguucgcuccacaggcuuuaagauuagcucugccguggcuugcgccuccggggucugugugaccggaagccaaucucccagcaccgagaucacacugaaauacccuggcauuucccagucuagcggcggggauaucggaguccauauggcgcacgacgaucaguccgugagcucuaagauuguugcucauugcccgccccaggacccuugucuugugcacggcugcaucgucugcgcccaugggcugaucaauuaucaaugucacacggcccucuccgcuuucgugguuguguucgucuuuagcucuauugccaucauuugccuggcugugcuguacagagugcucaaaugucugaagaucgcgccccggaaaguucuuaacccucugauguggauuaccgccuucauccgcuggaucuauaagaagauggucgccagaguggcugauaauauuaaccaggugaaucgggaaaucggauggauggagggcgggcagcucguccugggcaaccccgccccgauuccucgccacgcucccaucccuagauacuccacauaccuuaugcugcuccugauugugagcuaugccuccgcgugcucugaacugauccaggccagcucccggaucaccacauguucuaccgagggaguuaacacgaaaugccgccucagcggcacagcucugauuagagccggguccgugggagcugaagccugucuuaugcugaagggcgucaaagaggaccaaaccaaguuucucaaaaucaagaccgugagcucugagcuguccugccgggaagggcagagcuacuggacaggaucuuucucccccaaaugucugagcucuagacgcugccaucuuguuggcgagugucacgugaaucggugccucagcuggagagauaacgaaaccuccgccgaguuuagcuucgucggggaaucuacaacgaugcgcgagaauaagugcuuugagcaguguggcggauggggcugcggguguuucaacgugaauccuuccugccuguuuguucauaccuaucugcagagcgugcggaaggaagcucucagagucuucaacuguauugacugggugcacaaacugacacuugagaucaccgacuuugauggauccgugucuacaauugaccugggcgcgagcuccucucgcuucaccaauugggggagcgucucccucucucuggaugccgaaggaaucagcggcuccaacagcuuuucuuucauugagucccccgggaagggcuacgcuaucguugacgagccguucagcgaaaucccucggcaaggauuucugggcgagauuagaugcaauucugaauccagcgugcuuucugcccacgaguccugucuccgcgcccccaaccugaucagcuauaaacccaugauugaucagcuggaaugcacgaccaaucucaucgacccuuucguggucuuugagcgggggucccugccgcagacaagaaacgauaagaccuucgcugccagcaaaggaaaucgcggcgugcaggcguuuucuaaggggagcguucaagcugaccuuacacugauguucgauaacuuugagguggacuucgucggagccgccguguccugugaugcugccuuucucaaucugaccggcugcuacucuuguaacgcgggggcucggguuugccugagcauuacguccacaggcaccggaucucuuagcgcccauaacaaggacggcucccuccacaucgugcugcccucugaaaaugggacaaaagaucagugccagauccugcauuucaccgucccugagguggaagaggaauuuauguauagcugugacggagacgagagaccccuccugguuaagggcacccuuauugccaucgauccuuucgacgaucggcgcgaggcugggggagaauccacaguggucaaccccaaaagcggcucuuggaacuuuuucgacugguucuccggccugaugagcugguuugggggaccucucaagacgauucugcugaucugccuuuacguggcccucucuauuggccuguucuuucugcucaucuaccuggggagaaccggacuuuccaaaauguggcuggcugccacaaagaaggcgagcuga

SEQ ID NO: 14541 - RNA, 3204 nt, Artificial Sequence
  derived and/or modified CDS sequence (opt5) from RVFV(MP12)__Z30318.1__Gn-Gc
auggccggcaucgcuaugacagugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccuguccgcccauggcaacccuuguaugaaagagaagcugguuaugaagacacacugcccgaaugauuaucagucugcucaccaucucaacaaugacgggaaaauggccagcgugaagugucccccuaaauacgaacugaccgaggauugcaacuuuuguagacagaugacaggagcgucccuuaagaaaggcucuuauccccugcaggaccucuucugccaaagcuccgaggaugacggcagcaagcugaagaccaaaaugaagggggucugugaagugggaguucaggcccuuaaaaagugcgauggccagcugucuacggcucacgagguggucccuuuugccguguucaaaaauuccaagaaaguguaccucgacaagcuggaccugaagaccgaagagaaccuccugcccgauagcuuugucuguuucgagcauaaagggcaguauaagggaacaauggacucuggccaaaccaaacgggaacuuaaguccuuugauaucagccagugcccgaaaauugggggacacggcucuaagaagugcacaggcgacgcugccuucuguuccgccuacgagugcaccgcucaguacgcgaaugccuauuguagccacgcuaacggguccggaaucguucagauccaagugucuggcguguggaaaaagccucugugcgucggguacgaacgcgugguugugaaaagagagcucagcgccaagcccauucagcgggucgaaccuuguacgacaugcaucaccaaaugugagccccauggacuggugguucgcuccacaggcuuuaagauuagcucugccguggcuugcgccuccggggucugugugaccggaagccagucucccagcaccgagaucacacuuaaguauccuggcauuucccaaucuagcggcggggauaucggaguccacauggcgcaugacgaucaguccgugagcucuaaaauuguugcucacugcccgccccaggacccuugucuggugcaugauugcaucgucugcgcccacggccucaucaauuaccagugucacacggcccuguccgcuuucgugguuguguucgucuuuagcucuauugccaucauuugccuggcuauccucuauagagugcugaagugucuuaaaauugcgccccggaaggugcugaacccucucauguggaucaccgccuucauccgcuggauuuacaaaaagaugguugccagagucgcucauaauaucaaccaagugaaucgggaaauuggguggauggagggaggccagcuggugcuugggaaccccgccccgaucccucgccacgcucccauuccuagauauuccacauaccugaugcuccugcugaucgucagcuacgccuccgcgugcucugaacucauccaggccagcucccggauuaccacauguucuaccgagggcgugaacacgaagugccgccugagcggaacagcucuuaucagagccggcuccguuggggcugaagccugucugaugcucaaaggagugaaggaggaccagaccaaauuucugaagcugaaaaccgucagcucugagcuuuccugccgggaaggccaaagcuauuggacagggucuuucucccccaagugucucagcucuagacgcugccaucuggugggagagugucacguuaaucggugccugagcuggagagauaacgaaaccuccgccgaguuuagcuucgugggcgaaucuacaacgaugcgcgagaauaaaugcuuugagcagugugggggcuggggaugcggcuguuucaacgucaauccuuccugccucuuugugcacaccuaccugcagagcguucggaaggaagcucuuagaguguucaacuguauugacuggguccauaagcugacacucgagaucaccgacuuugauggguccgugucuacaauugaccugggagcgagcuccucucgcuucaccaauuggggcagcgugucccugucucuugaugccgaagggaucagcggauccaacagcuuuucuuucauugagucccccggcaaaggguaugcuaucgucgacgagccguucagcgaaaucccucggcagggcuuucucggagagauuagaugcaauucugaauccagcguucugucugcccacgaguccugucugcgcgcccccaaccucaucagcuacaagcccaugauugaucaacuggaaugcacgaccaaucuuaucgacccuuucgugguguuugagcggggcucccugccgcagacaagaaacgauaaaaccuucgcugccagcaaggggaaucgcggaguccaggcguuuucuaaaggcagcgugcaggcugaccucacacugauguucgauaacuuugagguugacuucgugggggccgccgucuccugugaugcugccuuucugaaucuuaccggaugcuauucuuguaacgcgggcgcucgggugugccucagcauuacguccacagggaccggcucucugagcgcccauaacaaggacggaucccugcacaucguucuccccucugaaaauggcacaaaggaucaaugccagauccugcauuucaccgugccugaggucgaagaggaauuuauguacagcugugacggggacgagagaccccuucuggugaaaggaacccucauugccaucgauccuuucgacgaucggcgcgaggcuggcggggaauccacaguugugaaccccaagagcggaucuuggaacuuuuucgacugguucuccggccugaugagcugguuuggcgggccucugaaaacgauucuucucaucugccuguaugucgcccugucuauuggacucuucuuucugcuuaucuaccugggcgggaccggacucuccaagauguggcuggcugccaccaaaaaggcgagcuga

SEQ ID NO: 14542 - RNA, 3204 nt, Artificial Sequence
  derived and/or modified CDS sequence (opt5) from RVFV(200803166)__JF311381.1__Gn-Gc
auggccggcaucgcuaugaccgugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucaagaaaggaaaguuuccccuguuccaaucuuacgcccaccaucgcacacuucuggaggcggugcacgacaccaucauugccaaagcugauccucccagcugcgaccuccaguccgcccauggcaacccuuguaugaaggaaaagcugguuaugaaaacacacugcccgaaugauuaucagucugcucacuaccugaacaaugacgggaagauggccagcgugaaaugucccccuaaguaugagcucaccgaagauugcaacuuuuguagacagaugacaggagcgucccugaaaaagggcucuuacccccuucaagaccuguucugccagagcuccgaggaugacggcagcaagcucaaaaccaagaugaaaggggucugugaggugggaguucaggcccugaagaaaugcgauggccagcuuucuacggcucaugaaguggucccuuuugccguguucaagaauagcaaaaagguguaucuggacaagcucgaccugaaaaccgaggaaaaccugcuccccgauagcuuugucuguuucgagcacaaggggcaauacaaaggaacaauggacucuggccagaccaagcgggagcugaaauccuuugauaucagccagugcccgaagauugggggacauggcucuaagaaaugcacaggcgacgcugccuucuguuccgccuacgaaugcaccgcucaguaugcgaaugccuacuguagccacgcuaacggguccggaaucguucaaauccaggugucuggcguguggaagaaaccucuuugcgucggguaugagcgcgugguugugaagagagaacugagcgccaaacccauucagcgggucgagccuuguacgacaugcaucaccaagugugaaccccacggacucgugguucgcuccacaggcuuuaagauuagcucugccguggcuugcgccuccggggucugugugaccggaagccaaucucccagcaccgagaucacacugaaauacccuggcauuucccagucuagcggcggggauaucggaguccauauggcgcacgacgaucaguccgugagcucuaagauuguugcucauugcccgccccaggacccuugucuugugcacggcugcaucgucugcgcccaugggcugaucaauuaucaaugucacacggcccucuccgcuuucgugguuguguucgucuuuagcucuauugccaucauuugccuggcuauccuguacagagugcucaaaugucugaagauugcgccccggaaagugcuuaacccucugauguggaucaccgccuucauccgcuggguuuauaagaagauggucgccagaguggcugauaauauuaaccaggugaaucgggagaucggauggauggaaggcgggcagcucguccugggcaaccccgccccgauuccucgccacgcucccaucccuagauacuccacauaccuuaugcugcuccugauugugagcuaugccaccgcgugcuccgagcugauccaggccucuagccggaucacaaccuguuccacggaaggaguuaacacaaaaugccgccucucuggcaccgcucugauuagagccgggagcgugggagcugaggccugucuuaugcugaagggcgucaaagaagaccaaaccaaguuucucaaaaucaagacaguguccagcgagcugucuugccgggaggggcaguccuacuggaccggauccuucucucccaaaugucuguccagcagacgcugccaucuuguuggcgaaugucacgugaaucggugccucucuuggagagauaacgagacaagcgccgaauuuuccuucgucggggagagcacgaccaugcgcgaaaauaagugcuuugagcaguguggcggauggggcugcggguguuucaacgugaauccuucuugccuguuuguucauacauaucugcaguccgugcggaaggaggcucucagagucuucaacuguauugacugggugcacaaacugacccuugaaaucacagacuuugauggaagcguguccaccauugaccugggcgcgucuagcucccgcuucacgaauugggggucugucagccucucccuggaugccgagggaaucucuggcagcaacuccuuuagcuucauugaaucucccgggaagggcuacgcuaucguugacgagccguucuccgagaucccucggcaaggauuucugggcgaaauuagaugcaauagcgagucuuccgugcuuagcgcccacgaaucuugucuccgcgcccccaaccugaucuccuauaaacccaugauugaucagcuggagugcaccacaaaucucaucgacccuuucguggucuuugaacgggggagccugccgcagaccagaaacgauaagacauucgcugccuccaaaggaaaucgcggcgugcaggcguuuagcaaggggucuguucaagcugaccuuacccugauguucgauaacuuugagguggacuucgucggagccgccgugagcugugaugcugccuuucucaaucugacgggcugcuacuccuguaacgcgggggcucggguuugccugucuauuacaagcaccggcacaggaacccuuuccgcccauaacaaggacggcucucuccacgugguccugcccagcgagaaugggaccaaagaucagugccagauccugcauuucacagugccugaaguugaggaagaguuuauguauuccugugacggagacgaaagaccccuccuggugaagggcacgcuuaucgccauugauccuuucgacgaucggcgcgaggcugggggagagucuaccgucgugaaccccaaaagcggcuccuggaacuuuuucgacugguucagcggccugaugucuugguuugggggaccucucaagacaauccugcugauuugccuuuacguggcccucuccaucggccuguucuuucugcucauuuaccuggggagaaccggacuuagcaaaauguggcuggcugccacaaagaaggcgucuuga

SEQ ID NO: 14543 - RNA, 3204 nt, Artificial Sequence
  derived and/or modified CDS sequence (opt5) from RVFV(200803162)__JF311377.1__Gn-Gc
auggccggcaucgcuaugaccgugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucaaauccaggugucuggcguguggaaaaagccucuuugcgucggguaugaacgcgugguugugaaaagagagcugagcgccaagcccauucagcgggucgaaccuuguacgacaugcaucgccaaaugugagccccacggacucgugguucgcuccaccggcuuuaagauuagcucugcuguggccugcgcguccggggucugugugacaggaagccaaucucccagcaccgagaucacccugaaguacccuggcauuucccagucuagcggcggggauaucggaguccauauggcucacgacgaucaguccgugagcucuaaaauuguugcccauugcccgccccaggacccuugucuugugcacgauugcaucgucugcgcccauggccugaucaauuaucaaugucacacagcucucuccgccuucgugguuauuuucguguuuagcucuacggcuaucauuugccuggccguccuguacagagugcucaagugucugaaaaucgcgccccggaaggugcuuaacccucugauguggauuaccgccuucauccgcuggguuuauaaaaagauggucgcuagaguggccgacaauaucaaccaggugaaucgggaaauuggguggauggagggaggccagcucgcucugcgcaaccccgccccgaucccuagacacgcgcccauuccucgguacuccacauaccuuaugcugcuccugaucgucagcuaugccuccgcuugcucugaacugauucaggccagcucccgcaucaccacauguucuaccgagggggugaacacgaagugcagacucagcggcacagcucugauccgggccggauccguuggcgccgaggcuugucuuaugcugaaaggggugaaggaagaucaaaccaaauuucucaagauuaaaaccgucagcucugagcuguccugcagagaaggacagagcuacuggacaggcucuuucucccccaagugucugagcucucgccggugccaucuugugggggagugucacguuaauagaugccucagcuggcgcgacaacgaaaccuccgcggaguuuagcuucgugggagaaucuacaacgaugcgggagaauaaaugcuuugagcaguguggcggguggggcugcggauguuucaacgucaauccuuccugccuguuugugcauaccuaucugcagagcguuagaaaggaagcccuccgcguguucaacuguaucgacuggguccacaagcugacacuugagauuaccgauuuugacggcuccgugucuacaaucgaucugggggcuagcuccucucgguucaccaauuggggaagcgugucccucucucuggacgccgaaggcauuagcggguccaacagcuuuucuuucaucgagucccccggaaaaggcuacgccauugucgaugagccguucagcgaaaucccuagacaaggguuucugggcgagauccgcugcaauucugaauccagcguucuuucugcucacgaguccugucuccgggcccccaaccuggugagcuauaagcccaugauugaccagcuggaaugcacgaccaaucucaucgauccuuucguggucuuugagagaggaucccugccgcagacacgcaacgacaaaaccuucgcggcuagcaagggcaauagaggggugcaggccuuuucuaaaggaagcguucaagccgaucuuacacugauguucgacaacuuugagguggauuucgucggcgcugccguguccugugacgcggcuuuucucaaucugaccgggugcuacucuuguaacgccggagcccggguuugccugagcauuacguccacaggcaccgggacacuuucugcucauaacaaggauggcagccuccacaucgugcugcccuccgaaaauggaaccaaggaccagugccagauucugcauuucaccgucccugagguggaagaggaauuuauguauucuugugacggcgaugagcggccccuccugguuaaagggacacuuaucgccaucgacccuuucgaugaccgcagagaggcuggaggcgaaagcacgguggucaaccccaaguccgggagcuggaacuuuuucgauugguucucuggacugauguccugguuuggcggcccucucaaaaccauucugcugaucugccuuuacguggcccucagcauugggcuguucuuucugcucaucuaccugggacggacaggccuuucuaagauguggcuggcggccaccaaaaaggcuuccuga

SEQ ID NO: 14544 - RNA, 3204 nt, Artificial Sequence
  derived and/or modified CDS sequence (opt5) from RVFV(Hv-B375)__DQ380218.1__Gn-Gc
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaaaacgaacucaccgaggauugcaauuuuuguagacagaugacaggagcgucccugaagaaaggcucuuauccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaacuccaagaaaguguaccuggacaagcucgaccugaagaccgaagagaaucugcuccccgauagcuuugucuguuucgagcacaaagggcaauauaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguacgcgaacgccuauuguagccacgcuaauggguccggaaucguucaaauccaggugucuggcguguggaaaaagccucuuugcgucggguacgaacgcgugguugugaaaagagagcugagcgccaagcccauucagcgggucgaaccuuguacgacaugcaucaccaaaugugagccccacggacucgugguucgcuccacaggcuuuaagauuagcucugccguggcuugcgccuccggggucugugugaccggaagccaaucucccagcaccgagaucacacugaaguauccuggcauuucccagucuagcggcggggauaucggaguccauauggcgcacgacgaucaguccgugagcucuaaaauuguugcucauugcccgccccaggacccuugucuugugcacggcugcaucgucugcgcccaugggcugaucaacuaccaaugucacacggcccucuccgcuuucgugguuguguucgucuuuagcucuauugccaucauuugccuggcuauccuguauagagugcucaagugucugaaaauugcgccccggaaggugcuuaauccucugauguggaucaccgccuucauccgcuggguuuacaaaaagauggucgccagaguggcugauaacauuaaucaggugaaccgggaaaucggauggauggagggcgggcagcucguccugggcaaccccgccccgauuccucgccacgcucccaucccuagauauuccacauaccuuaugcugcuccugauugugagcuacgccuccgcgugcucugaacugauccaggccagcucccggaucaccacauguucuaccgagggaguuaauacgaagugccgccucagcggcacagcucugauuagagccggguccgugggagcugaagccugucuuaugcugaaaggcgucaaggaggaccaaaccaaauuucucaagaucaaaaccgugagcucugagcuguccugccgggaagggcagagcuauuggacaggaucuuucucccccaagugucugagcucuagacgcugccaucuuguuggcgagugucacgugaaccggugccucagcuggagagauaaugaaaccuccgccgaguuuagcuucgucggggaaucuacaacgaugcgcgagaacaaaugcuuugagcaguguggcggauggggcugcggguguuucaaugugaacccuuccugccuguuuguucauaccuaccugcagagcgugcggaaggaagcucucagagucuucaauuguauugacugggugcacaagcugacacuugagaucaccgacuuugauggauccgugucuacaauugaccugggcgcgagcuccucucgcuucaccaacugggggagcgucucccucucucuggaugccgaaggaaucagcggcuccaauagcuuuucuuucauugagucccccgggaaaggcuaugcuaucguugacgagccguucagcgaaaucccucggcaaggauuucugggcgagauuagaugcaacucugaauccagcgugcuuucugcccacgaguccugucuccgcgcccccaaucugaucagcuacaagcccaugauugaucagcuggaaugcacgaccaaccucaucgacccuuucguggucuuugagcgggggucccugccgcagacaagaaaugauaaaaccuucgcugccagcaagggaaaccgcggcgugcaggcguuuucuaaagggagcguucaagcugaccuuacacugauguucgauaauuuugagguggacuucgucggagccgccguguccugugaugcugccuuucucaaccugaccggcugcuauucuuguaacgcgggggcucggguuugccugagcauuacguccacaggcaccggaacacuuucugcccauaauaaggacggcagccuccacaucgugcugcccuccgaaaacgggaccaaggaucagugccagauccugcauuucaccgucccugagguggaagaggaauuuauguacucuugugacggagacgagagaccccuccugguuaaaggcacacuuauugccaucgauccuuucgacgaucggcgcgaggcugggggagaaagcacgguggucaaucccaaguccggcagcuggaacuuuuucgacugguucucuggccugauguccugguuugggggaccucucaaaaccauucugcugaucugccuuuauguggcccucagcauuggccuguucuuucugcucaucuaccuggggagaacaggacuuucuaagauguggcuggcugccaccaaaaaggcguccuga

SEQ ID NO: 14545 - RNA, 3204 nt, Artificial Sequence
  derived and/or modified CDS sequence (opt5) from RVFV(1260/78)__DQ380214.1__Gn-Gc
auggccggcaucgcuaugaccgugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucaaauccaggugucuggcguguggaaaaagccucuuugcgucggguaugaacgcgugguugugaaaagagagcugagcgccaagcccauucagcgggucgaaccuuguacgacaugcaucaccaaaugugagccccacggacucgugguucgcuccacaggcuuuaagauuagcucugccguggcuugcgccuccggggucugugugaccggaagccaaucucccagcaccgagaucacacugaaguacccuggcauuucccagucuagcggcggggauaucggaguccauauggcgcacgacgaucaguccgugagcucuaaaauuguugcucauugcccgccccaggacccuugucuugugcacggcugcaucgucugcgcccaugggcugaucaauuaucaaugucacacggcccucuccgcuuucgugguuguguucgucuuuagcucuauugccaucauuugccuggcuauccugcacagagugcucaagugucugaaaauugcgccccggaaggugcuuaacccucugauguggaucaccgccuucauccgcuggguuuacaaaaagauggucgccagaguggcugauaauauuaaccaggugaaucgggaaaucggauggauggagggcgggcagcucguccugggcaaccccgccccgauuccucgccaugcucccaucccuagauauuccacauaccuuaugcugcuccugauugugagcuacgccuccgcgugcucugaacugauccaggccagcucccggaucaccacauguucuaccgagggaguuaacacgaagugccgccucagcggcacagcucugauuagagccggguccgugggagcugaagccugucuuaugcugaaaggcgucaaggacgaucaaaccaaauuucucaagaucaaaaccgugagcucugagcuguccugccgggaggggcagagcuauuggacaggaucuuucucccccaagugucugagcucuagacgcugccaccuuguuggcgaaugucaugugaaucggugccucagcuggagagacaacgagaccuccgccgaauuuagcuucgucggggagucuacaacgaugcgcgaaaauaaaugcuuugagcaguguggcggauggggcugcggguguuucaacgugaauccuuccugccuguuuguucacaccuaccugcagagcgugcggaaggaggcucucagagucuucaacuguauugacugggugcacaagcugacacuugaaaucaccgauuuugacggauccgugucuacaauugaucugggcgcgagcuccucucgcuucaccaauugggggagcgucucccucucucuggacgccgagggaaucagcggcuccaacagcuuuucuuucauugaaucccccgggaaaggcuaugcuaucguugaugagccguucagcgagaucccucggcaaggauuucugggcgaaauuagaugcaauucugaguccagcgugcuuucugcccaugaauccugucuccgcgcccccaaccugaucagcuacaagcccaugauugaccagcuggagugcacgaccaaucucaucgauccuuucguggucuuugaacgggggucccugccgcagacaagaaacgacaaaaccuucgcugccagcaagggaaaucgcggcgugcaggcguuuucuaaagggagcguucaagcugaucuuacacugauguucgacaacuuugagguggauuucgucggagccgccguguccugugacgcugccuuucucaaucugaccggcugcuauucuuguaacgcgggggcucggguuugccugagcauuacguccacaggcaccggaacacuuucugcccacaacaaggauggcagccuccauaucgugcugcccuccgagaaugggaccaaggaccagugccagauccugcacuucaccgucccugaaguggaggaagaguuuauguacucuugugacggagaugaaagaccccuccugguuaaaggcacacuuauugccaucgacccuuucgaugaccggcgcgaggcugggggagagagcacgguggucaaccccaaguccggcagcuggaacuuuuucgauugguucucuggccugauguccugguuugggggaccucucaaaaccauucugcugaucugccuuuauguggcccucagcauuggccuguucuuucugcucaucuaccuggggagaacaggacuuucuaagauguggcuggcugccaccaaaaaggcguccuga

SEQ ID NO: 14546 - RNA, 3204 nt, Artificial Sequence
  derived and/or modified CDS sequence (opt5) from RVFV(ZH-501-777)__DQ380202.1__Gn-Gc
auggccggcaucgcuaugacagugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacccgggccagaccaaacgggaacugaagucuuuugauaucucccagugcccuaaaauugggggacauggcagcaagaagugcacaggcgacgcugccuucuguucugccuacgagugcaccgcucaguaugcgaaugccuacuguucccacgcuaacgggagcggaaucguucaaauccagguguccggcguguggaaaaagccccuuugcgucggguaugaacgcgugguugugaaaagagagcugucugccaagccuauucagcgggucgaacccuguacgacaugcaucaccaaaugugagccccacggacucgugguucgcagcacaggcuuuaagauuuccagcgccguggcuugcgccucuggggucugugugaccggaucccaaagcccuucuaccgagaucacacugaaguacccgggcauuagccaguccucuggcggggauaucggaguccauauggcgcacgacgaucagagcguguccagcaaaauuguugcucauugucccccucaggaccccugccuugugcacggcugcaucgucugcgcccaugggcugaucaauuaucaaugucacacggcccucucugcuuucgugguuguguucgucuuuuccagcauugccaucauuugccuggcugugcuguacagagugcucaagugucugaaaaucgccccucggaagguucuuaacccccugauguggauuaccgcguucauccgcuggaucuauaaaaagauggucgccagaguggcugauaauauuaaccaggugaaucgggaaaucggauggauggagggcgggcagcucguccugggcaacccggccccuauuccccgccacgcuccuauccccagauacucuacauaccuuaugcugcuccugauuguguccuaugccagcgcgugcuccgaacugauccaggccucuagccggaucaccacauguuccaccgagggaguuaacacgaagugccgccucucuggcacagcucugauuagagccgggagcgugggagcugaagccugucuuaugcugaaaggcgucaaggaggaccaaaccaaauuucucaagaucaaaaccguguccagcgagcugucuugccgggaagggcaguccuacuggacaggcagcuucucuccuaagugucuguccagcagacgcugccaucuuguuggagagugucacgugaaucggugccucucuuggagagauaacgaaaccagcgccgaguuuuccuucgucggggaaagcacaacgaugcgcgagaauaaaugcuuugagcaguguggcggauggggcugcggguguuucaacgugaaucccucuugccuguuuguucauaccuaucugcaguccgugcggaaggaagcucucagagucuucaacuguauugacugggugcacaagcugacacuugagaucaccgacuuugauggaagcguguccacaauugaccugggcgcgucuagcucccgcuucaccaauugggggucugucagccucucccuggaugccgaaggaaucucuggcagcaacuccuuuagcuucauugagucuccggggaaaggcuacgcuaucguugacgagccuuucuccgaaaucccccggcaaggauuucugggcgagauuagaugcaauagcgaaucuuccgugcuuagcgcccacgagucuugucuccgcgcccccaaccugaucuccuauaagccuaugauugaucagcuggaaugcacgaccaaucucaucgacccguucguggucuuugagcgggggagccugccccagacaagaaacgauaaaaccuucgcugccuccaagggaaaucgcggcgugcaggcguuuagcaaagggucuguucaagcugaccuuacacugauguucgauaacuuugagguggacuucgucggagccgccgugagcugugaugcugccuuucucaaucugaccggcugcuacuccuguaacgcgggggcucggguuugccugucuauuacgagcacaggcaccggaucccuuucugcccauaacaaggacggcagccuccacaucgugcugccuuccgaaaaugggacaaaggaucagugccagauccugcauuucaccguccccgagguggaagaggaauuuauguauucuugugacggagacgagagaccucuccugguuaaaggcacccuuauugccaucgaucccuucgacgaucggcgcgaggcugggggagaaagcacaguggucaacccuaaguccggcagcuggaacuuuuucgacugguucucuggccugauguccugguuugggggaccccucaaaacgauucugcugaucugccuuuacguggcccucagcauuggccuguucuuucugcucaucuaccuggggagaaccggacuuucuaagauguggcuggcugccaccaaaaaggcguccuga

SEQ ID NO: 14547 - RNA, 3204 nt, Artificial Sequence
  derived and/or modified CDS sequence (opt5) from RVFV(OS-3)__DQ380184.1__Gn-Gc
auggccggcaucgcuaugaccgugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaguugugcaaauccaggugucuggcgucuggaaaaagccucuuugcgugggguaugaacgcguuguggucaaaagagagcugagcgccaagcccauccagcggguggaaccuuguacgacaugcauuaccaaaugugagccccacggacucguugugcgcuccacaggcuuuaagaucagcucugccgucgcuugcgccuccggggugugugucaccggaagccaaucucccagcaccgagauuacacugaaguacccuggcaucucccagucuagcggcggggauauuggagugcauauggcgcacgacgaucaguccguuagcucuaaaaucguggcucauugcccgccccaggacccuugucuuguccacggcugcauugugugcgcccaugggcugaucaauuaucaaugucacacggcccucuccgcuuucguuguggucuucguguuuagcucuguggccaucauuugccuggcuauccuguacaagguucucaaaugucugaagauugcccccagaaaaguccuuaacccucugauguggaucaccgcguucauucgguggguguauaagaagaugguggcccgcgucgcugauaauaucaaccaggugaauagagaaaucggauggauggagggcgggcagcucgcccugggcaaccccgcuccgauuccucggcacgcccccaucccucgcuacuccacauaccuuaugcugcuccugauuguuagcuaugcguccgccugcucugaacugauccaggcuagcuccagaauuaccacauguucuaccgagggagugaacacgaaaugccggcucagcggcacagcccugauccgcgcuggguccgucggagccgaagccugucuuaugcugaagggcgugaaagaggaccaaaccaaguuucucaaaaucaagaccguuagcucugagcuguccugcagagaagggcagagcuacuggacaggaucuuucucccccaaaugucugagcucucggagaugccaucuugugggcgagugucacgucaaucgcugccucagcuggcgggauaacgaaaccuccgcugaguuuagcuucgugggggaaucuacaacgaugagagagaauaagugcuuugagcaguguggcggauggggcugcggguguuucaacguuaauccuuccugccuguuugugcauaccuaucugcagagcguccgcaaggaagcgcuccggguguucaacuguauugacugggugcacaaacugacacuugagaucaccgacuuugauggauccgucucuacaauugaccugggcgccagcuccucuagauucaccaauugggggagcguuucccucucucuggaugcugaaggaaucagcggcuccaacagcuuuucuuucauugagucccccgggaagggcuacgccaucguggacgagccguucagcgaaauuccucgccaaggauuucugggcgagauccggugcaauucugaauccagcgugcuuucugcccacgaguccugucucagagcucccaaccugaucagcuauaaacccaugauugaucagcuggaaugcacgaccaaucucaucgacccuuucgucguguuugagcgcgggucccugccgcagacacggaacgauaagaccuucgccgcgagcaaaggaaauagaggcguucaggcuuuuucuaaggggagcgugcaagccgaccuuacacugauguucgauaacuuugaggucgacuucgugggagccgcuguuuccugugaugccgcguuucucaaucugaccggcugcuacucuuguaacgcuggggcccgcgugugccugagcauuacguccacaggcaccggaacacuuucugcccauaacaaggacggcagccuccacaucguccugcccuccgaaaaugggaccaaagaucagugccagauucugcauuucaccgugccugagguugaagaggaauuuauguauucuugugacggagacgagcggccccuccuggugaagggcacacuuaucgcuaucgauccuuucgacgauagacgggaggccgggggagaaagcacggucgugaaccccaaauccggcagcuggaacuuuuucgacugguucucuggccugauguccugguuugggggaccucucaagaccauucugcugaucugccuuuacguggcucucagcauuggccuguucuuucugcucaucuaccuggggcgcacaggacuuucuaaaauguggcuggccgcgaccaagaaggccuccuga

SEQ ID NO: 14548 - RNA, 3204 nt, Artificial Sequence
  derived and/or modified CDS sequence (opt5) from RVFV(SAUDI 200010901)__KU978778.1__Gn-Gc
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuuuuguagccacgcuaacggguccggaaucguucaaauccaggugucuggcguguggaaaaagccucuuugcgucggguacgaacgcgugguugugaaaagagagcugagcgccaagcccauucagcgggucgaaccuuguacgacaugcaucaccaaaugugagccccacggacucgugguucgcuccacaggcuucaagauuagcucugccguggcuugcgccuccggggucugugugaccggaagccaaucucccagcaccgagaucacacugaaguauccuggcauuucccagucuagcggcggggauaucggaguccauauggcgcacgacgaucaguccgugagcucuaaaauuguugcucauugcccgccccaggacccuugucuugugcacggcugcaucgucugcgcccaugggcugaucaauuaccaaugucacacggcccucuccgcuuucgugguuguguuugucuucagcucuauugccaucauuugccuggcuauccuguauagagugcucaagugucugaaaauugcgccccggaaggugcuuaacccucugauguggaucaccgccuuuauccgcuggguuuacaaaaagauggucgccagaguggcugauaauauuaaccaggugaaucgggaaaucggauggauggagggcgggcagcucguccugggcaaccccgccccgauuccucgccacgcucccaucccuagauauuccacauaccuuaugcugcuccugauuaucagcuacgccuccgcgugcucugaacugauccaggccagcucccggauuaccacauguucuaccgagggagugaacacgaagugccgccucagcggcacagcucugaucagagccggguccguuggagcugaagccugucuuaugcugaaaggcgugaaggaggaccaaaccaaauuccucaagauuaaaaccgucagcucugagcuguccugccgggaagggcagagcuauuggacaggaucuuuuucccccaagugucugagcucuagacgcugccaucuugugggcgagugucacguuaaucggugccucagcuggagagauaacgaaaccuccgccgaguucagcuuugugggggaaucuacaacgaugcgcgagaauaaaugcuucgagcaguguggcggauggggcugcggguguuuuaacgucaauccuuccugccuguucgugcauaccuaccugcagagcguucggaaggaagcucucagaguguuuaacuguaucgacuggguccacaagcugacacuugagauuaccgacuucgauggauccgugucuacaaucgaccugggcgcgagcuccucucgcuuuaccaauugggggagcgugucccucucucuggaugccgaaggaauuagcggcuccaacagcuucucuuucaucgagucccccgggaaaggcuaugcuaucgucgacgagccguuuagcgaaauuccucggcaaggauuccugggcgagaucagaugcaauucugaauccagcguucuuucugcccacgaguccugucuccgcgcccccaaccugauuagcuacaagcccaugaucgaucagcuggaaugcacgaccaaucucauugacccuuuugugguguucgagcgggggucccugccgcagacaagaaacgagaaaaccuuugcugccagcaagggaaaucgcggcguccaggcguucucuaaagggagcgugcaagcugaucuuacacugauguuugacaacuucgaaguugauuuugugggagccgccgucuccugugacgcugccuuccucaaucugaccggcugcuauucuuguaacgcgggggcucgggugugccugagcaucacguccacaggcaccggaacacuuucugcccauaacaaggauggcagccuccacaucguucugcccuccgagaaugggaccaaggaccagugccagauucugcauuuuaccgugccugaagucgaggaagaguucauguacucuugugauggagacgagagaccccuccuggugaaaggcacacuuaucgccauugacccuuuugaugaccggcgcgaagcugggggagagagcacgguugugaaccccaaguccggcagcuggaauuucuucgauugguuuucuggccugauguccugguucgggggaccucucaaaaccauccugcugauuugccuuuaugucgcccucagcaucggccuguuuuuccugcucaucuaccuggggagaacaggacuuucuaagauguggcuggcugccaccaaaaaggcguccuga

SEQ ID NO: 14549 - RNA, 3204 nt, Artificial Sequence
  derived and/or modified CDS sequence (opt5) from RVFV(2007001811)__EU574040.1__Gn-Gc
auggccggcaucgcuaugaccgugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucaaauccaggugucuggcguguggaaaaagccucuuugcgucggguaugaacgcgugguugugaaaagagagcugagcgccaagcccauucagcgggucgaaccuuguacgacaugcaucaccaaaugugagccccacggacucgugguucgcuccacaggcuuuaagauuagcucugccguggcuugcgccuccggggucugugugaccggaagccaaucucccagcaccgagaucacacugaaguacccuggcauuucccagucuagcggcggggauaucggaguccauauggcgcacgacgaucaguccgugagcucuaaaauuguugcucauugcccgccccaggacccuugucuugugcacggcugcaucgucugcgcccaugggcugaucaauuaucaaugucacacggcccucuccgcuuucgugguuguguucgucuuuagcucuauugccaucauuugccuggcuauccuguacagagugcucaagugucugaaaauugcgccccggaaggugcuuaacccucugauguggaucaccgccuucauccgcuggguuuauaaaaagauggucgccagaguggcugauaauauuaaccaggugaaucgggaaaucggauggauggagggcgggcagcucguccugggcaaccccgccccgauuccucgccacgcucccaucccuagauacuccacauaccuuaugcugcuccugauugugagcuaugccuccgcgugcucugaacugauccaggccagcucccggaucaccacauguucuaccgagggaguuaacacgaagugccgccucagcggcacagcucugauuagagccggguccgugggagcugaagccugucuuaugcugaaaggcgucaaggaggaccaaaccaaauuucucaugaucaagaccgugagcucugagcuguccugccgggaagggcagagcuacuggacaggaucuuucucccccaaaugucugagcucuagacgcugccaucuuguuggcgagugucacgugaaucggugccucagcuggagagauaacgaaaccuccgccgaguuuagcuucgucggggaaucuacaacgaugcgcgagaauaagugcuuugagcaguguggcggauggggcugcggguguuucaacgugaauccuuccugccuguuuguucauaccuaucugcagagcgugcggaaagaagcucucagagucuucaacuguauugacugggugcacaagcugacacuugagaucaccgacuuugauggauccgugucuacaauugaccugggcgcgagcuccucucgcuucaccaauugggggagcgucucccucucucuggaugccgaaggaaucagcggcuccaacagcuuuucuuucauugagucccccgggaagggcuacgcuaucguugacgagccguucagcgaaaucccucggcaaggauuucugggcgagauuagaugcaauucugaauccagcgugcuuucugcccacgaguccugucuccgcgcccccaaccugaucagcuauaaacccaugauugaucagcuggaaugcacgaccaaucucaucgacccuuucguggucuuugagcgggggucccugccgcagacaagaaacgagaagaccuucgcugccagcaaaggaaaucgcggcgugcaggcguuuucuaaggggagcguucaagcugaucuuacacugauguucgacaacuuugaaguggauuucgucggagccgccguguccugugacgcugccuuucucaaucugaccggcugcuacucuuguaacgcgggggcucggguuugccugagcauuacguccacaggcaccggaacacuuucugcccauaacaaagauggcagccuccacaucgugcugcccuccgagaaugggaccaaggaccagugccagauccugcauuucaccgucccugaaguggaggaagaguuuauguauucuugugauggagacgagagaccccuccugguuaagggcacacuuauugccaucgacccuuucgaugaccggcgcgaagcugggggagagagcacgguggucaaccccaaauccggcagcuggaacuuuuucgauugguucucuggccugauguccugguuugggggaccucucaagaccauucugcugaucugccuuuacguggcccucagcauuggccuguucuuucugcucaucuaccuggggagaacaggacuuucuaaaauguggcuggcugccaccaagaaagcguccuga

SEQ ID NO: 14550 - RNA, 3204 nt, Artificial Sequence
  derived and/or modified CDS sequence (opt5) from RVFV(2007000253)__JF326192.1__Gn-Gc
auggccggcaucgcuaugacagugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucaaauccaggugucuggcguguggaaaaagccucuuugcgucggguaugaacgcgugguugugaaaagagagcugagcgccaagcccauucagcgggucgaaccuuguacgacaugcaucaccaaaugugagccccacggacucgugguucgcuccacaggcuuuaagauuagcucugccguggcuugcgccuccggggucugugugaccggaagccaaucucccagcaccgagaucacacugaaguacccuggcauuucccagucuagcggcggggauaucggaguccauauggcgcacgacgaucaguccgugagcucuaaaauuguugcucauugcccgccccaggacccuugucuugugcacggcugcaucgucugcgcccaugggcugaucaauuaucaaugucacacggcccucuccgcuuucgugguuauuuucguguuuagcucuaccgccaucauuugccuggcuguccuguacagagugcucaagugucugaaaaucgcuccccggaaggugcuuaacccucugauguggauuacagcguucauccgcuggguuuauaaaaagauggucgccagaguggcugauaauaucaaccaggugaaucgggaaauuggauggauggagggcgggcagcucgcccugggcaaccccgcuccgaucccucgccacgcccccauuccuagauacuccaccuaccuuaugcugcuccugaucgucagcuaugcguccgccugcucugaacugauucaggcuagcucccggaucacaaccuguucuacggagggagugaacacaaagugccgccucagcggcaccgcccugaucagagcuggguccgccggagccgaagccugucuuaugcugaaaggcguuaaggaggaccaaaccaaauuucucaagauuaaaacagugagcucugagcuguccugccgggaagggcagagcuacuggaccggaucuuucucccccaagugucugagcucuagacgcugccaucuugucggcgagugucacgugaaucggugccucagcuggagagauaacgaaacauccgcggaguuuagcuucguuggggaaucuacgaccaugcgcgagaauaaaugcuuugagcaguguggcggauggggcugcggguguuucaacgugaauccuuccugccuguuuguccauacauaucugcagagcgugcggaaggaagcccucagaguuuucaacuguaucgacugggugcacaagcugacccuugagauuacagacuuugauggauccgucucuaccaucgaccugggcgcuagcuccucucgcuucacgaauugggggagcgugucccucucucuggaugccgaaggaauuagcggcuccaacagcuuuucuuucaucgagucccccgggaaaggcuacgccauuguggacgagccguucagcgaaaucccucggcaaggauuucugggcgagaucagaugcaauucugaauccagcguccuuucugcucacgaguccugucuccgcgcccccaaccugguuagcuauaagcccaugauugaucagcuggaaugcaccacaaaucucaucgacccuuucgugguguuugagcgggggucccugccgcagaccagaaacgauaaaacauucgcggcuagcaagggaaaucgcggcguccaggccuuuucuaaagggagcgugcaagccgaccuuacccugauguucgauaacuuugagguugacuucgugggagcugccgucuccugugaugcggcuuuucucaaucugacgggcugcuacucuuguaacgccggggcccgggugugccugagcauuacauccaccggcacaggaacccuuucugcucauaacaaggacggcagccuccacaucguucugcccuccgaaaaugggaccaaggaucagugccagauucugcauuucacagugccugaggucgaagaggaauuuauguauucuugugacggagacgagagaccccuccuggugaaaggcacgcuuaucgccaucgauccuuucgacgaucggcgcgaggcugggggagaaagcaccguugugaaccccaaguccggcagcuggaacuuuuucgacugguucucuggccugauguccugguuugggggaccucucaaaacaauucugcugaucugccuuuacgucgcccucagcauuggccuguucuuucugcucaucuaccuggggagaaccggacuuucuaagauguggcuggcggccaccaaaaaggcuuccuga

SEQ ID NO: 14551 - RNA, 3204 nt, Artificial Sequence
  derived and/or modified CDS sequence (opt5) from RVFV(2007001292)__EU574046.1__Gn-Gc
auggccggcaucgcuaugacagugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucaaauccaggugucuggcguguggaaaaagccucuuugcgucggguaugaacgcgugguugugaaaagagagcugagcgccaagcccauucagcgggucgaaccuuguacgacaugcaucaccaaaugugagccccacggacucgugguucgcuccacaggcuuuaagauuagcucugccguggcuugcgccuccggggucugugugaccggaagccaaucucccagcaccgagaucacacugaaguacccuggcauuucccagucuagcggcggggauaucggaguccauauggcgcacgacgaucaguccgugagcucuaaaauuguugcucauugcccgccccaggacccuugucuugugcacggcugcaucgucugcgcccaugggcugaucaauuaucaaugucacacggcccucuccgcuuucgugguuauuuucguguuuagcucuaccgccaucauuugccuggcuguccuguacagagugcucaagugucugaaaaucgcgccccggaaggugcuuaacccucugauguggauuacagccuucauccgcuggguuuauaaaaagauggucgccagaguggcugauaauaucaaccaggugaaucgggaaauuggauggauggagggcgggcagcucgcccugggcaaccccgcuccgaucccucgccacgcccccauuccuagauacuccaccuaccuuaugcugcuccugaucgucagcuaugcguccgccugcucugaacugauucaggcuagcucccggaucacaaccuguucuacggagggagugaacacaaagugccgccucagcggcaccgcccugaucagagcuggguccguuggagccgaagccugucuuaugcugaaaggcgugaaggaggaccaaaccaaauuucucaagauuaaaacagucagcucugagcuguccugccgggaagggcagagcuacuggaccggaucuuucucccccaagugucugagcucuagacgcugccaucuugugggcgagugucacguuaaucggugccucagcuggagagauaacgaaacauccgcugaguuuagcuucgugggggaaucuacgaccaugcgcgagaauaaaugcuuugagcaguguggcggauggggcugcggguguuucaacgucaauccuuccugccuguuugugcauacauaucugcagagcguucggaaggaagcgcucagaguguucaacuguaucgacuggguccacaagcugacccuugagauuacagacuuugauggauccgugucuaccaucgaccugggcgccagcuccucucgcuucacgaauugggggagcgugucccucucucuggaugcugaaggaauuagcggcuccaacagcuuuucuuucaucgagucccccgggaaaggcuacgccauugucgacgagccguucagcgaaaucccucggcaaggauuucugggcgagaucagaugcaauucugaauccagcguucuuucugcccacgaguccugucuccgcgcucccaaccuggugagcuauaagcccaugauugaucagcuggaaugcaccacaaaucucaucgacccuuucguggucuuugagcgggggucccugccgcagaccagaaacgauaaaacauucgccgcgagcaagggaaaucgcggcgugcaggcuuuuucuaaagggagcguucaagccgaccuuacccugauguucgauaacuuugagguggacuucgucggagccgcuguguccugugaugccgcguuucucaaucugacgggcugcuacucuuguaacgcuggggcccggguuugccugagcauuacauccaccggcacaggaacccuuucugcccauaacaaggacggcagccuccacaucgugcugcccuccgaaaaugggaccaaggaucagugccagauucugcauuucacagucccugagguggaagaggaauuuauguauucuugugacggagacgagagaccccuccugguuaaaggcacgcuuaucgcuaucgauccuuucgacgaucggcgcgaggccgggggagaaagcaccguggucaaccccaaguccggcagcuggaaucuguuugacugguucucuggccucauguccugguucgggggaccucugaaaacaauucugcuuaucugccucuacguggcucugagcauuggccuguuuuuccuccugaucuaccuugggagaaccggacugucuaagauguggcucgccgcgaccaaaaaggccuccuga

SEQ ID NO: 14552 - RNA, 3204 nt, Artificial Sequence
  derived and/or modified CDS sequence (opt5) from RVFV(2007002476)__EU574036.1__Gn-Gc
auggccggcaucgcuaugaccgugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucaaauccaggugucuggcguguggaaaaagccucuuugcgucggguaugaacgcgugguugugaaaagagagcugagcgccaagcccauucagcgggucgaaccuuguacgacaugcaucaccaaaugugagccccacggacucgugguucgcuccacaggcuuuaagauuagcucugccguggcuugcgccuccggggucugugugaccggaagccaaucucccagcaccgagaucacacugaaguacccuggcauuucccagucuagcggcggggauaucggaguccauauggcgcacgacgaucaguccgugagcucuaaaauuguugcucauugcccgccccaggacccuugucuugugcacggcugcaucgucugcgcccaugggcugaucaauuaucaaugucacacggcccucuccgcuuucgugguuauuuucguguuuagcucuaccgccaucauuugccuggcuguccuguacagagugcucaagugucugaaaaucgcgccccggaaggugcuuaacccucugauguggauuacagccuucaucaaauggguuuauaagaagauggucgcccgcguggcugauaauaucaaccaggugaauagagaaauuggauggauggagggcgggcagcucgcccugggcaaccccgcuccgaucccucggcacgcccccauuccucgcuacuccaccuaccuuaugcugcuccugaucgucagcuaugcguccgccugcucugaacugauucaggcuagcuccagaaucacaaccuguucuacggagggagugaacacaaaaugccggcucagcggcaccgcccugauccgcgcuggguccguuggagccgaagccugucuuaugcugaagggcgugaaagaggaccaaaccaaguuucucaaaauuaagacagucagcucugagcuguccugcagagaagggcagagcuacuggaccggaucuuucucccccaaaugucugagcucucggagaugccaucuugugggcgagugucacguuaaucgcugccucagcuggcgggauaacgaaacauccgcugaguuuagcuucgugggggaaucuacgaccaugagagagaauaagugcuuugagcaguguggcggauggggcugcggguguuucaacgucaauccuuccugccuguuugugcauacauaucugcagagcguucgcaaggaagcgcuccggguguucaacuguaucgacuggguccacaaacugacccuugagauuacagacuuugauggauccgugucuaccaucgaccugggcgccagcuccucuagauucacgaauugggggagcgugucccucucucuggaugcugaaggaauuagcggcuccaacagcuuuucuuucaucgagucccccgggaagggcuacgccauugucgacgagccguucagcgaaaucccucgccaaggauuucugggcgagauccggugcaauucugaauccagcguucuuucugcccacgaguccugucucagagcucccaaccuggugagcuauaaacccaugauugaucagcuggaaugcaccacaaaucucaucgacccuuucguggucuuugagcgcgggucccugccgcagacccggaacgauaagacauucgccgcgagcaaaggaaauagaggcgugcaggcuuuuucuaaggggagcguucaagccgaccuuacccugauguucgauaacuuugagguggacuucgucggagccgcuguguccugugaugccgcguuucucaaucugacgggcugcuacucuuguaacgcuggggcccgcguuugccugagcauuacauccaccggcacaggaacccuuucugcccauaacaaggacggcagccuccacaucgugcugcccuccgaaaaugggaccaaagaucagugccagauucugcauuucacagucccugagguggaagaggaauuuauguauucuugugacggagacgagcggccccuccugguuaagggcacgcuuaucgcuaucgauccuuucgacgauagacgggaggccgggggagaaagcaccguggucaaccccaaauccggcagcuggaacuuuuucgacugguucucuggccugauguccugguuugggggaccucucaagacaauucugcugaucugccuuuacguggcucucagcauuggccuguucuuucugcucaucuaccuggggcgcaccggacuuucuaaaauguggcuggccgcgacaaagaaggccuccuga

SEQ ID NO: 14553 - RNA, 3204 nt, Artificial Sequence
  derived and/or modified CDS sequence (opt5) from RVFV(73HB1230)__DQ380221.1__Gn-Gc
auggccggcaucgcuaugaccgugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaaaaggaacugaaauccuuugauaucagccagugcccgaagauugggggacauggcucuaagaaaugcacaggcgacgcugccuucuguuccgccuacgagugcaccgcucaguaugcgaaugccuacuguagccacgcuaacggguccggaaucguucaaauccaggugucuggcguguggaagaaaccucuuugcgucggguaugaacgggugguugugaagcgcgagcugagcgccaaacccauucagagagucgaaccuuguacgacaugcaucaccaagugugagccccacggacucgugguucgguccacaggcuuuaagauuagcucugccguggcuugcgccuccggggucugugugaccggaagccaaucucccagcaccgagaucacacugaaauacccuggcauuucccagucuagcggcggggauaucggaguccauauggcgcacgacgaucaguccgugagcucuaagauuguugcucauugcccgccccaggacccuugucuugugcacggcugcaucgucugcgcccaugggcugaucaauuaucaaugucacacggcccucuccgcuuucgugguuguguucgucuuuagcucuauugccaucauuugccuggcuauccuguaccgcgugcucaaaugucugaagauugcccccagaaaagugcuuaacccucugauguggaucaccgcguucauccgguggguuuauaagaagauggucgcccgcguggcugauaauauuaaccaggugaauagagaaaucggauggauggagggcgggcagcucguccugggcaaccccgccccgauuccucggcacgcucccaucccucgcuacuccacauaccuuaugcugcuccugauugugagcuaugccuccgcgugcucugaacugauccaggccagcuccagaaucaccacauguucuaccgagggaguuaacacgaaaugccggcucagcggcacagcucugauucgcgccggguccgugggagcugaagccugucuuaugcugaagggcgucaaagaggaccaaaccaaguuucucaaaaucaagaccgugagcucugagcuguccugcagagaagggcagagcuacuggacaggaucuuucucccccaaaugucugagcucucggagaugccaucuuguuggcgagugucacgugaaucgcugccucagcuggcgggauaacgaaaccuccgccgaguuuagcuucgucggggaaucuacaauuaugagagagaauaagugcuuugagcaguguggcggauggggcugcggguguuucaacgugaauccuuccugccuguuuguucauacguaucugcagagcgugcgcaaggaagcucuccgggucuucaacuguaucgacugggugcacaaacugacccuugagauuacagacuuugauggauccgugucuaccaucgaccugggcgcgagcuccucuagauucacaaauugggggagcgucucccucucucuggaugccgaaggaauuagcggcuccaacagcuuuucuuucaucgagucccccgggaagggcuacgcuaucguugacgagccguucagcgaaauuccucgccaaggauuucugggcgagauccggugcaauucugaauccagcgugcuuucugcccacgaguccugucucagagcccccaaccugauuagcuauaaacccaugaucgaucagcuggaaugcaccacgaaucucauugacccuuucguggucuuugagcgcgggucccugccgcagacccggaacgauaagacauucgcugccagcaaaggaaauagaggcgugcaggcguuuucuaaggggagcguucaagcugaccuuacccugauguucgauaacuuugagguggacuucgucggagccgccguguccugugaugcugccuuucucaaucugacaggcugcuacucuuguaacgcgggggcucgcguuugccugagcaucaccuccacgggcacaggaacccuuucugcccauaacaaggacggcagccuccacaucgugcugcccuccgaaaaugggacaaaagaucagugccagauucugcauuucaccgucccugagguggaagaggaauuuauguauucuugugacggagacgagcggccccuccugguuaagggcacccuuaucgccauugauccuuucgacgauagacgggaggcugggggagaaagcacaguggucaaccccaaauccggcagcuggaacuuuuucgacugguucucuggccugauguccugguuugggggaccucucaagacgauccugcugauuugccuuuacguggcccucagcaucggccuguucuuucugcucaucuaccuggggcgcaccggacuuucuaaaauguggcuggcugccacaaagaaggcguccuga

SEQ ID NO: 14554 - RNA, 3204 nt, Artificial Sequence
  derived and/or modified CDS sequence (opt5) from RVFV(ZINGA J83 R1)__KU978776.1__Gn-Gc
auggccggcaucgcuaugaccgugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacugaugacaggagcgucccuuaagaaaggcucuuacccccugcaggaccucuucugccaaagcuccgaggaugacggcagcaagcugaagaccaaaaugaagggggucugugaagugggaguucaggcccuuaaaaagugcgauggccagcugucuacggcucaugagguggucccuuuugccguguucaaaaauuccaagaaaguguaucucgacaagcuggaccugaagaccgaagagaaccuccugcccgauagcuuugucuguuucgagcacaaagggcaguacaagggaacaauggacucuggccaaaccaaacgggaacuuaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucagauccaagugucuggcguguggaaaaagccucugugcgucggguaugaacgcgugguugugaaaagagagcucagcgccaagcccauucagcgggucgaaccuuguacgacaugcaucaccaaaugugagccccacggacuggugguucgcuccacaggcuuuaagauuagcucugccguggcuugcgccuccggggucugugugaccggaagccagucucccagcaccgagaucacacuuaaguacccuggcauuucccaaucuagcggcggggauaucggaguccauauggcgcacgacgaucaguccgugagcucuaaaauuguugcucauugcccgccccaggacccuugucuggugcacggcugcaucgucugcgcccaugggcucaucaauuaucagugucacacggcccuguccgcuuucgugguuguguucgucuuuagcucuauugccaucauuugccuggcuauccucuacagagugcugaagugucuuaaaauugcuccccggaaggugcugaacccucucauguggaucaccgcguucauccgcuggguuuauagaaaaauggucgcccggguggcugauaauauuaaccaagugaaucgcgaaaucggauggauggagggcgggcagcugguccuuggcaaccccgccccgauuccuagacacgugcccaucccucgguacuccacauaccugaugcuccugcugauuguuagcuaugcuuccgccugcucugaacucauccaggcgagcucccgcaucaccacauguucuaccgagggagugaacacgaagugcagacugagcggcacagcccuuauucgggcuggguccgucggagccgaagccugucugaugcucaagggcgugaaagaggaccagaccaaguuucugaaaaucaagaccguuagcucugagcuguccugcagagaagggcaaagcuacuggacaggaucuuucucccccaaaugucuuagcucucgccggugccaucucgugggcgagugucacgucaauagaugccugagcuggcgcgauaacgaaaccuccgccgaguuuagcuucgugggggaaucuacaacgaugcgggagaauaagugcuuugagcaguguggcggauggggcugcggguguuucaacguuaauccuuccugccuguuugugcauaccuaucuccagagcgucagaaaagaagcccugcgcguguucaacuguauugacugggugcacaaacuuacacuggagaucaccgacuuugauggauccgucucuacaauugaccucggcgcuagcuccucucgguucaccaauugggggagcguuucccugucucuggaugcggaaggaaucagcggcuccaacagcuuuucuuucauugagucccccgggaagggcuacgccaucguggacgagccguucagcgaaaucccuagacagggauuucuuggcgagauucgcugcaauucugaauccagcgugcucucugcucacgaguccugucugcgggcccccaaccugaucagcuauaagcccaugauugaucaacucgaaugcacgaccaaucugaucgacccuuucgucguguuugagagagggucccuuccgcagacacgcaacgauaagaccuucgccgcuagcaaaggaaaucggggcguucaggccuuuucuaaggggagcgugcaggcggaccugacacucauguucgauaacuuugaggucgacuucgugggagcugccguuuccugugaugccgcuuuucugaaucugaccggcugcuacucuuguaacgccggggcgagagugugccuuagcauuacguccacaggcaccggaacacucucugcucauaacaaagacggcagccugcacaucguccugcccuccgaaaaugggaccaaggaucaaugccagauccuccauuucaccgugccugagguugaagaggaauuuauguauucuugugacggagacgagcggccccugcuugugcgcggcacacugauugccaucgauccuuucgacgauagacgggaggccgggggagaaagcacggucgugaaccccaaguccggcagcuggaacuuuuucgacugguucucuggccucauguccugguuugggggaccucugaaaaccauucugcuuaucugccucuacguggcucugagcauuggccuguucuuucuccugaucuaccuugggagaacaggacugucuaagauguggcucgccgcuaccaaaaaggccuccuga

SEQ ID NO: 14555 - RNA, 3204 nt, Artificial Sequence
  derived and/or modified CDS sequence (opt5) from RVFV(2008/00101)__HE687306.1__Gn-Gc
auggccggcaucgcuaugaccgugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucaaauccaggugucuggcguguggaaaaagccucuuugcgucggguaugaacgcgugguugugaaaagagagcugagcgccaagcccauucagcgggucgaaccuuguacgacaugcaucaccaaaugugagccccacggacucgugguucgcuccacaggcuuuaagauuagcucugccguggcuugcgccuccggggucugugugaccggaagccaaucucccagcaccgagaucacacugaaguacccuggcauuucccagucuagcggcggggauaucggaguccauauggcgcacgacgaucaguccgugagcucuaaaauuguugcucauugcccgccccaggacccuugucuugugcacggcugcaucgucugcgcccaugggcugaucaauuaucaaugucacacggcccucuccgcuuucgugguuauuuucguguuuagcucuaccgccaucauuugccuggcuguccuguacagagugcucaagugucugaaaaucgcgccccggaaggugcuuaacccucugauguggauuacagccuucauccgcuggguuuauaaaaagauggucgccagaguggcugauaauaucaaccaggugaaucgggaaauuggauggauggagggcgggcagcucgcccugggcaaccccgcuccgaucccucgccacgcccccauuccuagauacuccaccuaccuuaugcugcuccugaucgucagcuaugcguccgccugcucugaacugauucaggcuagcucccggaucacaaccuguucuacggagggagugaacacaaagugccgccucagcggcaccgcccugaucagagcuggguccguuggagccgaagccugucuuaugcugaaaggcgugaaggaggaccaaaccaaauuucucaagauuaaaacagucagcucugagcuguccugccgggaagggcagagcuacuggaccggaucuuucucccccaagugucugagcucuagacgcugccaucuugugggcgagugucacguuaaucggugccucagcuggagagauaacgaaacauccgcugaguuuagcuucgugggggaaucuacgaccaugcgcgagaauaaaugcuuugagcaguguggcggauggggcugcggguguuucaacgucaauccuuccugccuguuugugcauacauaucugcagagcguucggaaggaagcgcucagaguguucaacuguaucgacuggguccacaagcugacccuugagauuacagacuuugauggauccgugucuaccaucgaccugggcgccagcuccucucgcuucacgaauugggggagcgugucccucucucuggaugcugaaggaauuagcggcuccaacagcuuuucuuucaucgagucccccgggaaaggcuacgccauugucgacgagccguucagcgaaaucccucggcaaggauuucugggcgagaucagaugcaauucugaauccagcguucuuucugcccacgaguccugucuccgcgcucccaaccuggugagcuauaagcccaugauugaucagcuggaaugcaccacaaaucucaucgacccuuucguggucuuugagcgggggucccugccgcagaccagaaacgauaaaacauucgccgcgagcaagggaaaucgcggcgugcaggcuuuuucuaaagggagcguucaagccgaccuuacccugauguucgauaacuuugagguggacuucgucggagccgcuguguccugugaugccgcguuucucaaucugacgggcugcuacucuuguaacgcuggggcccggguuugccugagcauuacauccaccggcacaggaacccuuucugcccauaacaaggacggcagccuccacaucgugcugcccuccgaaaaugggaccaaggaucagugccagauucugcauuucacagucccugagguggaagaggaauuuauguauucuugugacggagacgagagaccccuccugguuaaaggcacgcuuaucgcuaucgauccuuucgacgaucggcgcgaggccgggggagaaagcaccguggucaaccccaaguccggcagcuggaacuuuuucgacugguucucuggccugauguccugguuugggggaccucucaaaacaacccugcugauuugccuuuacguggcucucagcaucggccuguucuuucugcucauuuaccuggggagaacaggacuuucuaagauguggcuggccgcgaccaaaaaggccuccuga

SEQ ID NO: 14556 - RNA, 3204 nt, Artificial Sequence
  derived and/or modified CDS sequence (opt5) from RVFV(2007002445)__EU574037.1__Gn-Gc
auggccggcaucgcuaugacagugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucaaauccaggugucuggcguguggaaaaagccucuuugcgucggguaugaacgcgugguugugaaaagagagcugagcgccaagcccauucagcgggucgaaccuuguacgacaugcaucaccaaaugugagccccacggacucgugguucgcuccacaggcuuuaagauuagcucugccguggcuugcgccuccggggucugugugaccggaagccaaucucccagcaccgagaucacacugaaguacccuggcauuucccagucuagcggcggggauaucggaguccauauggcgcacgacgaucaguccgugagcucuaaaauuguugcucauugcccgccccaggacccuugucuugugcacggcugcaucgucugcgcccaugggcugaucaauuaucaaugucacacggcccucuccgcuuucgugguuauuuucguguuuagcucuaccgccaucauuugccuggcuguccuguacagagugcucaagugucugaaaaucgcgccccggaaggugcuuaacccucugauguggauuacagccuucauccgcuggguuuauaaaaagauggucgccagaguggcugauaauaucaaccaggugaaucgggaaauuggauggauggagggcgggcagcucgcccugggcaaccccgcuccgaucccucgccacgcccccauuccuagauacuccaccuaccuuaugcugcuccugaucgucagcuaugcguccgccugcucugaacugauucaggcuagcucccggaucacaaccuguucuacggagggagugaacacaaagugccgccucagcggcaccgcccugaucagagcuggguccguuggagccgaagccugucuuaugcugaaaggcgugaaggaggaccaaaccaaauuucucaagauuaaaacagucagcucugagcuguccugccgggaagggcagagcuacuggaccggaucuuucucccccaagugucugagcucuagacgcugccaucuugugggcgagugucacguuaaucggugccucagcuggagagauaacgaaacauccgcugaguuuagcuucgugggggaaucuacgaccaugcgcgagaauaaaugcuuugagcaguguggcggauggggcugcggguguuucaacgucaauccuuccugccuguuugugcauacauaucugcagagcguucggaaggaagcgcucagaguguucaacuguaucgacuggguccacaagcugacccuugagauuacagacuuugauggauccgugucuaccaucgaccugggcgccagcuccucucgcuucacgaauugggggagcgugucccucucucuggaugcugaaggaauuagcggcuccaacagcuuuucuuucaucgagucccccgggaaaggcuacgccauugucgacgagccguucagcgaaaucccucggcaaggauuucugggcgagaucagaugcaauucugaauccagcguucuuucugcccacgaguccugucuccgcgcucccaaccuggugagcuauaagcccaugauugaucagcuggaaugcaccacaaaucucaucgacccuuucguggucuuugagcgggggucccugccgcagaccagaaacgagaaaacauucgccgcgagcaagggaaaucgcggcgugcaggcuuuuucuaaagggagcauucaagccgaucuuacccugauguucgacaacuuugaaguugauuucgugggagccgcugucuccugugacgccgcguuucucaaucugacgggcugcuacucuuguaacgcuggggcccgggugugccugagcaucacauccaccggcacaggaacccuuucugcccauaacaaggauggcagccuccacauuguucugcccuccgagaaugggaccaaggaccagugccagauccugcauuucacagugccugaagucgaggaagaguuuauguauucuugugauggagacgagagaccccuccuggugaaaggcacgcuuaucgcuauugacccuuucgaugaccggcgcgaagccgggggagagagcaccguugugaaccccaaguccggcagcuggaacuuuuucgauugguucucuggccugauguccugguuugggggaccucucaaaacaauccugcugauuugccuuuacgucgcucucagcaucggccuguucuuucugcucauuuaccuggggagaaccggacuuucuaagauguggcuggccgcgaccaaaaaggccuccuga

SEQ ID NO: 14557 - RNA, 3204 nt, Artificial Sequence
  derived and/or modified CDS sequence (opt5) from RVFV(ZC-3349)__DQ380207.1__Gn-Gc
auggccggcaucgcuaugaccgugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucaaauccaggugucuggcguguggaaaaagccucuuugcgucggguaugaacgcgugguugugaaaagagagcugagcgccaagcccauucagcgggucgaaccuuguacgacaugcaucaccaaaugugagccccacggacucgugguucgcuccacaggcuuuaagauuagcucugccguggcuugcgccuccggggucugugugaccggaagccaaucucccagcaccgagaucacacugaaguacccuggcauuucccagucuagcggcggggauaucggaguccauauggcgcacgacgaucaggcuguguccagcaaaauuguugcccauugcccgccccaggacccuugucuugugcacggcugcaucgucugcgcccaugggcugaucaauuaucaaugucacacggcucucucugccuucgugguuguguucgucuuuuccagcauugcuaucauuugccuggccauccuguacagagugcucaagugucugaaaauugcgccccggaaggugcuuaacccucugauguggaucaccgccuucauccgcuggauuuauaaaaagaugguugcuagagucgccgauaauaucaaccacgugaaucgggaaauuggauggauggagggcgggcagcucgugcugggcaaccccgcuccgaucccucgccaugcccccauuccuagauacucuacauaccuuaugcugcuccugaucgucuccuaugcgagcgccugcuccgaacugauccaggcuucuagccggauuaccacauguuccaccgagggagugaacacgaagugccgccucucuggcacagcccugaucagagcugggagcguuggagccgaagccugucuuaugcugaaaggcgugaaggaggaccagaccaaauuucucaagauuaaaaccgucuccagcgagcugucuugccgggaagggcaauccuacuggacaggcagcuucucucccaagugucuguccagcagacgcugccaccuugugggagagugucauguuaaucggugccucucuuggagagauaacgaaaccagcgcugaguuuuccuucgugggggaaagcacaacgaugcgcgagaauaaaugcuuugagcaguguggcggauggggcugcggguguuucaacgucaauccuucuugccuguuugugcacaccuaucugcaguccguucggaaggaagcgcucagaguguucaacuguaucgacuggguccacaagcugacacuugagauuaccgacuuugauggaagcguguccacaaucgaccugggcgccucuagcucccgcuucaccaauugggggucugugagccucucccuggaugcugaaggaauuucuggcagcaacuccuuuagcuucaucgagucucccgggaaaggcuacgccaucgucgacgagccguucuccgaaauuccucggcagggauuucugggcgagaucagaugcaauagcgaaucuuccguucuuagcgcccaugagucuugucucaaggcucccaaccugauuuccuauaaacccaugaucgaucaacuggaaugcacgaccaaucucauugacccuuucgugguguuugagcgcgggagccugccgcagacacggaacgauaagaccuucgccgcguccaaaggaaauagaggcguccaggcuuuuagcaaggggucugugcaggccgaccuuacacugauguucgauaacuuugagguugacuucgugggagccgcugucagcugugaugccgcguuucucaaucugaccggcugcuacuccuguaacgcuggggcccgcgugugccugucuaucacgagcacaggcaccggaucccuuucugcccacaacaaggacggcagccuccauaucguucugcccuccgaaaaugggacaaaagaucaaugccagauucugcacuucaccgugccugaggucgaagaggaauuuauguauucuugugacggagacgagcggccccuccuggugaagggcacccuuaucgcuauugauccuuucgacgauagacgggaggccgggggagaaagcacaguugugaaccccaaauccggcagcuggaacuuuuucgacugguucucuggccugauguccugguuugggggaccucucaagacgauccugcugauuugccuuuacgucgcucucagcaucggccuguucuuucugcucaucuaccuggggcgcaccggacuuucuaaaauguggcuggccgcgacaaagaaggccuccuga

SEQ ID NO: 14558 - RNA, 3204 nt, Artificial Sequence
  derived and/or modified CDS sequence (opt5) from RVFV(Kenya 9800523)__DQ380196.1__Gn-Gc
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuuuuguagccacgcuaacggguccggaaucguucaaauccaggugucuggcguguggaaaaagccucuuugcgucggguacgaacgcgugguugugaaaagagagcugagcgccaagcccauucagcgggucgaaccuuguacgacaugcaucaccaaaugugagccccacggacucgugguucgcuccacaggcuucaagauuagcucugccguggcuugcgccuccggggucugugugaccggaagccaaucucccagcaccgagaucacacugaaguauccuggcauuucccagucuagcggcggggauaucggaguccauauggcgcacgacgaucaguccgugagcucuaaaauuguugcucauugcccgccccaggacccuugucuugugcacggcugcaucgucugcgcccaugggcugaucaauuaccaaugucacacggcccucuccgcuuucgugguuguguuugucuucagcucuauugccaucauuugccuggcuauccuguauagagugcucaagugucugaaaauugcgccccggaaggugcuuaacccucugauguggaucaccgccuuuauccgcuggguuuacaaaaagauggucgccagaguggcugauaauauuaaccaggugaaucgggaaaucggauggauggagggcgggcagcucguccugggcaaccccgccccgauuccucgccacgcucccaucccuagauauuccacauaccuuaugcugcuccugauugugagcuacgccuccgcgugcucugaacugauccaggccagcucccggaucaccacauguucuaccgagggaguuaacacgaagugccgccucagcggcacagcucugauuagagccggguccgugggagcugaagccugucuuaugcugaaaggcgucaaggaggaccaaaccaaauuccucaagaucaaaaccgugagcucugagcuguccugccgggaagggcagagcuauuggacaggaucuuuuucccccaagugucugagcucuagacgcugccaucuuguuggcgagugucacgugaaucggugccucagcuggagagauaacgaaaccuccgccgaguucagcuuugucggggaaucuacaacgaugcgcgagaauaaaugcuucgagcaguguggcggauggggcugcggguguuuuaacgugaauccuuccugccuguucguucauaccuaccugcagagcgugcggaaggaagcucucagagucuuuaacuguauugacugggugcacaagcugacacuugagaucaccgacuucgauggauccgugucuacaauugaccugggcgcgagcuccucucgcuuuaccaauugggggagcgucucccucucucuggaugccgaaggaaucagcggcuccaacagcuucucuuucauugagucccccgggaaaggcuaugcuaucguugacgagccguuuagcgaaaucccucggcaaggauuccugggcgagauuagaugcaauucugaauccagcgugcuuaacgcccacgagucuugucuccgcgcccccaaucugaucuccuacaagcccaugauugaucagcuggaaugcacgaccaaccucaucgacccuuuuguggucuucgagcgggggagccugccgcagacaagaaaugauaaaaccuuugcugccuccaagggaaaccgcggcgugcaggcguucagcaaagggucuguucaagcugaccuuacacugauguuugauaauuucgagguggacuuugucggagccgccgugagcugugaugcugccuuccucaaccugaccggcugcuauuccuguaacgcgggggcucggguuugccugucuauuacgagcacaggcaccggaacacuuuccgcccauaauaaggaaggcucucuccacaucgugcugcccagcgagaacgggaccaaggaccagugccagauccugcauuuuaccgucccugaaguggaggaagaguucauguacuccugugauggagacgagagaccccuccugguuaaaggcacacuuauugccaucgacccuuuugaugaccggcgcgaagcugggggagagucuacgguggucaaucccaagagcggcuccuggaacuucuucgauugguuuagcggccugaugucuugguucgggggaccucucaaaaccauucugcugaucugccuuuauguggcccucuccauuggccuguuuuuccugcucaucuaccuggggagaacaggacuuagcaagauguggcuggcugccaccaaaaaggcgucuuga

SEQ ID NO: 14559 - RNA, 3204 nt, Artificial Sequence
  derived and/or modified CDS sequence (opt5) from RVFV(Entebbe)__DQ380191.1__Gn-Gc
auggccggcaucgcuaugaccgugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaucaaacgggaacugaaguccuuugauauuagccagugcccgaaaaucgggggacauggcucuaagaagugcaccggcgacgcugccuucuguuccgccuacgagugcacagcucaguaugcgaaugccuacuguagccacgcuaacggguccggaaucguucaaauucaggugucuggcguguggaaaaagccucuuugcgucggguaugaacgcgugguugugaaaagagagcugagcgccaagcccauccagcgggucgaaccuuguaccacgugcauuacaaaaugugagccccacggacucgugguucgcuccaccggcuuuaagaucagcucugccguggcuugcgccuccggggucugugugacaggaagccaaucucccagcaccgagauuacccugaaguacccuggcaucucccagucuagcggcggggauauuggaguccauauggcgcacgacgaucaguccgugagcucuaaaaucguugcucauugcccgccccaggacccuugucuugugcacggcugcaucgucugcgcccaugggcugauuaauuaucaaugucacacagcccucuccgcuuucgugguuguguucgucuuuagcucuguggccaucauuugccuggcuauccuguacaaggugcucaaaugucugaagauugcccccagaaaaguucuuaacccucugauguggaucacggcguucauccggugggucuauaagaagaugguggcccgcguggcugauaauauuaaccaggucaauagagaaaucggauggauggagggcgggcagcucgugcugggcaaccccgccccgauuccucggcacgcucccaucccucgcuacuccaccuaccuuaugcugcuccugauuguuagcuaugccuccgcgugcucugaacugauccaggccagcuccagaaucacaaccuguucuacagagggagugaacaccaaaugccggcucagcggcacggcucugauucgcgccggguccgucggagcugaagccugucuuaugcugaagggcgugaaagaggaccaaacaaaguuucucaaaaucaagaccguuagcucugagcuguccugcagagaagggcagagcuacuggaccggaucuuucucccccaaaugucugagcucucggagaugccaucuugugggcgagugucacgucaaucgcugccucagcuggcgggauaacgaaacauccgccgaguuuagcuucgugggggaaucuaccacaaugagagagaauaagugcuuugagcaguguggcggauggggcugcggguguuucaacguuaauccuuccugccuguuugugcauacguaucugcagagcguccgcaaggaagcucuccggguguucaacuguauugacugggugcacaaacugacccuugagaucacagacuuugauggauccgucucuaccguugaccugggcgcgagcuccucuagauucacaaauugggggagcgugucccucucucuggaugccgaaggaauuagcggcuccaacagcuuuucuuucaucgagucccccgggaagggcuacgcuauuguggacgagccguucagcgaaaucccucgccaaggauuucugggcgagauccggugcaauucugaauccagcguccuuucugcccacgaguccugucucagagcccccaaccugauuagcuauaaacccaugaucgaucagcuggaaugcaccacgaaucucauugacccuuucgugguuuuugagcgcgggucccugccgcagacccggaacgauaagacauucgcugccagcaaaggaaauagaggcgugcaggcguuuucuaaggggagcguccaagcugaccuuacccugauguucgauaacuuugagguggacuucguuggagccgccguguccugugaugcugccuuucucaaucugacaggcugcuacucuuguaacgcgggggcucgcgucugccugagcaucaccuccacgggcacaggaacccuuucugcccauaacaaggacggcagccuccacauugugcugcccuccgaaaaugggacaaaagaucagugccagauccugcauuucaccguuccugagguggaagaggaauuuauguauucuugugacggagacgagcggccccuccuggucaagggcacccuuaucgccauugauccuuucgacgauagacgggaggcugggggagaaagcacaguggugaaccccaaauccggcagcuggaacuuuuucgacugguucucuggccugauguccugguuugggggaccucucaagacgauccugcugauuugccuuuacgucgcccucagcaucggccuguucuuucugcucauuuaccuggggcgcaccggacuuucuaaaauguggcuggcugccacaaagaaggcguccuga

SEQ ID NO: 14560 - RNA, 3204 nt, Artificial Sequence
  derived and/or modified CDS sequence (opt5) from RVFV(25010-24)__KM210509.1__Gn-Gc
auggccggcaucgcuaugaccgugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucaaauccaggugucuggcguguggaaaaagccucuuugcgucggguaugaacgcgugguugugaaaagagagcugagcgccaagcccauucagcgggucgaaccuuguacgacaugcaucaccaaaugugagccccacggacucauugugcgcuccacaggcuuuaagaucagcucugccguugcuugcgccuccggggugugugucaccggaagccaaucucccagcaccgagauuacacugaaguacccuggcaucucccagucuagcggcggggauauuggagugcauauggcgcacgacgaucaguccgucagcucuaaaaucguggcucauugcccgccccaggacccuugucuuguucacggcugcaucgugugcgcccaugggcugauuaauuaucaaugucacacggcccucuccgcuuucgucgugguuuucguguuuagcucugucgccaucauuugccuggcuauccuguacaaggugcucaaaugucugaagauugcccccaaaaaggugcuuaacccucugauguggaucaccgcguucaucagauggguuuauaagaaaauggucgcccggguggcugauaauauuaaccaggugaaucgcgaaaucggauggauggagggcgggcagcucgcccugggcaaccccgcuccgauuccuagacacgcccccaucccucgguacuccacauaccuuaugcugcuccugauugucagcuaugcguccgccugcucugaacugauccaggcuagcucccgcaucaccacauguucuaccgagggagugaacacgaagugcagacucagcggcacagcccugauucgggcuggguccguuggagccgaagccugucuuaugcugaaaggcgugaaggacgaucaaaccaaauuucucaagaucaaaaccgucagcucugagcuguccugccgcgaggggcagagcuacuggacaggaucuuucucccccaagugucugagcucuagacggugccaucuugugggcgaaugucacguuaauagaugccucagcuggcgcgacaacgagaccuccgcugaauuuagcuucgugggggagucuacaacgaugcgggaaaauaagugcuuugagcaguguggcggauggggcugcggguguuucaacgucaauccuuccugccuguuugugcauaccuaucugcagagcguuagaaaagaggcgcuccgcguguucaacuguauugacuggguccacaagcugacacuugaaaucaccgauuuugacggauccgugucuacaauugaucugggcgccagcuccucucgguucaccaauugggggagcgugucccucucucuggacgcugagggaaucagcggcuccaacagcuuuucuuucauugaaucccccgggaaaggcuacgccaucgucgaugagccguucagcgagaucccuagacaaggauuucugggcgaaauucgcugcaauucugaguccagcguucuuucugcccacgaauccugucuccgggcucccaaccugaucagcuauaagcccaugauugaccagcuggagugcacgaccaaucucaucgauccuuucgugguguuugaaagagggucccugccgcagacacgcaacgacaaaaccuucgccgcgagcaagggaaaucggggcguccaggcuuuuucuaaggggagcgugcaagccgaucuuacacugauguucgacaacuuugagguugauuucgugggagccgcugucuccugugacgccgcguuucucaaucugaccggcugcuacucuuguaacgcuggggccagagugugccugagcauuacguccacaggcaccggaacacuuucugcccauaacaaagauggcagccuccacaucguucugcccuccgagaaugggaccaaggaccagugccagauccugcauuucaccgugccugaagucgaggaagaguuuauguauucuugugacggagaugaacgcccccuccuggugaaaggcacacuuauugcuaucgacccuuucgaugaccggagagaggccgggggagagagcacgguugugaaccccaaguccggcagcuggaacuuuuucgauugguucucuggccugauguccugguuugggggaccucucaaaaccauucugcugaucugccuuuacgucgcucucagcauuggccuguucuuucugcucaucuaccuggggcggacaggacuuucuaagauguggcuggccgcgaccaagaaagccuccuga

SEQ ID NO: 14561 - RNA, 3204 nt, Artificial Sequence
  derived and/or modified CDS sequence (opt5) from RVFV(763/70)__DQ380188.1__Gn-Gc
auggccggcaucgcuaugaccgugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauauggacucaccgaagauugcaacuuuuguagacagaugacaggcgcgucccugaagaaaggcucuuacccccuucaagaccuguucugccagagcuccgaggaugacgggagcaagcucaagaccaaaaugaagggagucugugaggugggcguucaggcccugaaaaagugcgaugggcagcuuucuacggcucaugaaguggucccuuuugccguguucaaaaauuccaagaaaguguaucuggacaagcucgaccugaagaccgaggaaaaccugcuccccgauagcuuugucuguuucgagcacaaaggacaauacaagggcacaauggacucugggcagaccaaacgggagcugaaguccuuugauaucagccagugcccgaaaauuggaggccauggcucuaagaagugcacaggggacgcugccuucuguuccgccuacgaaugcaccgcucaguaugcgaaugccuacuguagccacgcuaacggauccggcaucguucaaauccaggugucugggguguggaaaaagccucuuugcgucggauaugagcgcgugguugugaaaagagaacugagcgccaagcccauucagcgggucgagccuuguacgacaugcaucaccaaaugugaaccccacggccucgugguucgcuccacaggguuuaagauuagcucugccguggcuugcgccuccggagucugugugaccggcagccaaucucccagcaccgagaucacacugaaguacccuggcauuucccagucuagcgggggagauaucggcguccauauggcgcacgacgaucaguccgugagcucuaaaauuguugcucauugcccgccccaggacccuugucuugugcacgggugcaucgucugcgcccauggacugaucaauuaucaaugucacacggcccucuccgcuuucgugguuguguucgucuuuagcucuguggccauuaucugccuggcuauucuguacaaggugcucaaaugucugaagaucgcccccagaaaaguucuuaacccucugauguggauuaccgcguucauccggugggucuauaagaagaugguggcccgcguggcugauaauaucaaccaggucaauagagagauuggcuggauggaagggggccagcucgcccugggaaaccccgcuccgaucccucggcacgcccccauuccucgcuacuccacauaccuuaugcugcuccugaucgugagcuaugcguccgccugcucugagcugauucaggcuagcuccagaaucaccacauguucuaccgaaggcguuaacacgaaaugccggcucagcgggacagcccugauccgcgcuggauccgugggcgccgaggccugucuuaugcugaagggggucaaagaagaccaaaccaaguuucucaaaauuaagaccgugagcucugagcuguccugcagagagggacagagcuacuggacaggcucuuucucccccaaaugucugagcucucggagaugccaucuuguuggggaaugucacgugaaucgcugccucagcuggcgggauaacgagaccuccgcugaauuuagcuucgucggcgagucuacaacgaugagagaaaauaagugcuuugagcaguguggaggcugggggugcggauguuucaacgugaauccuuccugccuguuuguucauaccuaucugcagagcgugcgcaaggaggcgcuccgggucuucaacuguaucgacugggugcacaaacugacacuugaaauuaccgacuuugauggcuccgugucuacaaucgaccugggggccagcuccucuagauucaccaauuggggaagcgucucccucucucuggaugcugagggcauuagcggguccaacagcuuuucuuucaucgaaucccccggcaagggauacgccauuguugacgagccguucagcgagaucccucgccaaggcuuucugggggaaauccggugcaauucugaguccagcgugcuuucugcccacgaauccugucucagagcucccaaccugauuagcuauaaacccaugaucgaucagcuggagugcacgaccaaucucauugacccuuucguggucuuugaacgcggaucccugccgcagacacggaacgauaagaccuucgccgcgagcaaaggcaauagaggggugcaggcuuuuucuaagggaagcguucaagccgaccuuacacugauguucgauaacuuugagguggacuucgucggcgccgcuguguccugugaugccgcguuucucaaucugaccgggugcuacucuuguaacgcuggcgcccgcguuugccugagcaucacguccacaggaaccggcacacuuucugcccauaacaaggacgggagccuccacauugugcugcccuccgagaauggaaccaaagaucagugccagauccugcauuucaccgucccugaaguggaggaagaguuuauguauucuugugacggcgacgaacggccccuccugguuaaggggacacuuaucgcuauugauccuuucgacgauagacgggaggccggaggcgagagcacgguggucaaccccaaauccggcagcuggaacuuuuucgacugguucucugggcugauguccugguuuggaggcccucucaagaccauccugcugauuugccuuuacguggcucucagcaucgggcuguucuuucugcucauuuaccugggacgcacaggccuuucuaaaauguggcuggccgcgaccaagaaggccuccuga

SEQ ID NO: 14562 - RNA, 3204 nt, Artificial Sequence
  derived and/or modified CDS sequence (opt5) from RVFV(OS-1)__DQ380186.1__Gn-Gc
auggccggcaucgcuaugaccgugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaguugugcaaauccaggugucuggcgucuggaaaaagccucuuugcgugggguaugaacgcguuguggucaaaagagagcugagcgccaagcccauccagcggguggaaccuuguacgacaugcauuaccaaaugugagccccacggacucguugugcgcuccacaggcuuuaagaucagcucugccgucgcuugcgccuccggggugugugucaccggaagccaaucucccagcaccgagauuacacugaaguacccuggcaucucccagucuagcggcggggauauuggagugcauauggcgcacgacgaucaguccguuagcucuaaaaucguggcucauugcccgccccaggacccuugucuuguccacggcugcauugugugcgcccaugggcugaucaauuaucaaugucacacggcccucuccgcuuucguuguggucuucguguuuagcucuguggccaucauuugccuggcuauccuguacaagguucucaaaugucugaagauugcccccagaaaaguccuuaacccucugauguggaucaccgcguucauucgguggguguauaagaagaugguggcccgcgucgcugauaauaucaaccaggugaauagagaaaucggauggauggagggcgggcagcucgcccugggcaaccccgcuccgauuccucggcacgcccccaucccucgcuacuccacauaccuuaugcugcuccugauuguuagcuaugcguccgccugcucugaacugauccaggcuagcuccagaauuaccacauguucuaccgagggagugaacacgaaaugccggcucagcggcacagcccugauccgcgcuggguccgucggagccgaagccugucuuaugcugaagggcgugaaagaggaccaaaccaaguuucucaaaaucaagaccguuagcucugagcuguccugcagagaagggcagagcuacuggacaggaucuuucucccccaaaugucugagcucucggagaugccaucuugugggcgagugucacgucaaucgcugccucagcuggcgggauaacgaaaccuccgcugaguuuagcuucgugggggaaucuacaacgaugagagagaauaagugcuuugagcaguguggcggauggggcugcggguguuucaacguuaauccuuccugccuguuugugcauaccuaucugcagagcguccgcaaggaagcgcucaaaguguucaacuguauugacugggugcacaagcugacacuugagaucaccgacuuugauggauccgucucuacaauugaccugggcgccagcuccucucgguucaccaauugggggagcguuucccucucucuggaugcugaaggaaucagcggcuccaacagcuuuucuuucauugagucccccgggaaaggcuacgccaucguggacgagccguucagcgaaauuccuagacaaggauuucugggcgagauccgcugcaauucugaauccagcgugcuuucugcccacgaguccugucuccgggcucccaaccugaucagcuauaagcccaugauugaucagcuggaaugcacgaccaaucucaucgacccuuucgucguguuugagagagggucccugccgcagacacgcaacgauaaaaccuucgccgcgagcaagggaaaucggggcguucaggcuuuuucuaaggggagcgugcaagccgaccuuacacugauguucgauaacuuugaggucgacuucgugggagccgcuguuuccugugaugccgcguuucucaaucugaccggcugcuacucuuguaacgcuggggccagagugugccugagcauuacguccacaggcaccggaacacuuucugcccauaacaaagacggcagccuccacaucguccugcccuccgaaaaugggaccaaggaucagugccagauucugcauuucaccgugccugagguugaagaggaauuuauguauucuugugacggagacgagcgcccccuccuggugaaaggcacacuuaucgcuaucgauccuuucgacgaucggagagaggccgggggagaaagcacggucgugaaccccaaguccggcagcuggaacuuuuucgacugguucucuggccugauguccugguuugggggaccucucaaaaccauucugcugaucugccuuuacguggcucucagcauuggccuguucuuucugcucaucuaccuggggcggacaggacuuucuaagauguggcuggccgcgaccaagaaagccuccuga

SEQ ID NO: 14563 - RNA, 3204 nt, Artificial Sequence
  derived and/or modified CDS sequence (opt5) from RVFV(BIME-01)__KX609032.1__Gn-Gc
auggccggcaucgcuaugaccgugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucaaauccaggugucuggcguguggaaaaagccucuuugcgucggguaugaacgcgugguugugaaaagagagcugagcgccaagcccauucagcgggucgaaccuuguacgacaugcaucaccaaaugugagccccacggacucgugguucgcuccacaggcuuuaagauuagcucugccguggcuugcgccuccggggucugugugaccggaagccaaucucccagcaccgagaucacacugaaguacccuggcauuucccagucuagcggcggggauaucggaguccauauggcgcacgacgaucaguccgugagcucuaaaauuguugcucauugcccgccccaggacccuugucuugugcacggcugcaucgucugcgcccaugggcugaucaauuaucaaugucacacggcccucuccgcuuucgugguuguguucgucuuuagcucuguggccauuaucugccuggcuauucuguacaaggugcucagaugucugaaaaucgcccccaagaaaguucuuaacccucugauguggauuaccgcguucauccggugggucuauaagaagaugguggcccgcguggcugauaauaucaaccaggucaauagagaaauuggauggauggagggcgggcagcucgcccugggcaaccccgcuccgaucccucggcacgcccccauuccucgcuacuccacauaccuuaugcugcuccugaucauuagcuaugcguccgccugcucugaacugauccaggcuagcuccagaaucaccacauguucuaccgagggagugaacacgaaaugccggcucagcggcacagcccugauucgcgcuggguccguuggagccgaagccugucuuaugcugaagggcgugaaagaggaccaaaccaaguuucucaaaaucaagaccgucagcucugagcuguccugcagagaagggcagagcuacuggacaggaucuuucucccccaaaugucugagcucucggagaugccaucuugugggcgagugucacguuaaucgcugccucagcuggcgggauaacgaaaccuccgcugaguuuagcuucgugggggaaucuacaacgaugagagagaauaagugcuuugagcaguguggcggauggggcugcggguguuucaacgucaauccuuccugccuguuugugcauaccuaucugcagagcguucgcaaggaagcgcuccggguguucaacuguauugacuggguccacaaacugacacuugagaucaccgacuuugauggauccgugucuacaauugaccugggcgccagcuccucuagauucaccaauugggggagcgugucccucucucuggaugcugaaggaaucagcggcuccaacagcuuuucuuucauugagucccccgggaagggcuacgccaucgucgacgagccguucagcgaaaucccucgccaaggauuucugggcgagauucggugcaauucugaauccagcguucuuucugcccacgaguccugucucagagcucccaaccugaucagcuauaaacccaugauugaucagcuggaaugcacgaccaaucucaucgacccuuucgugguguuugagcgcgggucccugccgcagacacggaacgauaagaccuucgccgcgagcaaaggaaauagaggcguccaggcuuuuucuaaggggagcgugcaagccgaccuuacacugauguucgauaacuuugagguugacuucgugggagccgcugucuccugugaugccgcguuucucaaucugaccggcugcuacucuuguaacgcuggggcccgcgugugccugagcauuacguccacaggcaccggaacacuuucugcccauaacaaggacggcagccuccacaucguucugcccuccgaaaaugggaccaaagaucagugccagauccugcauuucaccgugccugaggucgaagaggaauuuauguauucuugugacggagacgagcggccccuccuggugaagggcacacuuauugcuaucgauccuuucgacgauagacgggaggccgggggagaaagcacgguugugaaccccaaauccggcagcuggaacuuuuucgacugguucucuggccugauguccugguuugggggaccucucaagaccauucugcugaucugccuuuacgucgcucucagcauuggccuguucuuucugcucaucuaccuggggcgcacaggacuuucuaaaauguggcuggccgcgaccaagaaggccuccuga

SEQ ID NO: 14564 - RNA, 3204 nt, Artificial Sequence
  derived and/or modified CDS sequence (opt5) from RVFV(73HB1449)__DQ380211.1__Gn-Gc
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucaaauccaggugucuggcguguggaaaaagccucuuugcgucggguaugaacgcgugguugugaaaagagagcugagcgccaagcccauucagcgggucgaaccuuguacgacaugcaucaccaaaugugagccccacggacucgugguucgcuccacaggcuuuaagauuagcucugccguggcuugcgccuccggggucugugugaccggaagccaaaaucccucuaccgagaucacacugaaguacccuggcauuagccaguccucuggcggggauaucggaguccauauggcgcacgacgaucagagcguguccagcaaaauuguugcucauugcccgccccaggacccuugucuugugcacggcugcaucgucugcgcccaugggcugaucaacuaucaaugucacacggcccucucugcuuucgugguuguguucgucuuuuccagcauugccaucauuugccuggcuauccuguacagagugcucaagugucugaaaauugcgccccggaaggugcuuaauccucugauguggaucaccgccuucauccgcuggguuuauaaaaagauggucgccagaguggcugauaacauuaaucaggugaaccgggaaaucggauggauggagggcgggcagcucguccugggcaaccccgccccgauuccucgccacgcucccaucccuagauacucuacauaccuuaugcugcuccugauuguguccuaugccagcgcgugcuccgaacugauccaggccucuagccggaucaccacauguuccaccgagggaguuaauacgaagugccgccucucuggcacagcucugauuagagccgggagcgugggagcugaagccugucuuaugcugaaaggcgucaaggacgaucaaaccaaauuucucaagaucaaaaccguguccagcgagcugucuugccgggaggggcaguccuacuggacaggcagcuucucucccaagugucuguccagcagacgcugccaucuuguuggagaaugucacgugaaccggugccucucuuggagagacaaugagaccagcgccgaauuuuccuucgucggggagagcacaacgaugcgcgaaaacaaaugcuuugagcaguguggcggauggggcugcggguguuucaaugugaacccuucuugccuguuuguucauaccuaucugcaguccgugcggaaggaggcucucagagucuucaauuguauugacugggugcacaagcugacacuugaaaucaccgauuuugacggaagcguguccacaauugaucugggcgcgucuagcucccgcuucaccaacugggggucugucagccucucccuggacgccgagggaaucucuggcagcaauuccuuuagcuucauugaaucucccgggaaaggcuacgcuaucguugaugagccguucuccgagaucccucggcaaggauuucugggcgaaauuagaugcaacagcgagucuuccgugcuuagcgcccacgaaucuugucuccgcgcccccaaucugaucuccuauaagcccaugauugaccagcuggagugcacgaccaaccucaucgauccuuucguggucuuugaacgggggagccugccgcagacaagaaaugagaaaaccuucgcugccuccaagggaaaccgcggcgugcaggcguuuagcaaagggucuguucaagcugaccuuacacugauguucgauaauuuugagguggacuucgucggagccgccgugagcugugaugcugccuuucucaaccugaccggcugcuacuccuguaacgcgggggcucggguuugccugucuauuacgagcacaggcaccggaacacuuuccgcccauaauaaggacggcucucuccacaucgugcugcccagcgaaaacgggaccaaggaucagugccagauccugcauuucaccgucccugagguggaagaggaauuuauguauuccugugacggagacgagagaccccuccugguuaaaggcacacuuauugccaucgauccuuucgacgaucggcgcgaggcugggggagaaucuacgguggucaaucccaagagcggcuccuggaacuuuuucgacugguucagcggccugaugucuugguuugggggaccucucaaaaccauucugcugaucugccuuuacguggcccucuccauuggccuguucuuucugcucaucuaccuggggagaacaggacuuagcaagauguggcuggcugccaccaaaaaggcgucuuga

SEQ ID NO: 14565 - RNA, 3204 nt, Artificial Sequence
  derived and/or modified CDS sequence (opt5) from RVFV(SA01-1322)__KX096942.1__Gn-Gc
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuuuuguagccacgcuaacggguccggaaucguucaaauccaggugucuggcguguggaaaaagccucuuugcgucggguacgaacgcgugguugugaaaagagagcugagcgccaagcccauucagcgggucgaaccuuguacgacaugcaucaccaaaugugagccccacggacucgugguucgcuccacaggcuucaagauuagcucugccguggcuugcgccuccggggucugugugaccggaagccaaucucccagcaccgagaucacacugaaguauccuggcauuucccagucuagcggcggggauaucggaguccauauggcgcacgacgaucaguccgugagcucuaaaauuguugcucauugcccgccccaggacccuugucuugugcacggcugcaucgucugcgcccaugggcugaucaauuaccaaugucacacggcccucuccgcuuucgugguuguguuugucuucagcucuauugccaucauuugccuggcuauccuguauagagugcucaagugucugaaaauugcgccccggaaggugcuuaacccucugauguggaucaccgccuuuauccgcuggguuuacaaaaagauggucgccagaguggcugauaauauuaaccaggugaaucgggaaaucggauggauggagggcgggcagcucguccugggcgaccccgccccgauuccucgccacgcucccaucccuagauauuccacauaccuuaugcugcuccugauuaucagcuacgccuccgcgugcucugaacugauccaggccagcucccggauuaccacauguucuaccgagggagugaacacgaagugccgccucagcggcacagcucugaucagagccggguccguuggagcugaagccugucuuaugcugaaaggcgugaaggaggaucaaaccaaauuccucaagauuaaaaccgucagcucugagcuguccugccgggaagggcagagcuauuggacaggaucuuuuucccccaagugucugagcucuagacgcugccaucuugugggcgagugucacguuaaccggugccucagcuggagagacaaugaaaccuccgccgaguucagcuuugugggggaaucuacaacgaugcgcgagaacaaaugcuucgagcaguguggcggauggggcugcggguguuuuaaugucaacccuuccugccuguucgugcauaccuaccugcagagcguucggaaggaagcucucagaguguuuaauuguaucgacuggguccacaagcugacacuugagauuaccgauuucgacggauccgugucuacaaucgaucugggcgcgagcuccucucgcuuuaccaacugggggagcgugucccucucucuggacgccgaaggaauuagcggcuccaauagcuucucuuucaucgagucccccgggaaaggcuaugcuaucgucgaugagccguuuagcgaaauuccucggcaaggauuccugggcgagaucagaugcaacucugaauccagcguucuuucugcccacgaguccugucuccgcgcccccaaucugauuagcuacaagcccaugaucgaccagcuggaaugcacgaccaaccucauugauccuuuugugguguucgagcgggggucccugccgcagacaagaaaugagaaaaccuuugcugccagcaagggaaaccgcggcguccaggcguucucuaaagggagcgugcaagcugaccuuacacugauguuugauaauuucgaaguugacuuugugggagccgccgucuccugugaugcugccuuccucaaccugaccggcugcuauucuuguaaugcgggggcucgggugugccugagcaucacguccacaggcaccggaacacuuucugcccauaacaaggacggcagccuccacaucguucugcccuccgagaacgggaccaaggaucagugccagauucugcauuuuaccgugccugaagucgaggaagaguucauguacucuugugacggagacgagagaccccuccuggugaaaggcacacuuaucgccauugauccuuuugacgaucggcgcgaagcugggggagagagcacgguugugaaucccaaguccggcagcuggaacuucuucgacugguuuucuggccugauguccugguucgggggaccucucaaaaccauccugcugauuugccuuuaugucgcccucagcaucggccuguuuuuccugcucaucuaccuggggagaacaggacuuucuaagauguggcuggcugccaccaaaaaggcguccuga

SEQ ID NO: 14566 - RNA, 3204 nt, Artificial Sequence
  derived and/or modified CDS sequence (opt5) from RVFV(Sudan 2V-2007)__JQ820490.1__Gn-Gc
auggccggcaucgcuaugaccgugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucaaauccaggugucuggcguguggaaaaagccucuuugcgucggguaugaacgcgugguugugaaaagagagcugagcgccaagcccauucagcgggucgaaccuuguacgacaugcaucaccaaaugugagccccacggacucgugguucgcuccacaggcuuuaagauuagcucugccguggcuugcgccuccggggucugugugaccggaagccaaucucccagcaccgagaucacacugaaguacccuggcauuucccagucuagcggcggggauaucggaguccauauggcgcacgacgaucaguccgugagcucuaaaauuguugcucauugcccgccccaggacccuuguuccgugcacggcugcaucgucugcgcccaugggcuuaucaauuaucaaugucacacggcccugagcgcuuucgugguuguguucgucuuuucuuccauugccaucauuugccucgcuauccuguacagagugcugaagugucucaaaauugcgccccggaaggugcugaacccucuuauguggaucaccgccuucauccgcuggguuuauaaaaagauggucgccagaguggcugauaauauuaaccaggugaaucgggaaaucggauggauggagggcgggcagcugguccucggcaaccccgccccgauuccucgccacgcucccaucccuagauacagcacauaccugaugcuucugcucauugugucccaugccucugcgugcagcgaacugauccaggccuccucucggaucaccacauguagcaccgagggaguuaacacgaagugccgccuguccggcacagcucucauuagagccgggagcgugggagcugaagccugucugaugcuuaaaggcgucaaggaggaccaaaccaaauuucugaagaucaaaaccgugucuuccgagcucagcugccgggaagggcagucuuauuggacaggauccuucagccccaagugucugucuagcagacgcugccaccugguuggcgagugucaugugaaucggugccuuuccuggagagauaacgaaaccagcgccgaguuuucuuucgucggggaauccacaacgaugcgcgagaauaaaugcuuugagcaguguggcggauggggcugcggguguuucaacgugaauccuagcugccucuuuguucacaccuaccugcaguccgugcggaaggaagcucugagagucuucaacuguauugacugggugcacaagcucacacuggagaucaccgacuuugauggaucugugagcacaauugaccuuggcgcguccucuagccgcuucaccaauuggggguccgucucucugagccucgaugccgaaggaaucuccggcagcaacucuuuuuccuucauugagagccccgggaaaggcuaugcuaucguugacgagccguucucugaaaucccucggcaaggauuucugggcgagauuagaugcaauuccgaaagcucugugcuguccgcccaugagagcugucuucgcgcccccaaccucaucuccuacaagcccaugauugaucagcuggaaugcacgaccaaucugaucgacccuuucguggucuuugagcgggggagccucccgcagacaagaaacgauaaaaccuucgcugccucuaagggaaaucgcggcgugcaggcguuuagcaaaggguccguucaagcugaccugacacuuauguucgauaacuuugagguggacuucgucggagccgccgugucuugugaugcugccuuucugaaucucaccggcugcuauagcuguaacgcgggggcucggguuugccuguccauuacgucuacaggcaccggaacacugagcgcccacaacaaggacggcucccuucauaucgugcuccccucugaaaaugggaccaaggaucagugccagauccugcacuucaccgucccugagguggaagaggaauuuauguacagcugugacggagacgagagaccccugcucguuaaaggcacacugauggccauugauccuuucgacgaucggcgcgaggcugggggagaauccacgguggucaaccccaagagcggcucuuggaacuuuuucgacugguucuccggccuuaugagcugguuugggggaccucugaaaaccauccuccugauuugccuguauguggcccuuucuaucggccucuucuuucugcugauuuaccucgggagaacaggacuguccaagauguggcuugcugccaccaaaaaggcgagcuga

SEQ ID NO: 14567 - RNA, 3204 nt, Artificial Sequence
  derived and/or modified CDS sequence (opt5) from RVFV(35/74)__JF784387.1__Gn-Gc
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaguugugcaaauccaggugucuggcgucuggaaaaagccucuuugcgugggguaugaacgcguuguggucaaaagagagcugagcgccaagcccauccagcggguggaaccuuguacgacaugcauuaccaaaugugagccccacggacucguugugcgcuccacaggcuuuaagaucagcucugccgucgcuugcgccuccggggugugugucaccggaagccaaucucccagcaccgagauuacacugaaguacccuggcaucucccagucuagcggcggggauauuggagugcauauggcgcacgacgaucaguccguuagcucuaaaaucguggcucauugcccgccccaggacccuugucuuguccacggcugcauugugugcgcccaugggcugaucaauuaucaaugucacacggcccucuccgcuuucguuguggucuucguguuuagcucuguggccaucauuugccuggcuauccuguacaagguucucaaaugucugaagauugcccccagaaaaguccuugauccucugauguggaucaccguguucauucgguggguguauaagaagauggucgcgcgcguggccgacaacaucaaucagguuaacagagaaaucggauggauggagggcgggcagcucgcucugggcaaucccgccccgauuccucggcacgcucccaucccucgcuacuccacauaccuuaugcugcuccugauugugagcuaugccuccgcgugcucugaacugauccaggccagcuccagaauuaccacauguucuaccgagggagucaacacgaaaugccggcucagcggcacagcucugauccgcgccggguccgugggagcugaagccugucuuaugcugaagggcguuaaagaggaucaaaccaaguuucucaaaaucaagaccgugagcucugagcuguccugcagagaagggcagagcuacuggacaggaucuuucucccccaaaugucugagcucucggagaugccaucuugucggcgagugucacgugaaccgcugccucagcuggcgggacaaugaaaccuccgccgaguuuagcuucguuggggaaucuacaacgaugagagagaacaagugcuuugagcaguguggcggauggggcugcggguguuucaaugugaacccuuccugccuguuuguccauaccuaucugcagagcgugcgcaaggaagcucuccggguguucaauuguauugacuggguccacaaacugacacuugagaucaccgauuuugacggauccguuucuacaauugaucugggcgcgagcuccucuagauucaccaacugggggagcgugucccucucucuggacgccgaaggaaucagcggcuccaauagcuuuucuuucauugagucccccgggaagggcuacgcuaucguggaugagccguucagcgaaauuccucgccaaggauuucugggcgagauccggugcaacucugaauccagcguccuuucugcccacgaguccugucucagagcccccaaucugaucagcuauaaacccaugauugaccagcuggaaugcacgaccaaccucaucgauccuuucgugguuuuugagcgcgggucccugccgcagacacggaaugacaagaccuucgcugccagcaaaggaaacagaggcgugcaggcguuuucuaaggggagcguccaagcugaucuuacacugauguucgacaauuuugagguggauuucguuggagccgccguguccugugacgcugccuuucucaaccugaccggcugcuacucuuguaaugcgggggcucgcgucugccugagcauuacguccacaggcaccggaacacuuucugcccauaacaaggauggcagccuccacaucgugcugcccuccgaaaacgggaccaaagaccagugccagauucugcauuucaccguuccugagguggaagaggaauuuauguauucuugugacggagaugagcggccccuccuggucaagggcacacuuaucgccaucgacccuuucgaugacagacgggaggcugggggagaaagcacgguggugaaucccaaauccggcagcuggaacuuuuucgauugguucucuggccugauguccugguuugggggaccucucaagaccauucugcugaucugccuuuacgucgcccucagcauuggccuguucuuucugcucaucuaccuggggcgcacaggacuuucuaaaauguggcuggcugccaccaagaaggcguccuga

SEQ ID NO: 14568 - RNA, 3204 nt, Artificial Sequence
  derived and/or modified CDS sequence (opt5) from RVFV(200803169)__JF311384.1__Gn-Gc
auggccggcaucgcuaugacagugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucaaauccaggugucuggcguguggaaaaagccucuuugcgucggguaugaacgcgugguugugaaaagagagcugagcgccaagcccauucagcgggucgaaccuuguacgacaugcaucaccaaaugugagccccacggacucgugguucgcuccacaggcuuuaagauuagcucugccguggcuugcgccuccggggucugugugaccggaagccaaucucccagcaccgagaucacacugaaguacccuggcauuucccagucuagcggcggggauaucggaguccauauggcgcacgacgaucaguccgugagcucuaaaauuguugcucauugcccgccccaggacccuugucuugugcacggcugcaucgucugcgcccaugggcugaucaauuaucaaugucacacggcccucuccgcuuucgugguuauuuucguguuuagcucuaccgccaucauuugccuggcuguccuguacagagugcucaagugucugaaaaucgcgccccggaaggugcuuaacccucugauguggauuacagccuucauccgcuggguuuauaaaaagauggucgccagaguggcugauaauaucaaccaggugaaucgggaaauuggauggauggagggcgggcagcucgcccugggcaaccccgcuccgaucccucgccacgcccccauuccuagauacuccaccuaccuuaugcugcuccugaucgucagcuaugcguccgccugcucugaacugauucaggcuagcucccggaucacaaccuguucuacggagggagugaacacaaagugccgccucagcggcaccgcccugaucagagcuggguccguuggagccgaagccugucuuaugcugaaaggcgugaaggucgaccaaaccaaauuucucaagauuaaaacagugagcucugagcuguccugccgggaggggcagagcuacuggaccggaucuuucucccccaagugucugagcucuagacgcugccaucuuguuggcgaaugucacgugaaucggugccucagcuggagagauaacgagacauccgcugaauuuagcuucgucggggagucuacgaccaugcgcgaaaauaaaugcuuugagcaguguggcggauggggcugcggguguuucaacgugaauccuuccugccuguuuguucauacauaucugcagagcgugcggaaggaggcgcucagagucuucaacuguaucgacugggugcacaagcugacccuugaaauuacagacuuugauggauccgugucuaccaucgaccugggcgccagcuccucucgcuucacgaauugggggagcgucucccucucucuggaugcugagggaauuagcggcuccaacagcuuuucuuucaucgaaucccccgggaaaggcuacgccauuguugacgagccguucagcgagaucccucggcaaggauuucugggcgaagugagaugcaauucugaguccagcgugcuuucugcccacgaauccugucuccgcgcucccaaccuggucagcuauaagcccaugaucgaucagcuggagugcaccacaaaucucauugacccuuucgugguuuuugaacgggggucccugccgcagaccagaaacgauaaaacauucgccgcgagcaagggaaaucgcggcgugcaggcuuuuucuaaagggagcguccaagccgaccuuacccugauguucgauaacuuugagguggacuucguuggagccgcuguguccugugaugccgcguuucucaaucugacgggcugcuacucuuguaacgcuggggcccgggucugccugagcaucacauccaccggcacaggaacccuuucugcccauaacaaggacggcagccuccacauugugcugcccuccgagaaugggaccaaggaucagugccagauccugcauuucacaguuccugaaguggaggaagaguuuauguauucuugugacggagacgaaagaccccuccuggucaaaggcacgcuuauugcuaucgauccuuucgacgaucggcgcgaggccgggggagagagcaccguggugaaccccaaguccggcagcuggaacuuuuucgacugguucucuggccugauguccugguuugggggaccucucaaaacaauccugcugauuugccuuuacgucgcucucagcaucggccuguucuuucugcucauuuaccuggggagaaccggacuuucuaagauguggcuggccgcgaccaaaaaggccuccuga

SEQ ID NO: 14569 - RNA, 3204 nt, Artificial Sequence
  derived and/or modified CDS sequence (opt5) from RVFV(2269/74)__DQ380222.1__Gn-Gc
auggccggcaucgcuaugaccgugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaacauaagggaacaauggacucuggccagaccaaacgggaacugaaguccuuugauaucagccagugcccgaaaauugggggacacggcucuaagaagugcacaggcgacgcugccuucuguuccgccuacgagugcaccgcucaguacgcgaaugccuauuguagccacgcuaacggguccggaaucguucaaauccaggugucuggcguguggaaaaagccucuuugcgucggguacgaacgcgugguugugaaaagagagcugagcgccaagcccauucagcgggucgaaccuuguacgacaugcaucaccaaaugugagccccauggacucgugguucgcuccacaggcuuuaagauuagcucugccguggcuugcgccuccggggucugugugaccggaagccaaucucccagcaccgagaucacacugaaguauccuggcauuucccagucuagcggcggggauaucggaguccacauggcgcaugacgaucaguccgugagcucuaaaauuguugcucacugcccgccccaggacccuugucuugugcauggcugcaucgucugcgcccacgggcugaucaauuaccaaugucacacggcccucuccgcuuucgugguuguguucgucuuuagcucuguggccauuaucugccuggcuauucuguauaaggugcucaaaugucugaagaucgcccccaaaaagguucuuaacccucugauguggauuaccgcguucaucagaugggucuacaagaaaaugguggcccggguggcugauaauaucaaccaggucaaucgcgaaauuggauggauggagggcgggcagcucgcccugggcaaccccgcuccgaucccuagacaugcccccauuccucgguauuccacauaccuuaugcugcuccugaucgugagcuacgcguccgccugcucugaacugauucaggcuagcucccgcaucaccacauguucuaccgagggaguuaacacgaagugcagacucagcggcacagcccugauccgggcuggguccgugggagccgaagccugucuuaugcugaaaggcgucaaggaggaccaaaccaaauuucucaagauuaaaaccgugagcucugagcuguccugccgcgaagggcagagcuauuggacaggaucuuucucccccaagugucugagcucuagacggugccaccuuguuggcgagugucaugugaauagaugccucagcuggcgcgauaacgaaaccuccgcugaguuuagcuucgucggggaaucuacaacgaugcgggagaauaagugcuuugagcaguguggcggauggggcugcggguguuucaacgugaauccuuccugccuguuuguucacaccuaccugcagagcgugagaaaagaagcgcuccgcgucuucaacuguaucgacugggugcacaagcugacacuugagauuaccgacuuugauggauccgugucuacaaucgaccugggcgccagcuccucucgguucaccaauugggggagcgucucccucucucuggaugcugaaggaauuagcggcuccaacagcuuuucuuucaucgagucccccgggaaaggcuaugccauuguugacgagccguucagcgaaaucccuagacaaggauuucugggcgagauccgcugcaauucugaauccagcgugcuuucugcccaugaguccugucuccgggcucccaaccugauuagcuacaagcccaugaucgaucagcuggaaugcacgaccaaucucauugacccuuucguggucuuugagagagggucccugccgcagacacgcaacgauaaaaccuucgccgcgagcaagggaaaucggggcgugcaggcuuuuucuaaggggagcguucaagccgaccuuacacugauguucgauaacuuugagguggacuucgucggagccgcuguguccugugaugccgcguuucucaaucugaccggcugcuauucuuguaacgcuggggccagaguuugccugagcaucacguccacaggcaccggaacacuuucugcccacaacaaagacggcagccuccauauugugcugcccuccgaaaaugggaccaaggaucagugccagauccugcacuucaccgucccugagguggaagaggaauuuauguacucuugugacggagacgagcgcccccuccugguuaaaggcacacuuaucgcuauugauccuuucgacgaucggagagaggccgggggagaaagcacgguggucaaccccaaguccggcagcuggaacuuuuucgacugguucucuggccugauguccugguuugggggaccucucaaaaccauccugcugauuugccuuuauguggcucucagcaucggccuguucuuucugcucauuuaccuggggcggacaggacuuucuaagauguggcuggccgcgaccaagaaagccuccuga

SEQ ID NO: 14570 - RNA, 3204 nt, Artificial Sequence
  derived and/or modified CDS sequence (opt5) from RVFV(SA-51 (Van Wyck))__DQ380195.1__Gn-Gc
auggccggcaucgcuaugaccgugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacgcggcucuaagaagugcacaggcgacgcugccuucuguuccgccuacgagugcaccgcucaguaugcgaaugccuacuguagccaugcuaacggguccggaaucguucaaauccaggugucuggcguguggaaaaagccucuuugcgucggguaugaaagagugguugugaaacgggagcugagcgccaagcccauucagcgcgucgaaccuuguacgacaugcaucaccaaaugugagccccacggacucgugguuagauccacaggcuuuaagauuagcucugccguggcuugcgccuccggggucugugugaccggaagccaaucucccagcaccgagaucacacugaaguacccuggcauuucccagucuagcggcggggauaucggaguccacauggcgcaugacgaucaguccgugagcucuaaaauuguugcucacugcccgccccaggacccuugucuugugcauggcugcaucgucugcgcccacgggcugaucaauuaucaaugucauacggcccucuccgcuuucgugguuguguucgucuuuagcucuguggccauuaucugccuggcuauucuguacaaggugcucaaaugucugaagaucgcgccccggaaaguucuuaacccucugauguggauuaccgccuucauccgcugggucuauaagaagaugguggccagaguggcugauaauaucaaccaggucaaucgggaaauuggauggauggagggcgggcagcucgcccugggcaaccccgcuccgaucccucgccacgcccccauuccuagauacuccacauaccuuaugcugcuccugaucgugagcuaugcguccgccugcucugaacugauucaggcuagcucccggaucaccacauguucuaccgagggaguuaacacgaaaugccgccucagcggcacagcccugaucagagcuggguccgugggagccgaagccugucuuaugcugaagggcgucaaagaggaccaaaccaaguuucucaaaauuaagaccgugagcucugagcuguccugccgggaagggcagagcuacuggacaggaucuuucucccccaaaugucugagcucuagacgcugccaccuuguuggcgagugucaugugaaucggugccucagcuggagagauaacgaaaccuccgcugaguuuagcuucgucggggaaucuacaacgaugcgcgagaauaagugcuuugagcaguguggcggauggggcugcggguguuucaacgugaauccuuccugccuguuuguucacaccuaucugcagagcgugcggaaggaagcgcucagagucuucaacuguaucgacugggugcauaaacugacacuugaggugaccgacuuugauggauccgucucuacaauugaccugggcgccagcuccucucgcuucaccaauugggggagcguuucccucucucuggaugcugaaggaaucagcggcuccaacagcuuuucuuucauugagucccccgggaagggcuacgccaucguggacgagccguucagcgaaauuccucggcaaggauuucugggcgagaucagaugcaauucugaauccagcgugcuuucugcccacgaguccugucuccgcgcucccaaccugaucagcuauaaacccaugauugaucagcuggaaugcacgaccaaucucaucgacccuuucgucguguuugagcgggggucccugccgcagacaagaaacgauaagaccuucgccgcgagcaaaggaaaucgcggcguucaggcuuuuucuaaggggagcgugcaagccgaccuuacacugauguucgauaacuuugaggucgacuucgugggagccgcuguuuccugugaugccgcguuucucaaucugaccggcugcuacucuuguaacgcuggggcccgggugugccugagcauuacguccacaggcaccggaacacuuucugcccacaacaaggacggcagccuccauaucguccugcccuccgaaaaugggaccaaagaucagugccagauucugcacuucaccgugccugagguugaagaggaauuuauguauucuugugacggagacgagagaccccuccuggugaagggcacacuuaucgcuaucgauccuuucgacgaucggcgcgaggccgggggagaaagcacggucgugaaccccaaauccggcagcuggaacuuuuucgacugguucucuggccugauguccugguuugggggaccucucaagaccauucugcugaucugccuuuacguggcucucagcauuggccuguucuuucugcucaucuaccuggggagaacaggacuuucuaaaauguggcuggccgcgaccaagaaggccuccuga

SEQ ID NO: 14571 - RNA, 3204 nt, Artificial Sequence
  derived and/or modified CDS sequence (opt5) from RVFV(OS-8)__DQ380185.1__Gn-Gc
auggccggcaucgcuaugacagugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaguugugcaaauccaggugucuggcgucuggaaaaagccucuuugcgugggguaugaacgcguuguggucaaaagagagcugagcgccaagcccauccagcggguggaaccuuguacgacaugcauuaccaaaugugagccccacggacucguugugcgcuccacaggcuuuaagaucagcucugccgucgcuugcgccuccggggugugugucaccggaagccaaucucccagcaccgagauuacacugaaguacccuggcaucucccagucuagcggcggggauauuggagugcauauggcgcacgacgaucaguccguuagcucuaaaaucguggcucauugcccgccccaggacccuugucuuguccacggcugcauugugugcgcccaugggcugaucaauuaucaaugucacacggcccucuccgcuuucguuguggucuucguguuuagcucuguggccaucauuugccuggcuauccuguacaagguucucaaaugucugaagauugcccccagaaaaguccuuaacccucugauguggaucaccgcguucauucgguggguguauaagaagaugguggcccgcgucgcugauaauaucaaccaggugaauagagaaaucggauggauggagggcgggcagcucgcccugggcaaccccgcuccgauuccucggcacgcccccaucccucgcuacuccacauaccuuaugcugcuccugauuguuagcuaugcguccgccugcucugaacugauccaggcuagcuccagaauuaccacauguucuaccgagggagugaacacgaaaugccggcucagcggcacagcccugauccgcgcuggguccgucggagccgaagccugucuuaugcugaagggcgugaaagaggaccaaaccaaguuucucagaaucaaaaccguuagcucugagcuguccugccgggaagggcagagcuacuggacaggaucuuucucccccaagugucugagcucuagacgcugccaucuugugggcgagugucacgucaaucggugccucagcuggagagauaacgaaaccuccgcugaguuuagcuucgugggggaaucuacaacgaugcgcgagaauaaaugcuuugagcaguguggcggauggggcugcggguguuucaacguuaauccuuccugccuguuugugcauaccuaucugcagagcguccggaaggaagcgcucagaguguucaacuguauugacugggugcacaagcugacacuugagaucaccgacuuugauggauccgucucuacaauugaccugggcgccagcuccucucgcuucaccaauugggggagcguuucccucucucuggaugcugaaggaaucagcggcuccaacagcuuuucuuucauugagucccccgggaaaggcuacgccaucguggacgagccguucagcgaaauuccucggcaaggauuucugggcgagaucagaugcaauucugaauccagcgugcuuucugcccacgaguccugucuccgcgcucccaaccugaucagcuauaagcccaugauugaucagcuggaaugcacgaccaaucucaucgacccuuucgucguguuugagcgggggucccugccgcagacaagaaacgauaaaaccuucgccgcgagcaagggaaaucgcggcguucaggcuuuuucuaaagggagcgugcaagccgaccuuacacugauguucgauaacuuugaggucgacuucgugggagccgcuguuuccugugaugccgcguuucucaaucugucuggcugcuacagcuguaacgcuggggcccgggugugccuguccauuaccucuacgggcacaggaacccuuagcgcccauaacaaggacggcucccuccacaucguccugcccucugaaaaugggacaaaggaucagugccagauucugcauuucaccgugccugagguugaagaggaauuuauguauagcugugacggagacgagagaccccuccuggugaaaggcacccuuaucgcuaucgauccuuucgacgaucggcgcgaggccgggggagaauccacagucgugaaccccaagagcggcucuuggaacuuuuucgacugguucuccggccugaugagcugguuugggggaccucucaaaacgauucugcugaucugccuuuacguggcucucucuauuggccuguucuuucugcucaucuaccuggggagaaccggacuuuccaagauguggcuggccgcgaccaaaaaggccagcuga

SEQ ID NO: 14572 - RNA, 3204 nt, Artificial Sequence
  derived and/or modified CDS sequence (opt5) from RVFV(KEN07-KUR340)__EF460404.1__Gn-Gc
auggccggcaucgcuaugaccgugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucaaauccaggugucuggcguguggaaaaagccucuuugcgucggguaugaacgcgugguugugaaaagagagcugagcgccaagcccauucagcgggucgaaccuuguacgacaugcaucaccaaaugugagccccacggacucgugguucgcuccacaggcuuuaagauuagcucugccguggcuugcgccuccggggucugugugaccggaagccaaucucccagcaccgagaucacacugaaguacccuggcauuucccagucuagcggcggggauaucggaguccauauggcgcacgacgaucaguccgugagcucuaaaauuguugcucauugcccgccccaggacccuugucuugugcacggcugcaucgucugcgcccaugggcugaucaauuaucaaugucacacggcccucuccgcuuucgugguuauuuucguguuuagcucuaccgccaucauuugccuggcuguccuguacagaaugcucaagugucugaaaaucgcgccccggauugugcuuaacccucugauguggaucacagccuucauccgcuggguguauaagaaaaugguugccagagucgcugauaauauuaaccaggugaaucgggaaaucggauggauggagggcgggcagcucgcccugggcaaccccgcuccgauuccucgccacgcccccaucccuagauacuccaccuaccuuaugcugcuccugauugugagcuaugcguccgccugcucugaacugauccaggcuagcucccggaucacaaccuguucuacggagggagucaacacaaagugccgccucagcggcaccgcccugauuagagcuggguccgugggagccgaagccugucuuaugcugaagggcguuaaagaggaccaaaccaaguuucucaaaaucaagacagugagcucugagcuguccugccgggaagggcagagcuacuggaccggaucuuucucccccaaaugucugagcucuagacgcugccaucuugucggcgagugucacgugaaucggugccucagcuggagagauaacgaaacauccgcugaguuuagcuucguuggggaaucuacgaccaugcgcgagaauaagugcuuugagcaguguggcggauggggcugcggguguuucaacgugaauccuuccugccuguuuguccauacauaucugcagagcgugcggaaagaagcgcucagaguuuucaacuguauugacugggugcacaagcugacccuugagaucacagacuuugauggauccgucucuaccauugaccugggcgccagcuccucucgcuucacgaauugggggagcgugucccucucucuggaugcugaaggaaucagcggcuccaacagcuuuucuuucauugagucccccgggaagggcuacgccaucguggacgagccguucagcgaaaucccucggcaaggauuucugggcgagauuagaugcaauucugaauccagcguccuuucugcccacgaguccugucuccgcgcucccaaccugguuagcuauaaacccaugaucgaucagcuggaaugcaccacaaaucucauugacccuuucgugguguuugagcgggggucccugccgcagaccagaaacgauaagacauucgccgcgagcaaaggaaaucgcggcguccaggcuuuuucuaaggggagcgugcaagccgaccuuacccugauguucgauaacuuugagguugacuucgugggagccgcugucuccugugaugccgcguuucucaaucugacgggcugcuacucuuguaacgcuggggcccgggugugccugagcaucacauccaccggcacaggaacccuuucugcccauaacaaagacggcagccuccacauuguucugcccuccgaaaaugggaccaaggaucagugccagauccugcauuucacagugccugaggucgaagaggaauuuauguauucuugugacggagacgagagaccccuccuggugaagggcacgcuuaucgcuauugauccuuucgacgaucggcgcgaggccgggggagaaagcaccguugugaaccccaaauccggcagcuggaacuuuuucgacugguucucuggccugauguccugguuugggggaccucucaagacaauccugcugauuugccuuuacgucgcucucagcaucggccuguucuuucugcucauuuaccuggggagaaccggacuuucuaaaauguggcuggccgcgacaaagaaagccuccuga

SEQ ID NO: 14573 - RNA, 3204 nt, Artificial Sequence
  derived and/or modified CDS sequence (opt5) from RVFV(ANK-3837)__DQ380215.1__Gn-Gc
auggccggcaucgcuaugaccgugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaaaacuggacucuggccagacaaagcgggaacuuaaauccuuugauaucagccagugcccgaagauugggggacauggcucuaagaaaugcaccggcgacgcugccuucuguuccgccuacgagugcacagcucaguaugcgaaugccuacuguagccacgcuaacggguccggaaucguucaaauccaggugucuggcguguggaagaaaccucugugcgucggguaugaacgcgugguugugaagagagagcucagcgccaaacccauucagcgggucgaaccuuguaccacgugcaucacaaagugugagccccacggacuggugguucgcuccaccggcuuuaagauuagcucugccguggcuugcgccuccggggucugugugacaggaagccaaucucccagcaccgagaucacccuuaaauacccuggcauuucccagucuagcggcggggauaucggaguccauauggcgcacgacgaucaguccgugagcucuaagauuguugcucauugcccgccccaggacccuugucuggugcacggcugcaucgucugcgcccaugggcucaucaauuaucaaugucacacagcccuguccgcuuucgugguuguguucgucuuuagcucuauugccaucauuugccuggcuauccucuacagagugcugaaaugucuuaagauugcuccccggaaagugcugaacccucucauguggaucacggcguucauccgcuggguuuauagaaagauggucgcccggguggcugauaauauuaaccaggugaaucgcgaaaucggauggauggagggcgggcagcugguccuuggcaaccccgccccgauuccuagacacgugcccaucccucgguacuccaccuaccugaugcuccugcugauuguuagcuaugcuuccgccugcucugaacucauccaggcgagcucccgcaucacaaccuguucuacagagggagugaacaccaagugcagacugagcggcacggcccuuauucgggcuggguccgucggagccgaagccugucugaugcucaaaggcgugaaggaggaccaaacaaaauuucugaagaucaaaaccguuagcucugagcuguccugcagagaagggcagagcuacuggaccggaucuuucucccccaagugucuuagcucucgccggugccaucucgugggcgagugucacgucaauagaugccugagcuggcgcgauaacgaaacauccgccgaguuuagcuucgugggggaaucuaccacaaugcgggagaauaaaugcuuugagcaguguggcggauggggcugcggguguuucaacguuaauccuuccugccuguuugugcauacguaucuccagagcgucagaaaggaagcccugcgcguguucaacuguauugacugggugcacaaacuuacccuggagaucacagacuuugauggauccgucucuaccauugaccucggcgcuagcuccucucgguucacaaauugggggagcguuucccugucucuggaugcggaaggaaucagcggcuccaacagcuuuucuuucauugagucccccgggaagggcuacgccaucguggacgagccguucagcgaaaucccuagacaaggauuucuuggcgagauucgcugcaauucugaauccagcgugcucucugcucacgaguccugucugcgggcccccaaccugaucagcuauaagcccaugauugaucagcucgaaugcaccacgaaucugaucgacccuuucgucguguuugagagagggucccuuccgcagacccgcaacgauaaaacauucgccgcuagcaagggaaaucggggcguucaggccuuuucuaaagggagcgugcaagcggaccugacccucauguucgauaacuuugaggucgacuucgugggagcugccguuuccugugaugccgcuuuucugaaucugacaggcugcuacucuuguaacgccggggcgagagugugccuuagcauuaccuccacgggcacaggaacccucucugcucauaacaaggacggcagccugcacaucguccugcccuccgaaaaugggacaaaggaucagugccagauccuccauuucaccgugccugagguugaagaggaauuuauguauucuugugacggagacgagcggccccugcuugugcgcggcacccugauugccaucgauccuuucgacgauagacgggaggccgggggagaaagcacagucgugaaccccaaauccggcagcuggaacuuuuucgacugguucucuggccucauguccugguuugggggaccucugaagacgauucugcuuaucugccucuacguggcucugagcauuggccuguucuuucuccugaucuaccuugggagaaccggacugucuaaaauguggcucgccgcuacaaagaaagccuccuga

SEQ ID NO: 14574 - RNA, 3204 nt, Artificial Sequence
  derived and/or modified CDS sequence (opt5) from RVFV(Lunyo)__KU167026.1__Gn-Gc
auggccggcaucgcuaugaccgugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaaugguuucuggccagaccaaacgggaacugaaguccuuugacaucagccagugcccgaaaauugggggacauggcucuaagaagugcacaggcgaugcugccuucuguuccgccuacgagugcaccgcucaguaugcgaaugccuacuguagccacgcuaacggguccggaaucgugcaaauccaggugucuggcgucuggaaaaagccucuuugcgugggguaugaacgcguuguggucaaaagagagcugagcgccaagcccauucagcggguggaaccuuguacgacaugcaucaccaaaugugagccccacggacucguugugcgcuccacaggcuuuaagauuagcucugccgucgcuugcgccuccggggugugugucaccggaagccaaucucccagcaccgagaucacacugaaguacccuggcauuucccagucuagcggcggggacaucggagugcauauggcgcacgaugaccaguccguuagcucuaaaauuguggcucauugcccgccccaggauccuugucuuguccacggcugcaucgugugcgcccaugggcugaucaauuaucaaugucacacggcccucuccgcuuucguuguggucuucguguuuagcucuguggccauuaucugccuggcuauucuguacaagguucucaaaugucugaagaucgcccccagaaaaguccuuaacccucugauguggauuaccgcguucauccgguggguguauaagaagaugguggcccgcgucgcugacaauaucaaccaggugaauagagaaauuggauggauggagggcgggcagcucgcccugggcaaccccgcuccgaucccucggcacgcccccauuccucgcuacuccacauaccuuaugcugcuccugaucguuagcuaugcguccgccugcucugaacugauucaggcuagcuccagaaucaccacauguucuaccgagggagugaacacgcggugccgccucagcggcacagcccugaucagagcuggguccgucggagccgaagccugucuuaugcugaaaggcgugaaggaggaucaaaccaaauuucucaagauuaaaaccguuagcucugagcuguccugccgggaagggcagagcuacuggacaggaucuuucucccccaagugucugagcucuagacgcugccaucuugugggcgagugucacgucaaucggugccucagcuggagagacaacgaaaccuccgcugaguuuagcuucgugggggaaucuacaacgaugcgcgagaauaaaugcuuugagcaguguggcggauggggcugcggguguuucaacguuaauccuuccugccuguuugugcauaccuaucugcagagcguccggaaggaagcgcucagaguguucaacuguaucgauugggugcacaagcugacacuugagauuaccgacuuugacggauccgucucuacaaucgaucugggcgccagcuccucucgcuucaccaauugggggagcguuucccucucucuggacgcugaaggaauuagcggcuccaacagcuuuucuuucaucgagucccccgggaaaggcuacgccauuguggaugagccguucagcgaaaucccucggcaaggauuucugggcgagaucagaugcaauucugaauccagcgugcuuucugcccacgaguccugucuccgcgcucccaaccugauuagcuauaagcccaugaucgaccagcuggaaugcacgaccaaucucauugauccuuucgucguguuugagcgggggucccugccgcagacaagaaacgacaaaaccuucgccgcgagcaagggaaaucgcggcguucaggcuuuuucuaaagggagcgugcaagccgaucuuacacugauguucgacaacuuugaggucgauuucgugggagccgcuguuuccugugacgccgcguuucucaaucugaccggcugcuacucuuguaacgcuggggcccgggugugccugagcaucacguccacaggcaccggaacacuuucugcccauaacaaggauggcagccuccacauuguccugcccuccgaaaaugggaccaaggaccagugccagauccugcauuucaccgugccugagguugaagaggaauuuauguauucuugugauggagacgagagaccccuccuggugaaaggcacacuuaucgcuauugacccuuucgaugaccggcgcgaggccgggggagaaagcacggucgugaaccccaaguccggcagcuggaacuuuuucgauugguucucuggccugauguccugguuugggggaccucucaaaaccauccugcugauuugccuuuacguggcucucagcaucggccuguucuuucugcucauuuaccuggggagaacaggacuuucuaagauguggcuggccgcgaccaaaaaggccuccuga

SEQ ID NO: 14575 - RNA, 3204 nt, Artificial Sequence
  derived and/or modified CDS sequence (opt5) from RVFV(200803167)__JF311382.1__Gn-Gc
auggccggcaucgcuaugaccgugcugcccgcccucgcggucuucgcucuggccccuguuguguuugccgaggaccuucaccugagaaaucggccggggaagggacauaauuacauugauggcaugacacaggaagacgcuacgugcaaacccgugaccuaugccggggcuuguagcuccuucgauguccuccuggagaagggaaaauuuccucuuuuccaaucuuacgcccaccaucgcacacugcucgaagcggugcacgacaccaucauugccaaggcugaucccccuagcugcgaccugcaguccgcccauggcaaccccuguaugaaagagaagcugguuaugaagacacacugcccuaaugauuaucagucugcucacuaccucaacaaugacgggaaaauggccagcgugaaguguccgcccaaauaugaacugaccgaggauugcaacuuuuguagacagaugacaggagcgucccuuaagaaaggcucuuacccucugcaagaccucuucugccagagcuccgaggaugacggcagcaagcugaagaccaaaaugaagggggucugugaagugggaguucaggcccuuaaaaagugcgauggccagcugucuacggcucaugaggugguccccuuugccguguucaaaaauuccaagaaaguguaucucgacaagcuggaccugaagaccgaagagaaccuccugccugauagcuuugucuguuucgagcacaaagggcaauacaagggaacaauggacucuggccagaccaaacgggaacuuaaguccuuugauaucagccagugccccaaaauugggggacauggcucuaagaagugcacaggcgacgcugccuucuguuccgccuacgagugcaccgcucaguaugcgaaugccuacuguagccacgcuaacggguccggaaucguucaaauccaggugucuggcguguggaaaaagccgcugugcgucggguaugaacgcgugguugugaaaagagagcucagcgccaagccuauucagcgggucgaacccuguacgacaugcaucaccaaaugugagccucacggacuggugguucgcuccacaggcuuuaagauuagcucugccguggcuugcgccuccggggucugugugaccggaagccaaucucccagcaccgagaucgcgcuuaaguaccccggcauuucccagucuagcggcggggauaucggaguccauauggcucacgacgaucaguccgugagcucuaaaauuguugcccauugcccuccgcaggaccccugucuggugcacggcugcaucgucugcgcccaugggcucaucaauuaucaaugucacacagcucuguccgccuucgugguuguguucgucuuuagcucuauugcuaucauuugccuggccauccucuacagagugcugaagugucuuaaaauugcgccucggaaggugcugaacccccucauguggaucacggccuucauccgcuggguuuauaaaaagauggucgcuagaguggccgauaauauuaaccaggugaaucgggaaaucggauggauggagggcgggcagcugguccuuggcaacccugcucccauuccgcgccacgccccuauccccagauacuccaccuaccugaugcuccugcugauugugagcuaugcguccgccugcucugaacucauccaggcuagcucccggaucacaaccuguucuacagagggaguuaacaccaagugccgccugagcggcacggcccuuauuagagcuggguccgugggagccgaagccugucugaugcucaaaggcgucaaggaggaccaaacaaaauuucugaagaucaaaaccgugagcucugagcuguccugccgggaagggcagagcuacuggaccggaucuuucuccccuaagugucuuagcucuagacgcugccaucucguuggcgagugucacgugaaucggugccugagcuggagagauaacgaaacauccgcugaguuuagcuucgucggggaaucuaccacaaugcgcgagaauaaaugcuuugagcaguguggcggauggggcugcggguguuucaacgugaaucccuccugccuguuuguucauacguaucuccagagcgugcggaaggaagcgcugagagucuucaacuguauugacugggugcacaaacuuacccuggagaucacagacuuugauggauccgugucuaccauugaccucggcgccagcuccucucgcuucacaaauugggggagcgucucccugucucuggaugcugaaggaaucagcggcuccaacagcuuuucuuucauugaguccccugggaaaggcuacgccaucguugacgagcccuucagcgaaaucccgcggcaaggauuucuuggcgagauuagaugcaauucugaauccagcgugcucucugcccacgaguccugucugcgcgcuccuaaccugaucagcuauaagcccaugauugaucagcucgaaugcaccacgaaucugaucgaccccuucguggucuuugagcgggggucccuuccucagaccagaaacgauaaaacauucgccgcgagcaagggaaaucgcggcgugcaggcuuuuucuaaagggagcguucaagccgaccugacccucauguucgauaacuuugagguggacuucgucggagccgcuguguccugugaugccgcguuucugaaucugacaggcugcuacucuuguaacgcuggggcccggguuugccuuagcauuaccuccacgggcacaggaacccucucugcccauaacaaggacggcagccugcacaucgugcugccguccgaaaaugggacaaaggaucagugccagauccuccauuucaccguccccgagguggaagaggaauuuauguauucuugugacggagacgagagaccucugcuuguuaaaggcacccugauugcuaucgaucccuucgacgaucggcgcgaggccgggggagaaagcacaguggucaacccuaaguccggcagcuggaacuuuuucgacugguucucuggccucauguccugguuugggggaccccugaaaacgaugcugcuuauuugccucuacguggcucugagcaucggccuguucuuucuccugauuuaccuugggagaaccggacugucuaagauguggcucgccgcgacaaagaaggccuccuga

SEQ ID NO: 14576 - RNA, 3204 nt, Artificial Sequence
  derived and/or modified CDS sequence (opt5) from RVFV(2373/74)__DQ380194.1__Gn-Gc
auggccggcaucgcuaugaccgugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucaaauccaggugucuggcguguggaaaaagccucuuugcgucggguaugaacgcgugguugugaaaagagagcugagcgccaagcccauucagcgggucgaaccuuguacgacaugcaucaccaaaugugagccccacggacucgugguucgcuccacaggcuuuaagauuagcucugccguggcuugcgccuccggggucugugugaccggaagccaaucucccagcaccgagaucacacugaaguacccuggcauuucccagucuagcggcggggauaucggaguccauauggcgcacgacgaucaguccgugagcucuaaaaugguugcucauugcccgccccaggacccuugucuugugcacggcugcauugucugcgcccaugggcugaucaauuaucaaugucacacggcccucuccgcuuucgugguuguguucgucuuuagcucuguggccaucauuugccuggcuauccuguacaaggugcucaaaugucugaagauugcccccagaaaaguucuuaacccucugauguggaucaccgcguucauucggugggucuauaagaagaugguggcccgcguggcugauaauaucaaccaggucaauagagaaaucggauggauggagggcgggcagcucgcccugggcaaccccgcuccgauuccucggcacgcccccaucccucgcuacuccacauaccuuaugcugcuccugauugugagcuaugcguccgccugcucugaacugauccaggcuagcuccagaauuaccacauguucuaccgagggaguuaacacgaaaugccggcucagcggcacagcccugauccgcgcuggguccgugggagccgaagccugucuuaugcugaagggcgucaaagaggaccaaaccaaguuucucaaaaucaagaccgugagcucugagcuguccugcagagaagggcagagcuacuggacaggaucuuucucccccaaaugucugagcucucggagaugccaucuuguuggcgagugucacgugaaucgcugccucagcuggcgggauaacgaaaccuccgcugaguuuagcuucgucggggaaucuacaacgaugagagagaauaagugcuuugagcaguguggcggauggggcugcggguguuucaacgugaauccuuccugccuguuuguucauaccuaucugcagagcgugcgcaaggaagcgcuccgggucuucaacuguauugacugggugcacaaacugacacuugagaucaccgacuuugauggauccgugucuacacuggaccucggcgccagcuccucuagauucaccaauugggggagcgucucccugucucuggaugcugaaggaauuagcggcuccaacagcuuuucuuucaucgagucccccgggaagggcuacgccauuguugacgagccguucagcgaaaucccucgccaaggauuucuuggcgagauucggugcaauucugaauccagcgugcucucugcccacgaguccugucugagagcucccaaccugaucagcuauaaacccaugaucgaucagcucgaaugcacgaccaaucugauugacccuuucguggucuuugagcgcgggucccuuccgcagacacggaacgagaagaccuucgccgcgagcaaaggaaauagaggcgugcaggcuuuuucuaaggggagcguucaagccgaucugacacucauguucgacaacuuugaaguggauuucgucggagccgcuguguccugugacgccgcguuucugaaucugaccggcugcuacucuuguaacgcuggggcccgcguuugccuuagcaucacguccacaggcaccggaacacucucugcccauaacaaggauggcagccugcacauugugcugcccuccgagaaugggaccaaagaccagugccagauccuccauuucaccgucccugaaguggaggaagaguuuauguauucuugugauggagacgagcggccccugcuuguuaagggcacacugauugcuaucgacccuuucgaugacagacgggaagccgggggagagagcacgguggucaaccccaaauccggcagcuggaacuuuuucgauugguucucuggccucauguccugguuugggggaccucugaagaccauccugcuuauuugccucuacguggcucugagcaucggccuguucuuucuccugauuuaccuugggcgcacaggacugucuaaaauguggcucgccgcgaccaagaaggccuccuga

SEQ ID NO: 14577 - RNA, 3204 nt, Artificial Sequence
  derived and/or modified CDS sequence (opt5) from RVFV(Kenya 57 (Rintoul))__DQ380192.1__Gn-Gc
auggccggcaucgcuaugaccgugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaucaaacgggaacugaaguccuuugauauuagccagugcccgaaaaucgggggacauggcucuaagaagugcaccggcgacgcugccuucuguuccgccuacgagugcacagcucaguaugcgaaugccuacuguagccacgcuaacggguccggaaucguucaaauucaggugucuggcguguggaaaaagccucuuugcgucggguaugaacgcgugguugugaaaagagagcugagcgccaagcccauccagcgggucgaaccuuguaccacgugcauuacaaaaugugagccccacggacucgugguucgcuccaccggcuuuaagaucagcucugccguggcuugcgccuccggggucugugugacaggaagccaaucucccagcaccgagauuacccugaaguacccuggcaucucccagucuagcggcggggauauuggaguccauauggcgcacgacgaucaguccgugagcucuaaaaucguugcucauugcccgccccaggacccuugucuugugcacggcugcaucgucugcgcccaugggcugauuaauuaucaaugucacacagcccucuccgcuuucgugguuguguucgucuuuagcucuguggccaucauuugccuggcuauccuguacaaggugcucaaaugucugaagauugcccccagaaaaguucuuaacccucugauguggaucacggcguucauccggugggucuauaagaagaugguggcccgcguggcugauaauauuaaccaggucaauagagaaaucggauggauggagggcgggcagcucgugcugggcaaccccgccccgauuccucggcacgcucccaucccucgcuacuccaccuaccuuaugcugcuccugauuguuagcuaugccuccgcgugcucugaacugauccaggccagcuccagaaucacaaccuguucuacagagggagugaacaccaaaugccggcucagcggcacggcucugauucgcgccggguccgucggagcugaagccugucuuaugcugaagggcgugaaagaggaccaaacaaaguuucucaaaaucaagaccguuagcucugagcuguccugcagagaagggcagagcuacuggaccggaucuuucucccccaaaugucugagcucucggagaugccaucuugugggcgagugucacgucaaucgcugccucagcuggcgggauaacgaaacauccgccgaguuuagcuucgugggggaaucuaccacaaugagagagaauaagugcuuugagcaguguggcggauggggcugcggguguuucaacguuaauccuuccugccuguuugugcauacguaucugcagagcguccgcaaggaagcucuccggguguucaacuguauugacugggugcacaaacugacccuugagaucacagacuuugauggauccgucucuaccguugaccugggcgcgagcuccucuagauucacaaauugggggagcgugucccucucucuggaugccgaaggaauuagcggcuccaacagcuuuucuuucaucgagucccccgggaagggcuacgcuauuguggacgagccguucagcgaaaucucucgccaaggauuucugggcgagauccggugcaauuccgaaagcucuguccuuuccgcccacgagagcugucucagagccccuaaccugauuuccuauaaacccaugaucgaucagcuggaaugcaccacgaaucucauugaccccuucgugguuuuugagcgcgggagccugccucagacccggaacgauaagacauucgcugccucuaaaggaaauagaggcgugcaggcguuuagcaagggguccguccaagcugaccuuacccugauguucgauaacuuugagguggacuucguuggagccgccgugucuugugaugcugccuuucucaaucugacaggcugcuacagcuguaacgcgggggcucgcgucugccuguccaucaccucuacgggcacaggaacccuuagcgcccauaacaaggacggcucccuccacauugugcugccgucugaaaaugggacaaaagaucagugccagauccugcauuucaccguucccgagguggaagaggaauuuauguauagcugugacggagacgagcggccucuccuggucaagggcacccuuaucgccauugaucccuucgacgauagacgggaggcugggggagaauccacaguggugaacccuaaaagcggcucuuggaacuuuuucgacugguucuccggccugaugagcugguuugggggaccccucaagacgauccugcugauuugccuuuacgucgcccucucuaucggccuguucuuucugcucauuuaccuggggcgcaccggacuuuccaaaauguggcuggcugccacaaagaaggcgagcuga

SEQ ID NO: 14578 - RNA, 3204 nt, Artificial Sequence
  derived and/or modified CDS sequence (opt5) from RVFV(RVFBJ01/2016)__KX785331.1__Gn-Gc
auggccggcaucgcuaugaccgugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaacaugaacucaccgaggauugcaacuuuuguagacagaugacaggagcgucccugaagaaaggcucuuauccccuucaagaccuguucugccagagcuccgaggaugacggcagcaagcucaagaccaaaaugaagggggucugugaagugggaguucaggcccugaaaaagugcgauggccagcuuucuacggcucacgagguggucccuuuugccguguucaaaaauuccaagaaaguguaccuggacaagcucgaccugaagaccgaagagaaccugcuccccgauagcuuugucuguuucgagcauaaagggcaauauaagggaacaauggacucuggccagaccaaacgggaacugaaguccuuugauaucagccagugcccgaaaauugggggacacggcucuaagaagugcacaggcgacgcugccuucuguuccgccuacgagugcaccgcucaguacgcgaaugccuauuguagccacgcuaacggguccggaaucguucaaauccaggugucuggcguguggaaaaagccucuuugcgucggguacgaacgcgugguugugaaaagagagcugagcgccaagcccauucagcgggucgaaccuuguacgacaugcaucaccaaaugugagccccauggacucgugguucgcuccacaggcuuuaagauuagcucugccguggcuugcgccuccggggucugugugaccggaagccaaucucccagcaccgagaucacacugaaguauccuggcauuucccagucuagcggcggggauaucggaguccacauggcgcaugacgaucaguccgugagcucuaaaauuguugcucacugcccgccccaggacccuugucuugugcauggcugcaucgucugcgcccacgggcugaucaauuaccaaugucacacggcccucuccgcuuucgugguuguguucgucuuuagcucuguggccauuaucugccuggcuauucuguauaaggugcucagaugucugaaaaucgcccccaagaaaguucuuaacccucugauguggauuaccgcguucauccggugggucuacaagaagaugguggcccgcguggcugauaauaucaaccaggucaauagagaaauuggauggauggagggcgggcagcucgcccugggcaaccccgcuccgaucccucggcaugcccccauuccucgcuauuccacauaccuuaugcugcuccugaucauuagcuacgcguccgccugcucugaacugauccaggcuagcuccagaaucaccacauguucuaccgagggagugaacacgaaaugccggcucagcggcacagcccugauucgcgcuggguccguuggagccgaagccugucuuaugcugaagggcgugaaagaggaccaaaccaaguuucucaaaaucaagaccgucagcucugagcuguccugcagagaagggcagagcuauuggacaggaucuuucucccccaaaugucugagcucucggagaugccaccuugugggcgagugucauguuaaucgcugccucagcuggcgggauaacgaaaccuccgcugaguuuagcuucgugggggaaucuacaacgaugagagagaauaagugcuuugagcaguguggcggauggggcugcggguguuucaacgucaauccuuccugccuguuugugcacaccuaccugcagagcguucgcaaggaagcgcuccggguguucaacuguauugacuggguccacaaacugacacuugagaucaccgacuuugauggauccgugucuacaauugaccugggcgccagcuccucuagauucaccaauugggggagcgugucccucucucuggaugcugaaggaaucagcggcuccaacagcuuuucuuucauugagucccccgggaagggcuaugccaucgucgacgagccguucagcgaaaucccucgccaaggauuucugggcgagauucggugcaauucugaauccagcguucuuucugcccaugaguccugucucagagcucccaaccugaucagcuacaaacccaugauugaucagcuggaaugcacgaccaaucucaucgacccuuucgugguguuugagcgcgggucccugccgcagacacggaacgauaagaccuucgccgcgagcaaaggaaauagaggcguccaggcuuuuucuaaggggagcgugcaagccgaccuuacacugauguucgauaacuuugagguugacuucgugggagccgcugucuccugugaugccgcguuucucaaucugaccggcugcuauucuuguaacgcuggggcccgcgugugccugagcauuacguccacaggcaccggaacacuuucugcccacaacaaggacggcagccuccauaucguucugcccuccgaaaaugggaccaaagaucagugccagauccugcacuucaccgugccugaggucgaagaggaauuuauguacucuugugacggagacgagcggccccuccuggugaagggcacacuuauugcuaucgauccuuucgacgauagacgggaggccgggggagaaagcacgguugugaaccccaaauccggcagcuggaacuuuuucgacugguucucuggccugauguccugguuugggggaccucucaagaccauucugcugaucugccuuuaugucgcucucagcauuggccuguucuuucugcucaucuaccuggggcgcacaggacuuucuaaaauguggcuggccgcgaccaagaaggccuccuga

SEQ ID NO: 14579 - RNA, 3204 nt, Artificial Sequence
  derived and/or modified CDS sequence (opt5) from RVFV(clone 13)__DQ380213.1__Gn-Gc
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaacaugaacucaccgaggauugcaacuuuuguagacagaugacaggagcgucccugaagaaaggcucuuauccccuucaagaccuguucugccagagcuccgaggaugacggcagcaagcucaagaccaaaaugaagggggucugugaagugggaguucaggcccugaaaaagugcgauggccagcuuucuacggcucacgagguggucccuuuugccguguucaaaaauuccaagaaaguguaccuggacaagcucgaccugaagaccgaagagaaccugcuccccgauagcuuugucuguuucgagcauaaagggcaauauaagggaacaauggacucuggccagaccaaacgggaacugaaguccuuugauaucagccagugcccgaaaauugggggacacggcucuaagaagugcacaggcgacgcugccuucuguuccgccuacgagugcaccgcucaguacgcgaaugccuauuguagccacgcuaacggguccggaaucguucaaauccaggugucuggcguguggaaaaagccucuuugcgucggguacgaacgcgugguugugaaaagagagcugagcgccaagcccauucagcgggucgaaccuuguacgacaugcaucaccaaaugugagccccauggacucgugguucgcuccacaggcuuuaagauuagcucugccguggcuugcgccuccggggucugugugaccggaagccaaaaucccucuaccgagaucacacugaaguauccuggcauuagccaguccucuggcggggauaucggaguccacauggcgcaugacgaucagagcguguccagcaaaauuguugcucacugcccgccccaggacccuugucuugugcauggcugcaucgucugcgcccacgggcugaucaacuaccaaugucacacggcccucucugcuuucgugguuguguucgucuuuuccagcauugccaucauuugccuggcuauccuguauagagugcucaagugucugaaaauugcgccccggaaggugcuuaauccucugauguggaucaccgccuucauccgcuggguuuacaaaaagauggucgccagaguggcugauaacauuaaucaggugaaccgggaaaucggauggauggagggcgggcagcucguccugggcaaccccgccccgauuccucgccaugcucccaucccuagauauucuacauaccuuaugcugcuccugauuguguccuacgccagcgcgugcuccgaacugauccaggccucuagccggaucaccacauguuccaccgagggaguuaauacgaagugccgccucucuggcacagcucugauuagagccgggagcgugggagcugaagccugucuuaugcugaaaggcgucaaggacgaucaaaccaaauuucucaagaucaaaaccguguccagcgagcugucuugccgggaggggcaguccuauuggacaggcagcuucucucccaagugucuguccagcagacgcugccaccuuguuggagaaugucaugugaaccggugccucucuuggagagacaaugagaccagcgccgaauuuuccuucgucggggagagcacaacgaugcgcgaaaacaaaugcuuugagcaguguggcggauggggcugcggguguuucaaugugaacccuucuugccuguuuguucacaccuaccugcaguccgugcggaaggaggcucucagagucuucaauuguauugacugggugcacaagcugacacuugaaaucaccgauuuugacggaagcguguccacaauugaucugggcgcgucuagcucccgcuucaccaacugggggucugucagccucucccuggacgccgagggaaucucuggcagcaauuccuuuagcuucauugaaucucccgggaaaggcuaugcuaucguugaugagccguucuccgagaucccucggcaaggauuucugggcgaaauuagaugcaacagcgagucuuccgugcuuagcgcccaugaaucuugucuccgcgcccccaaucugaucuccuacaagcccaugauugaccagcuggagugcacgaccaaccucaucgauccuuucguggucuuugaacgggggagccugccgcagacaagaaaugagaaaaccuucgcugccuccaagggaaaccgcggcgugcaggcguuuagcaaagggucuguucaagcugaccuuacacugauguucgauaauuuugagguggacuucgucggagccgccgugagcugugaugcugccuuucucaaccugaccggcugcuauuccuguaacgcgggggcucggguuugccugucuauuacgagcacaggcaccggaacacuuuccgcccacaauaaggacggcucucuccauaucgugcugcccagcgaaaacgggaccaaggaucagugccagauccugcacuucaccgucccugagguggaagaggaauuuauguacuccugugacggagacgagagaccccuccugguuaaaggcacacuuauugccaucgauccuuucgacgaucggcgcgaggcugggggagaaucuacgguggucaaucccaagagcggcuccuggaacuuuuucgacugguucagcggccugaugucuugguuugggggaccucucaaaaccauucugcugaucugccuuuauguggcccucuccauuggccuguucuuucugcucaucuaccuggggagaacaggacuuagcaagauguggcuggcugccaccaaaaaggcgucuuga

SEQ ID NO: 14580 - RNA, 3204 nt, Artificial Sequence
  derived and/or modified CDS sequence (opt5) from RVFV__JQ068143.1__Gn-Gc
auggccggcaucgcuaugaccgugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaaucgacucuggccagaccaaacgggaacugaaguccuuugauauuagccagugcccgaaaaucgggggacauggcucuaagaagugcacaggcgacgcugccuucuguuccgccuacgagugcaccgcucaguaugcgaaugccuacuguagccacgcuaacggguccggaaucguucaaauucaggugucuggcguguggaaaaagccucuuugcgucggguaugaacgcgugguugugaaaagagagcugagcgccaagcccauccagcgggucgaaccuuguacgacaugcauuaccaaaugugagccccacggacucgugguucgcuccacaggcuuuaagaucagcucugccguggcuugcgccuccggggucugugugaccggaagccaaucucccagcaccgagauuacacugaaguacccuggcaucucccagucuagcggcggggauauuggaguccauauggcgcacgacgaucaguccgugagcucuaaaaucguugcucauugcccgccccaggacccuugucuugugcacggcugcaucgucugcgcccaugggcugauuaauuaucaaugucacacggcccucuccgcuuucgugguuguguucgucuuuagcucuguggccaucauuugccuggcuauccuguacaaggugcucagaugucugaaaauugcccccaagaaaguucuuaacccucugauguggaucaccgcguucauccggugggucuauaagaagaugguggcccgcguggcugauaauauuaaccaggucaauagagaaaucggauggauggagggcgggcagcucgcccugggcaaccccgcuccgauuccucggcacgcccccaucccucgcuacuccacauaccuuaugcugcuccugauuaucagcuaugcguccgccugcucugaacugauccaggcuagcuccagaauuaccacauguucuaccgagggagugaacacgaaaugccggcucagcggcacagcccugauccgcgcuggguccguuggagccgaagccugucuuaugcugaagggcgugaaagaggaccaaaccaaguuucucaaaauuaagaccgucagcucugagcuguccugcagagaagggcagagcuacuggacaggaucuuucucccccaaaugucugagcucucggagaugccaucuugugggcgagugucacguuaaucgcugccucagcuggcgggauaacgaaaccuccgcugaguuuagcuucgugggggaaucuacaacgaugagagagaauaagugcuuugagcaguguggcggauggggcugcggguguuucaacgucaauccuuccugccuguuugugcauaccuaucugcagagcguucgcaaggaagcgcuccggguguucaacuguaucgacuggguccacaaacugacacuugagauuaccgacuuugauggauccgugucuacaaucgaccugggcgccagcuccucuagauucaccaauugggggagcgugucccucucucuggaugcugaaggaauuagcggcuccaacagcuuuucuuucaucgagucccccgggaagggcuacgccaucgucgacgagccguucagcgaaauuccucgccaaggauuucugggcgagauccggugcaauucugaauccagcguucuuucugcccacgaguccugucucagagcucccaaccugauuagcuauaaacccaugaucgaucagcuggaaugcacgaccaaucucauugacccuuucgugguguuugagcgcgggucccugccgcagacacggaacgauaagaccuucgccgcgagcaaaggaaauagaggcguccaggcuuuuucuaaggggagcgugcaagccgaccuuacacugauguucgauaacuuugagguugacuucgugggagccgcugucuccugugaugccgcguuucucaaucugaccggcugcuacucuuguaacgcuggggcccgcgugugccugagcaucacguccacaggcaccggaacacuuucugcccauaacaaggacggcagccuccacaucguucugcccuccgaaaaugggaccaaagaucagugccagauucugcauuucaccgugccugaggucgaagaggaauuuauguauucuugugacggagacgagcggccccuccuggugaagggcacacuuaucgcuauugauccuuucgacgauagacgggaggccgggggagaaagcacgguugugaaccccaaauccggcagcuggaacuuuuucgacugguucucuggccugauguccugguuugggggaccucucaagaccauccugcugauuugccuuuacgucgcucucagcaucggccuguucuuucugcucaucuaccuggggcgcacaggacuuucuaaaauguggcuggccgcgaccaagaaggccuccuga

SEQ ID NO: 14581 - RNA, 3204 nt, Artificial Sequence
  derived and/or modified CDS sequence (opt5) from RVFV(SA-75)__DQ380189.1__Gn-Gc
auggccagaaucgcuaugaccgugcugcccgcccucgcggucuucgcucuggccccuguuguguuugccgaggacccgcaccuucggaaucgccccggcaaggggcauaauuacauugauggaaugacacaggaagacgcuacgugcaaaccugugaccuaugccggcgcuuguagcuccuucgauguccugcucgagaaggggaaauuuccccuguuccaaucuuacgcccaccauagaacacuucuggaagcggugcacgacaccaucauugccaaggcugauccucccagcugcgaccuccaguccgcccauggaaacccuuguaugaaagagaagcugguuaugaagacacacugcccgaaugauuaucagucugcucacuaccugaacaaugacggcaaaauggccagcgugaagugucccccuaaauaugaacucaccgaggauugcaacuuuugucggcagaugacaggggcgucccugaagaaaggaucuuacccccuucaagaccuguucugccagagcuccgaggaugacggcagcaagcucaagaccaaaaugaagggcgucugugaaguggggguucaggcccugaaaaagugcgauggacagcuuucuacggcucaugagguggucccuuuugccguguucaaaaauuccaagaaaguguaucuggacaagcucgaccugaagaccgaagagaaccugcuccccgauagcuuugucuguuucgagcacaaaggccaauacaaggggacaauggacucuggacagaccaaacgcgaacugaaguccuuugauaucagccagugcccgaaaauuggcgggcauggaucuaagaagugcacaggcgacgcugccuucuguuccgccuacgagugcaccgcucaguaugcgaaugccuacuguagccacgcuaacggcuccgggguugugcaaauccaggugucuggagucuggaaaaagccucuuugcgugggcuaugaaagaguuguggucaaacgggagcugagcgccaagcccauccagcgcguggaaccuuguacgacaugcauuaccaaaugugagccccacgggcucguugugagauccacaggauuuaagaucagcucugccgucgcuugcgccuccggcgugugugucaccgggagccaaucucccagcaccgagauuacacugaaguacccuggaaucucccagucuagcggcggcgauauuggggugcauauggcgcacgacgaucaguccguuagcucuaaaaucguggcucauugcccgccccaggacccuugucuuguccacggaugcauugugugcgcccauggccugaucaauuaucaaugucacacggcccucuccgcuuucguuguggucuucguguuuagcucuguggccaucauuugccuggcuauccuguacaagguucucaaaugucugaagauugcgccccggaaaguccuuaacccucugauguggaucaccguguucauucgcuggguguauaagaagauggucgccagaguggccgauaauaucaaccagguuaaucgggaaaucggguggauggagggaggccagcucgcucuggggaaccccgccccgauuccucgccacgcucccaucccuagauacuccacauaccuuaugcugcuccugauugugagcuaugccuccgcgugcucugaacugauccaggccagcucccggauuaccacauguucuaccgagggcgucaacacgaaaugccgccucagcggaacagcucugaucagagccggcuccgugggggcugaagccugucuuaugcugaagggaguuaaagaggaccaaaccaaguuucucaaaaucaagaccgugagcucugagcuguccugccgggaaggccagagcuacuggacagggucuuucucccccaaaugucugagcucuagacgcugccaucuugucggagagugucacgugaaucggugccucagcuggagagauaacgaaaccuccgccgaguuuagcuucguuggcgaaucuacaacgaugcgcgagaauaagugcuuugagcagugugggggcuggggaugcggcuguuucaacgugaauccuuccugccuguuuguccauaccuaucugcagagcgugcggaaggaagcucucagaguguucaacuguauugacuggguccacaaacugacacuugagaucaccgacuuugauggguccguuucuacaauugaccugggagcgagcuccucucgcuucaccaauuggggcagcgugucccucucucuggaugccgaagggaucagcggauccaacagcuuuucuuucauugagucccccggcaagggguacgcuaucguggacgagccguucagcgaaauuccucggcaaggcuuucugggagagaucagaugcaauucugaauccagcguccuuucugcccacgaguccugucuccgcgcccccaaccugaucagcuauaaacccaugauugaucagcuggaaugcacgaccaaucucaucgacccuuucgugguuuuugagcggggcucccugccgcagacaagaaacgauaagaccuucgcugccagcaaagggaaucgcggagugcaggcguuuucuaagggcagcguccaagcugaccuuacacugauguucgauaacuuugagguggacuucguuggggccgccguguccugugaugcugccuuucucaaucugaccggaugcuacucuuguaacgcgggcgcucgggucugccugagcauuacguccacagggaccggcacacuuucugcccauaacaaggacggaagccuccacaucgugcugcccuccgaaaauggcaccaaagaucagugccagauucugcauuucaccguuccugagguggaagaggaauuuauguauucuugugacggggacgagagaccccuccuggucaagggaacacuuaucgccaucgauccuuucgacgaucggcgcgaggcuggcggggaaagcacgguggugaaccccaaauccggaagcuggaacuuuuucgacugguucucuggccugauguccugguuuggcgggccucucaagaccauucugcugaucugccuuuacgucgcccucagcauuggacuguucuuucugcucaucuaccugggcagaacagggcuuucuaaaauguggcuggcugccaccaagaaggcguccuga

SEQ ID NO: 14582 - RNA, 3204 nt, Artificial Sequence
  derived and/or modified CDS sequence (opt5) from RVFV(ANK-6087)__DQ380216.1__Gn-Gc
auggccggcaucgcuaugaccgugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaaaacuggacucuggccagacaaagcgggaacuuaaauccuuugauaucagccagugcccgaagauugggggacauggcucuaagaaaugcaccggcgacgcugccuucuguuccgccuacgagugcacagcucaguaugcgaaugccuacuguagccacgcuaacggguccggaaucguucaaauccaggugucuggcguguggaagaaaccucugugcgucggguaugaacgcgugguugugaagagagagcucagcgccaaacccauucagcgggucgaaccuuguaccacgugcaucacaaagugugagccccacggacuggugguucgcuccaccggcuuuaagauuagcucugccguggcuugcgccuccggggucugugugacaggaagccaaucucccagcaccgagaucacccuuaaauacccuggcauuucccagucuagcggcggggauaucggaguccauauggcgcacgacgaucaguccgugagcucuaagauuguugcucauugcccgccccaggacccuugucuggugcacggcugcaucgucugcgcccaugggcucaucaauuaucaaugucacacagcccuguccgcuuucgugguuguguucgucuuuagcucuauugccaucauuugccuggcuauccucuacagagugcugaaaugucuuaagauugcuccccggaaagugcugaacccucucauguggaucacggcguucauccgcuggguuuauagaaagauggucgcccggguggcugauaauauuaaccaggugaaucgcgaaaucggauggauggagggcgggcagcugguccuuggcaaccccgccccgauuccuagacacgugcccaucccucgguacuccaccuaccugaugcuccugcugauuguuagcuaugcuuccgccugcucugaacucauccaggcgagcucccgcaucacaaccuguucuacagagggagugaacaccaagugcagacugagcggcacggcccuuauucgggcuggguccgucggagccgaagccugucugaugcucaaaggcgugaaggaggaccaaacaaaauuucugaagaucaaaaccguuagcucugagcuguccugcagagaagggcagagcuacuggaccggaucuuucucccccaagugucuuagcucucgccggugccaucucgugggcgagugucacgucaauagaugccugagcuggcgcgauaacgaaacauccgccgaguuuagcuucgugggggaaucuaccacaaugcgggagaauaaaugcuuugagcaguguggcggauggggcugcggguguuucaacguuaauccuuccugccuguuugugcauacguaucuccagagcgucagaaaggaagcccugcgcguguucaacuguauugacugggugcacaaacuuacccuggagaucacagacuuugauggauccgucucuaccauugaccucggcgcuagcuccucucgguucacaaauugggggagcguuucccugucucuggaugcggaaggaaucagcggcuccaacagcuuuucuuucauugagucccccgggaagggcuacgccaucguggacgagccguucagcgaaaucccuagacaaggauuucuuggcgagauucgcugcaauucugaauccagcgugcucucugcucacgaguccugucugcgggcccccaaccugaucagcuauaagcccaugauugaucagcucgaaugcuccaccaaucugaucgacccuuucgucguguuuaaaagagggagccuuccgcagacgcgcaacgauaagaccuucgccgcuucuaaaggaaaucggggcguucaggccuuuagcaagggguccgugcaagcggaccugacacucauguucgauaacuuugaggucgacuucgugggagcugccguuucuugugaugccgcuuuucugaaucugaccggcugcuacagcuguaacgccggggcgagagugugccuuuccauuacaucuaccggcacgggaacacucagcgcucauaacaaggacggcucccugcacaucguccugcccucugagaaugggaccaaagaucagugccagauccuccauuucacagugccugaaguugaggaagaguuuauguauagcugugacggagacgaacggccccugcuugugcgcggcacccugauugccaucgauccuuucgacgauagacgggaggccgggggagaguccaccgucgugaaccccaagagcggcucuuggaacuuuuucgacugguucuccggccucaugagcugguuugggggaccucugaaaacaauucugcuuaucugccucuacguggcucugucuauuggccuguucuuucuccugaucuaccuugggagaacgggacuguccaagauguggcucgccgcuaccaaaaaggccagcuga

SEQ ID NO: 14583 - RNA, 3204 nt, Artificial Sequence
  derived and/or modified CDS sequence (opt5) from RVFV(KEN/Kil-006/07)__HM586966.1__Gn-Gc
auggccggcaucgcuaugaccgugcugcccgcccucgcggucuucgcucuggccccuguuguguuugccgaggacccgcaccuuagaaaucggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgccgauggcaacaaauguaugaaggagaagcugguuaugaaaacacauugcccuaaugacuaucagucugcucacuaccugaacaaugaugggaagauggccagcgugaaauguccgcccaaguaugaacucaccgaggacugcaacuuuuguagacagaugacaggagcgucccugaaaaagggcucuuacccucuucaagaucuguucugccagagcuccgaggacgauggcagcaagcucaaaaccaagaugaaaggggucugugaagugggaguucaggcccugaagaaaugcgacggccagcuuucuacggcucacgaggugguccccuuugccguguucaaaaauuccaagaagguguaucuggacaagcucgaucugaaaaccgaagagaaccugcucccugacagcuuugucuguuucgagcauaaggggcaauacaaaggaacaauggauucuggccagaccaagcgggaacugaaauccuuugacaucagccagugccccaagauugggggacacggcucuaagaaaugcacaggcgaugcugccuucuguuccgccuacgagugcaccgcucaguaugcgaaugccuacuguagccaugcuaacggguccggaaucguucaaauccaggugucuggcguguggaagaaaccgcuuugcgucggguaugaacgcgugguugugaagagagagcugagcgccaaaccuauucagcgggucgaacccuguacgacaugcaucaccaagugugagccucacggacucgugguucgcuccacaggcuuuaagauuagcucugccguggcuugcgccuccggggucugugugaccggaagccaaucucccagcaccgagaucacacugaaauaccccggcauuucccagucuagcggcggggacaucggaguccacauggcgcaugaugaccaguccgugagcucuaagauuguugcucacugcccuccgcaggaucccugucuugugcauggcugcaucgucugcgcccacgggcugaucaauuaucaaugucauacggcccucuccgcuuucgugguuauuuucguguuuagcucuaccgccaucauuugccuggcuguccuguacagagugcucaaaugucugaagaucgccccucggaaagugcuuaacccccugauguggauuacagcguucauccgcuggguuuauaagaagauggucgccagaguggcugacaauaucaaccaggugaaucgggaaauuggauggauggagggcgggcagcucgcccugggcaacccugcucccaucccgcgccacgccccuauucccagauacuccaccuaccuuaugcugcuccugaucgucagcuaugcguccgccugcucugaacugauucaggcuagcucccggaucacaaccuguucuacggagggagugaacacaaaaugccgccucagcggcaccgcccugaucagagcuggguccguuggagccgaagccugucuuaugcugaagggcgugaaagaggaucaaaccaaguuucucaaaauuaagacagucagcucugagcuguccugccgggaagggcagagcuacuggaccggaucuuucuccccuaaaugucugagcucuagacgcugccaccuugugggcgagugucauguuaaucggugccucagcuggagagacaacgaaacauccgcugaguuuagcuucgugggggaaucuacgaccaugcgcgagaauaagugcuuugagcaguguggcggauggggcugcggguguuucaacgucaaucccuccugccuguuugugcacacauaucugcagagcguucggaaggaagcgcucagaguguucaacuguaucgacuggguccauaaacugacccuugagauuacagauuuugacggauccgugucuaccaucgaucugggcgccagcuccucucgcuucacgaauugggggagcgugucccucucucuggacgcugaaggaauuagcggcuccaacagcuuuucuuucaucgaguccccugggaagggcuacgccauugucgaugagcccuucagcgaaaucccgcggcaaggauuucugggcgagaucagaugcaauucugaauccagcguucuuucugcccacgaguccugucuccgcgcuccuaaccuggugagcuauaaacccaugauugaccagcuggaaugcaccacaaaucucaucgaucccuucguggucuuugagcgggggucccugccucagaccagaaacgacaagacauucgccgcgagcaaaggaaaucgcggcgugcaggcuuuuucuaaggggagcguucaagccgaucuuacccugauguucgacaacuuugagguggauuucgucggagccgcuguguccugugacgccgcguuucucaaucugacgggcugcuacucuuguaacgcuggggcccggguuugccugagcauuacauccaccggcacaggaacccuuucugcccacaacaaggauggcagccuccauaucgugcugccguccgaaaaugggaccaaagaccagugccagauucugcacuucacaguccccgagguggaagaggaauuuauguauucuugugacggagaugagagaccucuccugguuaagggcacgcuuaucgcuaucgaccccuucgaugaccggcgcgaggccgggggagaaagcaccguggucaacccuaaauccggcagcuggaacuuuuucgauugguucucuggccugauguccugguuugggggaccccucaagacaauucugcugaucugccuuuacguggcucucagcauuggccuguucuuucugcucaucuaccuggggagaaccggacuuucuaaaauguggcuggccgcgacaaagaaggccuccuga

SEQ ID NO: 14584 - RNA, 3204 nt, Artificial Sequence
  derived and/or modified CDS sequence (opt5) from RVFV(MgH824)__DQ380210.1__Gn-Gc
auggccggcaucgcuaugaccgugcugcccgcccucgcggucuucgcucuggccccuguuguguuugccgaggacccgcaccuuagaaaccggcccgggaagggauacaauuauauugauggcaugacacaggaagacgcuacgugcaaaccugugaccuacgccggggcuuguagcuccuucgauguccugcucgagaagggaaaauuuccccuguuccaaucuuaugcccaucaccgcacacuucuggaagcggugcaugacaccaucauugccaaggcugauccucccagcugcgaccuccaguccgcccacggcaacccuuguaugaaagagaagcugguuaugaagacacauugcccgaaugauuaccagucugcucacuaucugaacaaugacgggaaaauggccagcgugaagugucccccuaaauacgaacucaccgaggauugcaacuuuuguagacagaugacaggagcgucccugaagaaaggcucuuauccccuucaagaccuguucugccagagcuccgaggaugacggcagcaagcucaagaccaaaaugaagggggucugugaagugggaguucaggcccugaaaaagugcgauggccagcuuucuacggcucacgagguggucccuuuugccguguucaaaaauuccaagaaaguguaccuggacaagcucgaccugaagaccgaagagaaccugcuccccgauagcuuugucuguuucgagcggaaagggcaauacaagggaacaauggacucuggccagaccaaacgcgaacugaaguccuuugauaucagccagugcccgaaaauugggggacauggcucuaagaagugcacaggcgacgcugccuucuguuccgccuaugagugcaccacgcaguacgcuaaugcguauuguagccacgccaacggguccggaguugugcaaauccaggugucuggcgucuggaaaaagccucuuugcgugggguacgaaagaguuguggucaaacgggagcugagcgcuaagcccauccagcgcguggaaccuuguacaaccugcauuacaaaaugugagccccauggacucguugugagauccaccggcuuuaagaucagcucugccgucgccugcgcuuccggggugugugucaccggaagccaaucucccagcacagagauuacgcugaaguauccuggcaucucccagucuagcggcggggauauuggagugcacauggcccacgacgaucaguccguuagcucuaaaaucguggcgcauugcccgccccaggacccuugucuuguccacggcugcauugugugcgcucaugggcugaucaauuaccaaugucacaccgcccucuccgccuucguuguggucuucguguuuagcucuaucgcuauuaucugccuggccauucuguaucgggugcucaagugucugaaaaucgcuccccgcaagguucuuaacccucugauguggauuacagccuucaucagauggaucuacaaaaagauggucgcgcggguggccgauaauauuaaccaggugaaucgcgaaaucggauggauggagggcgggcagcucguccugggcaaccccgcuccgauuccuagacaugcccccaucccucgguacuccaccuaucuuaugcugcuccugauugugagcuacgcuuccgccugcucugaacugauccaggcgagcucccgcaucacaaccuguucuacggagggaguugacacaaagugcagacucagcggcaccgcccugauucgggcuggguccgugggagccgaggcuugucuuaugcugaaaggcgucaaggaagaucaaaccaaauuucucaagaucaaaacagugagcucugagcuguccugcagagaagggcagagcuauuggaccggaucuuucucccccaagugucugagcucucgccggugccaccuuguuggcgagugucacgugaacagaugccucagcuggcgcgacaaugaaacauccgccgaguuuagcuucgucggggaaucuacgaccaugcgggagaacaaaugcuuugagcaguguggcggauggggcugcggguguuucaaugugaacccuuccugccuguuuguucauacauaccugcagagcgugagaaaggaagcccuccgcgucuucaauuguauugacugggugcacaagcugacccuugagaucacagauuuugacggauccgugucuaccauugaucugggcgcuagcuccucucgguucacgaacugggggagcgucucccucucucuggacgcggaaggaaucagcggcuccaauagcuuuucuuucauugagucccccgggaaaggcuaugccaucguugaugagccguucccugaaauccccagacaaggauuucugggcgagauucgcugcaacagcgaaucuuccgugcuuagcgcucaugagucuugucuccgggcccccaaucugaucuccuacaagccuaugauugaccagcuggaaugcaccacaaaccucaucgauccguucguggucuuugagagagggagccugccccagacccgcaaugacaaaacauucgccgcuuccaagggaaaccggggcgugcaggccuuuagcaaagggucuguucaagcggaucuuacccugauguucgacaauuuugagguggauuucgucggagcugccgugagcugugacgccgcuuuucucaaccugacgggcugcuauuccuguaaugccggggcgagaguuugccugucuauuacaagcaccggcacaggaucccuuucugcucacaacaaggauggcagccuccacaucgugcugccuuccgaaaacgggaccaaggaccagugccagauccugcauuucaccguccccgagguggaagaggaauuuauguacucuugugacggagaugagcggccucuccugguuaaaggcacacuuauugccaucgaccccuucgaugaccgcagagaggccgggggagaaagcacgguggucaauccuaaguccggcagcuggaacuuuuucgauugguucucuggccugauguccugguuugggggaccccucaaaaccauucugcugaucugccuuuacguggcucucagcauuggccuguucuuucugcucaucuaucuggggcggacaggacuuucuaagauguggcuggccgcuaccaaaaaggccuccuga

SEQ ID NO: 14585 - RNA, 3204 nt, Artificial Sequence
  derived and/or modified CDS sequence (opt5) from RVFV(KEN/Mal-032/07)__HM586967.1__Gn-Gc
auggccggcaucgcuaugaccgugcugcccgcccucgcggucuucgcucuggccccuguuguguuugccgaggacccgcaccuuagaaaucggcccgggaagggacauaauuacauugauggccgccugcaggaagacgcuacaugcaaaccugugacguaugccggggcuuguagcuccuucgauguccuccuggagaagggaaaauuuccccuuuuccaaucuuacgcccaccauagaacccugcucgaagcggugcacgacacaaucauugccaaggcugauccucccagcugcgaccugcaguccgccgauggcaacaaauguaugaaggagaagcugguuaugaaaacccauugcccuaaugacuaucagucugcucacuaccucaacaaugaugggaagauggccagcgugaaauguccgcccaaguaugaacugacagaggacugcaacuuuugucggcagaugaccggagcgucccuuaaaaagggcucuuacccucugcaagaucucuucugccagagcuccgaggacgauggcagcaagcugaaaacaaagaugaaaggggucugugaagugggaguucaggcccuuaagaaaugcgacggccagcugucuaccgcucacgaggugguccccuuugccguguucaaaaauuccaagaagguguaucucgacaagcuggaucugaaaacggaagagaaccuccugccugacagcuuugucuguuucgagcauaaggggcaauacaaaggaaccauggauucuggccagacaaagcgcgaacuuaaauccuuugacaucagccagugccccaagauugggggacacggcucuaagaaaugcaccggcgaugcugccuucuguuccgccuacgagugcacagcucaguaugcgaaugccuacuguagccaugcuaacggguccggaaucguucaaauccaggugucuggcguguggaagaaaccgcugugcgucggguaugaaagagugguugugaagcgggagcucagcgccaaaccuauucagcgcgucgaacccuguaccacgugcaucacaaagugugagccucacggacuggugguuagauccaccggcuuuaagauuagcucugccguggcuugcgccuccggggucugugugacaggaagccaaucucccagcaccgagaucacccuuaaauaccccggcauuucccagucuagcggcggggacaucggaguccacauggcgcaugaugaccaguccgugagcucuaagauuguugcucacugcccuccgcaggaucccugucuggugcauggcugcaucgucugcgcccacgggcucaucaauuaucaaugucauacagcccuguccgcuuucgugguuauuuucguguuuagcucuacggccaucauuugccuggcuguccucuaccgggugcugaaaugucuuaagaucgccccucgcaaagugcugaacccccucauguggauuaccgcguucaucagauggguuuauaagaagauggucgcccggguggcugacaauaucaaccaggugaaucgcgaaauuggauggauggagggcgggcagcuggcccuuggcaacccugcucccaucccgagacacgccccuauuccccgguacuccacauaccugaugcuccugcugaucgucagcuaugcguccgccugcucugaacucauucaggcuagcucccgcaucaccacauguucuaccgagggagugaacacgaaaugcagacugagcggcacagcccuuauccgggcuggguccguuggagccgaagccugucugaugcucaagggcgugaaagaggaucaaaccaaguuucugaaaauuaagaccgucagcucugagcuguccugcagagaagggcagagcuacuggacaggaucuuucuccccuaaaugucuuagcucucgccggugccaccucgugggcgagugucauguuaauagaugccugagcuggcgcgacaacgaaaccuccgcugaguuuagcuucgugggggaaucuacaacgaugcgggagaauaagugcuuugagcaguguggcggauggggcugcggguguuucaacgucaaucccuccugccuguuugugcacaccuaucuccagagcguuagaaaggaagcgcugcgcguguucaacuguaucgacuggguccauaaacuuacacuggagauuaccgauuuugacggauccgugucuacaaucgaucucggcgccagcuccucucgguucaccaauugggggagcgugucccugucucuggacgcugaaggaauuagcggcuccaacagcuuuucuuucaucgaguccccugggaagggcuacgccauugucgaugagcccuucagcgaaaucccgagacaaggauuucuuggcgagauccgcugcaauucugaauccagcguucucucugcccacgaguccugucugcgggcuccuaaccuggugagcuauaaacccaugauugaccagcucgaaugcacgaccaaucugaucgaucccuucguggucuuugagagagggucccuuccucagacacgcaacgacaagaccuucgccgcgagcaaaggaaaucggggcgugcaggcuuuuucuaaggggagcguucaagccgaucugacacucauguucgacaacuuugagguggauuucgucggagccgcuguguccugugacgccgcguuucugaaucugaccggcugcuacucuuguaacgcuggggccagaguuugccuuagcauuacguccacaggcaccggaacacucucugcccacaacaaggauggcagccugcauaucgugcugccguccgaaaaugggaccaaagaccagugccagauucuccacuucaccguccccgagguggaagaggaauuuauguauucuugugacggagaugagcggccucugcuuguuaagggcacacugaucgcuaucgaccccuucgaugaccgcagagaggccgggggagaaagcacgguggucaacccuaaauccggcagcuggaacuuuuucgauugguucucuggccucauguccugguuugggggaccccugaagaccauucugcuuaucugccucuacguggcucugagcauuggccuguucuuucuccugaucuaccuugggcggacaggacugucuaaaauguggcucgccgcgaccaagaaggccuccuga

SEQ ID NO: 14586 - RNA, 3204 nt, Artificial Sequence
  derived and/or modified CDS sequence (opt5) from RVFV(Kenya 56 (IB8))__DQ380190.1__Gn-Gc
auggccggcaucgcuaugaccgugcugcccgcccucgcggucuucgcucuggccccuguuguguuugccgaggacccgcaccuuagaaaccggcccgggaagggacauaauuacauugauggcaugacacagggggacgcuacgugcaaaccugugaccuaugccggagcuuguagcuccuucgauguccugcucgaaaagggcaaauuuccccuguuccaaucuuacgcccaccaucgcacacuucuggaggcggugcacgacaccaucauugccaaggcugauccucccagcugcgaccuccaguccgcccaugggaacccuuguaugaaagaaaagcugguuaugaagacacacugcccgaaagauuaucagucugcucacuaccugaauaacgacggaaagauggccagcgugaaaugucccccuaaguaugagcucaccgaagauugcaauuuuuguagacagaugacaggcgcgucccugaaaaagggcucuuacccccuucaagaccuguucugccagagcuccgaggaugacgggagcaagcucaaaaccaagaugaaaggagucugugaggugggcguucaggcccugaagaaaugcgaugggcagcuuucuacggcucaugaaguggucccuuuugccguguucaagaacuccaaaaagguguaucuggacaagcucgaccugaaaaccgaggaaaaucugcuccccgauagcuuugucuguuucgagcacaagggacaauacaaaggcacaauggacucugggcagaccaagcgggagcugaaauccuuugauaucagccagugcccgaagauuggaggccauggcucuaagaaaugcacaggggacgcugccuucuguuccgccuacgaaugcaccgcucaguaugcgaacgccuacuguagccacgcuaauggauccggcaucguucaaauccaggugucugggguguggaagcgcccucuuugcgucggauaugagagagugguugugaaacgggaacugagcgccaagcccauucagcgcgucgagccuuguacgacaugcaucaccaaaugugaaccccacggccucgugguuagauccacaggguuuaagauuagcucugccguggcuugcgccuccggagucugugugaccggcagccaaucucccagcaccgagaucacacugaaguacccuggcaugucccagucuagcgggggagauauuggcguccauauggcgcacgacgaucaguccgugagcucuaaaaucguugcucauugcccgccccaggacccuugucuugugcacgggugcauugucugcgcccauggacugaucaacuaucaaugucacacggcccucuccgcuuucgugguuguguucgucuuuagcucuguggccaucauuugccuggcuauccuguacaaggugcucaaaugucugaagauugcgccccggaaaguucuuaauccucugauguggaucaccgccuucauucgcugggucuauaagaagaugguggccagaguggcugauaacaucaaucaggucaaccgggagaucggcuggauggaagggggccagcccgcccucggaaauccggcuccuauuccccgccacgccccuauccccagauacuccacauaccugaugcuucugcucauugugagcuaugcguccgccugcucugagcugauccaggcuagcucccggauuaccacauguucuaccgaaggcguuaacacgaaaugccgccugagcgggacagcccucaucagagcuggauccgugggcgccgaggccugucugaugcuuaagggggucaaagaagaccaaaccaaguuucugaaaaucaagaccgugagcucugagcucuccugccgggagggacagagcuacuggacaggcucuuucuccccuaaaugucugagcucuagacgcugccaucugguuggggaaugucacgugaaccggugccuuagcuggagagauaaugagaccuccgcugaauuuagcuucgucggcgagucuacaacgaugcgcgaaaacaagugcuuugagcaguguggaggcugggggugcggauguuucaaugugaaccccuccugccucuuuguucauaccuaucugcagagcgugcggaaggaggcgcugagagucuucaauuguauugacugggugcacaaacucacacuggaaaucaccgacuuugauggcuccgugucuacaauugaccuuggggccagcuccucucgcuucaccaacuggggaagcgucucccugucucucgaugcugagggcaucagcggguccaauagcuuuucuuucauugaauccccgggcaagggauacgccaucguugacgagccuuucagcgagauuccccggcaaggcuuucugggggaaaucagaugcaacucugaguccagcgugcugucugcccacgaauccugucuucgcgcucccaaucucaucagcuauaaaccuaugauugaucagcuggagugcacgaccaaccugaucgacccguucguggccuuugaacggggaucccucccccagacaagaaaugauaagaccuucgcggcuagcaaaggcaaccgcgggguccaggccuuuucuaagggaagcgugcaagccgaccugacacuuauguucgauaauuuugagguugacuucgugggcgcugccgucuccugugaugcggcuuuucugaaccucaccgggugcuacucuuguaaugccggcgcccgggugugccugagcauuacguccacaggaaccggcacacugucugcucauaacaaggacgggagccuucacaucguucucccuuccgagaacggaaccaaagaucagugccagauucugcauuucaccgugcccgaagucgaggaagaguuuauguauucuugugacggcgacgaaagaccucugcucgugaaggggacacugaucgccaucgaucccuucgacgaucggcgcgaggcuggaggcgagagcacgguugugaauccuaaauccggcagcuggaacuuuuucgacugguucucugggcuuauguccugguuuggaggcccccugaagaccauucuccugaucugccuguacgucgcccuuagcauuggacucuucuuucugcugaucuaccucgggagaacaggccugucuaaaauguggcuugcggccaccaagaaggcuuccuga

SEQ ID NO: 14587 - RNA, 3204 nt, Artificial Sequence
  derived and/or modified CDS sequence (opt5) from RVFV(KEN/Gar-008/06)__HM586965.1__Gn-Gc
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucaaauccaggugucucgcguguggaaaaagccucuuugcgucggcuaugaaagagugguugugaaacgggagcugagcgccaagcccauucagcgcgucgaaccuuguacgacaugcaucaccaaaugugagccccacgggcucgugguuagauccacaggauuuaagauuagcucugccguggcuugcgccuccggcgucugugugaccgggagccaaucucccagcaccgagaucacacugaaguacccuggaauuucccagucuagcggcggcgauaucgggguccauauggcgcacgacgaucaguccgugagcucuaaaauuguugcucauugcccgccccaggacccuugucuugugcacggaugcaucgucugcgcccauggccugaucaauuaucaaugucacacggcccucuccgcuuucgugguuauuuucguguuuagcucuaccgccaucauuugccuggcuguccuguaccgggugcucaagugucugaaaaucgcuccccgcaaggugcuuaacccucugauguggauuacagcguucaucagauggguuuauaaaaagauggucgcccggguggcugauaauaucaaccaggugaaucgcgaaauuggguggauggagggaggccagcucgcccuggggaaccccgcuccgaucccuagacacgcccccauuccucgguacuccaccuaccuuaugcugcuccugaucgucagcuaugcguccgccugcucugaacugauucaggcuagcucccgcaucacaaccuguucuacggagggcgugaacacaaagugcagacucagcggaaccgcccugauccgggcuggcuccguuggggccgaagccugucuuaugcugaaaggagugaaggaggaccaaaccaaauuucucaagauuaaaacagucagcucugagcuguccugcagagaaggccagagcuacuggaccgggucuuucucccccaagugucugagcucucgccggugccaucuugugggagagugucacguuaauagaugccucagcuggcgcgauaacgaaacauccgcugaguuuagcuucgugggcgaaucuacgaccaugcgggagaauaaaugcuuugagcagugugggggcuggggaugcggcuguuucaacgucaauccuuccugccuguuugugcauacauaucugcagagcguuagaaaggaagcgcuccgcguguucaacuguaucgacuggguccacaagcugacccuugagauuacagacuuugauggguccgugucuaccaucgaccugggagccagcuccucucgguucacgaauuggggcagcgugucccucucucuggaugcugaagggauuagcggauccaacagcuuuucuuucaucgagucccccggcaaaggguacgccauugucgacgagccguucagcgaaaucccuagacaaggcuuucugggagagauccgcugcaauucugaauccagcguucuuucugcccacgaguccugucuccgggcucccaaccuggugagcuauaagcccaugauugaucagcuggaaugcaccacaaaucucaucgacccuuucguggucuuugagagaggcucccugccgcagacccgcaacgauaaaacauucgccgcgagcaaggggaaucggggagugcaggcuuuuucuaaaggcagcguucaagccgaccuuacccugauguucgauaaccucaagguggacuuugucggggccgcuguguccugugaugccgcguuccugaaucugacgggaugcuacucuuguaacgcuggcgccagaguuugccuuagcauuacauccaccgggacaggcacccucucugcccauaacaaggacggaagccugcacaucgugcugcccuccgagaauggcaccaaagaucagugccagauucuccauuuuacagucccugaagugaaggaggaguucauguauucuugugacggggacgaacgggcucugcuuaugaaaggaacgcugaucgccaucgaucccuuugacgaucgcagagaagcuggcggggagagcaccguugugaacccuaaguccggaagcuggaauuucuuugacugguucucuggccucauguccugguucggcgggccccugaaaacaauucugcuuaucugccucuacgucgcccugagcauuggacuguuuuuccuccugaucuaccuuggccggaccgggcugucuaagauguggcucgcggccacaaagaaagccuccuga

SEQ ID NO: 14588 - RNA, 3204 nt, Artificial Sequence
  derived and/or modified CDS sequence (opt5) from RVFV(KEN/Bar-035/07)__HM586969.1__Gn-Gc
auggccggcaucgcuaugaccgugcugcccgcccucgcggucuucgcucuggccccuguuguguuugccgaggacccgcaccuuagaaaucggcccgggaagggacauaauuacauugauggccgccugcaggaagacgcuacaugcaaaccugugacguaugccggggcuuguagcuccuucgauguccuccuggagaagggaaaauuuccccuuuuccaaucuuacgcccaccauagaacccugcucgaagcggugcacgacacaaucauugccaaggcugauccucccagcugcgaccugcaguccgccgauggcaacaaauguaugaaggagaagcugguuaugaaaacccauugcccuaaugacuaucagucugcucacuaccucaacaaugaugggaagauggccagcgugaaauguccgcccaaguaugaacugacagaggacugcaacuuuugucggcagaugaccggagcgucccuuaaaaagggcucuuacccucugcaagaucucuucugccagagcuccgaggacgauggcagcaagcugaaaacaaagaugaaaggggucugugaagugggaguucaggcccuuaagaaaugcgacggccagcugucuaccgcucacgaggugguccccuuugccguguucaaaaauuccaagaagguguaucucgacaagcuggaucugaaaacggaagagaaccuccugccugacagcuuugucuguuucgagcauaaggggcaauacaaaggaaccauggauucuggccagacaaagcgcgaacuuaaauccuuugacaucagccagugccccaagauugggggacacggcucuaagaaaugcaccggcgaugcugccuucuguuccgccuacgagugcacagcucaguaugcgaaugccuacuguagccaugcuaacggguccggaaucguucaaauccaggugucuggcguguggaagaaaccgcugugcgucggguaugaaagagugguugugaagcgggagcucagcgccaaaccuauucagcgcgucgaacccuguaccacgugcaucacaaagugugagccucacggacuggugguuagauccaccggcuuuaagauuagcucugccguggcuugcgccuccggggucugugugacaggaagccaaucucccagcaccgagaucacccuuaaauaccccggcauuucccagucuagcggcggggacaucggaguccacauggcgcaugaugaccaguccgugagcucuaagauuguugcucacugcccuccgcaggaucccugucuggugcauggcugcaucgucugcgcccacgggcucaucaauuaucaaugucauacagcccuguccgcuuucgugguuauuuucguguuuagcucuacggccaucauuugccuggcuguccucuaccgggugcugaaaugucuuaagaucgccccucgcaaagugcugaacccccucauguggauuaccgcguucaucagauggguuuauaagaagauggucgcccggguggcugacaauaucaaccaggugaaucgcgaaauuggauggauggagggcgggcagcuggcccuuggcaacccugcucccaucccgagacacgccccuauuccccgguacuccacauaccugaugcuccugcugaucgucagcuaugcguccgccugcucugaacucauucaggcuagcucccgcaucaccacauguucuaccgagggagugaacacgaaaugcagacugagcggcacagcccuuauccgggcuagauccguuggggccgaagccugucugaugcucaagggagugaaagaggaucaaaccaaguuucugaaaauuaagaccgucagcucugagcuguccugccgcgaaggccagagcuacuggacagggucuuucuccccuaaaugucuuagcucucggagaugccaccucgugggagagugucauguuaaucgcugccugagcuggcgggacaacgaaaccuccgcugaguuuagcuucgugggcgaaucuacaacgaugagagagaauaagugcuuugagcagugugggggcuggggaugcggcuguuucaacgucaaucccuccugccuguuugugcacaccuaucuccagagcguucgcaaggaagcgcugcggguguucaacuguaucgacuggguccauaaacuuacacuggagauuaccgauuuugacggguccgugucuacaaucgaucucggagccagcuccucuagauucaccaauuggggcagcgugucccugucucuggacgcugaagggauuagcggauccaacagcuuuucuuucaucgaguccccuggcaagggguacgccauugucgaugagcccuucagcgaaaucccgcgccaaggcuuucuuggagagauccggugcaauucugaauccagcguucucucugcccacgaguccugucugagagcuccuaaccuggugagcuauaaacccaugauugaccagcucgaaugcacgaccaaucugaucgaucccuucguggucuuugagcgcggcucccuuccucagacacggaacgacaagaccuucgccgcgagcaaagggaauagaggagugcaggcuuuuucuaagggcagcguucaagccgaucugacacucauguucgacaacuuugagguggauuucgucggggccgcuguguccugugacgccgcguuucugaaucugaccggaugcuacucuuguaacgcuggcgcccggguuugccuuagcauuacguccacagggaccggcacacucucugcccacaacaaggauggaagccugcauaucgugcugccguccgaaaauggcaccaaagaccagugccagauucuccacuucaccguccccgagguggaagaggaauuuauguauucuugugacggggaugagcgcccucugcuuguuaagggaacacugaucgcuaucgaccccuucgaugacagacgggaggccggcggggaaagcacgguggucaacccuaaauccggaagcuggaacuuuuucgauugguucucuggccucauguccugguuuggcgggccccugaagaccauucugcuuaucugccucuacguggcucugagcauuggacuguucuuucuccugaucuaccuuggcagaacagggcugucuaaaauguggcucgccgcgaccaagaaggccuccuga

SEQ ID NO: 14589 - RNA, 3204 nt, Artificial Sequence
  derived and/or modified CDS sequence (opt5) from RVFV(Smithburn)__DQ380193.1__Gn-Gc
auggccggcaucgcuaugaccguguuccccgcccuggucguuuuugcgcucgcuccugugguguucgccgaggacccgcaccugagaaaccggcccgggaagggacauaauuacauugauggcaugacacaggaagacgccacgugcaaaccugucaccuaugcuggggccuguagcuccuuugaugugcuucuggagaagggaaaauucccccucuuucaaucuuacgcucaccaucgcacacugcuugaagccguucacgacaucauuaucgcgaaggccgauccucccagcugcaaccugcaguccgcucauggcaauccuuguaugaaagagaagcucgugaugaagaccuauugcccgaacgacuaccagucugcccacuaucugaauaacgaugggaaaauggcuagcgucaagugucccccuaaacacgaacugacagaggacugcaauuucuguagacagaugaccggagccucccucaaggagggcucuuacccccugcaagaucuguuuugccagagcuccgaagacgauggcagcaaacuuaagacaaagaugaaaggggugugugagguuggagugcagguccucaagaaaugcgacggccagcugucuaccgcgcaugaaguggugccuuucgccgucuuuaagaacuccaaaaagguuuaucuugauaaacuggaccucaagacggaggagaaucugcugcccgacagcuucguguguuuugaacacaaggggcaauacaaaggaaccauggauucuggccagauuaagcgggagcucaaauccuucgacaucagccagugcccgaagaucgggggacauggcucuaaaaagugcacaggcgaugcugccuuuuguuccgcuuacgaaugcaccgcccaguaugccaacgcuuacuguagccacgcgaauggguccggaauugugcaaauccaggucucuggcguguggaagaaaccucugugcguuggguaugagcgcguggucgugaagagagaacuuagcgccaaacccauucagcggguugagccuuguacaaccugcaucacgaagugugagccccacggacuggugguccgcuccacaggcuucaaaauuagcucugcuguggccugcgccuccggggucugugugaccggaagccaaucucccagcacagaaaucacccucaaguacccuggcauuucccagucuagcggcggggacaucggaguucauauggcucacgaugaccaguccgugagcucuaagaucgucgcccauugcccgccccaggauccuugucuggugcacggcugcauuguuugcgcgcaugggcuuaucaacuaucaaugucacaccgcuuucuccgccuuuguggucguguucguguuuagcucuguugucauuaucugccuggccauucucuacaaagugcugaagugucugaaaaucgcucccagaaaggugcucaauccucugauguggaucacagccuucauucggugggucuauaaaaagaugguggcucgcguugccgacaacaucaaucaggugaacagagagauuggauggauggaaggcgggcagcuuguccugggcaaccccgcgccgaucccucggcacgcccccauuccucgcuacuccacguaccucaugcugcuucugaucgugagcuaugcuuccgccugcucugagcucauccaggcuagcuccagaauuaccacauguucuaccgaaggaguuaauacaaagugccggcugagcggcaccgcccugauccgcgcgggguccgugggagccgaggcuugucucaugcugaaaggcgucaaggaggaucaaacgaaauuucuuaagauuaaaacagugagcucugaacuguccugcagagaggggcagagcuacuggaccggaucuuucucccccaagugucucagcucucggagaugccaucugguuggcgaaugucacgugaaccgcugccugagcuggcgggacaaugagaccuccgccgaauuuagcuucgucggggagucuacaaccaugagagagaacaaaugcuuugaacaguguggcggauggggcugcggguguuucaaugugaacccuuccugccuuuuugugcauacauaucuccagagcguccgcaaggaggcucugcggguuuucaauuguaucgauugggugcacaagcugacgcucgaaauuaccgacuuugacggauccgugucuacagucgaucugggcgccagcuccucuagauucaccaacugggggagcgugucccuuucucuggacgccgagggaaucagcggcuccaauagcuucucuuuuauugagucccccgggaaaggcuacgcuaucguugaugaaccguucagcgagaucccucgccaaggauuucucggcgaaauucggugcaacucugaguccagcgugcugucugcgcacgaauccugucugagagcccccaaucuuaucagcuauaagcccaugauugaccagcucgagugcacaaccaaccugaucgauccuuucgucguguuugagcgcgggucccugccgcagacgcggaaugacaaaaccuucgcugccagcaagggaaacagaggcguucaggccuuuucuaaagggagcgugcaagcugaucucacacugauguucgacaauuuugaagucgauuucgugggagccgcgguuuccugugacgcugccuuucuuaaccugaccggcugcuacucuuguaacgccggggcucgcgugugccucagcauuacauccaccggcacgggaacacugucugcccauaauaaggauggcagccugcacaucguccuucccuccgagaacgggaccaaggaccagugccagauccuccauuucacagugccugaaguggaggaagaguuuauguauucuugugauggagacgagcggccccugcuggucaaaggcacccucauugcgaucgacccuuucgaugacagacgggaagcugggggagagagcaccguugugaaucccaaguccggcagcuggaacuucuuugauugguucucuggccugauguccugguuugggggaccucuuaaaacaauucugcucaucugccuguacguggcccugagcauuggccuuuucuuuuuccucaucuaccuggggcgcacgggacugucuaagauguggcucgccgcuaccaaaaaggccuccuga

SEQ ID NO: 14590 - RNA, 3204 nt, Artificial Sequence
  derived and/or modified CDS sequence (opt5) from RVFV(Beijing-01)__KX611606.1__Gn-Gc
auggccggcaucgcuaugaccgugcugcccgcccucgcggucuucgcucuggccccuguuguguuugccgaggacccgcaccuuagaaaccggcccgggaagggacauaauuacauugauggcgugacacaggaagacgcuacgugcaaaccugucaccuaugccggggcuuguagcuccuucgaugugcugcucgagaagggaaaauuuccccuguuccaaucuuacgcccaccaucgcacacuucuggaagcgguucacgacaccaucauugccaaggcugauccucccagcugcgaccuccaguccgcccauggcaacccuuguaugaaagagaagcuggugaugaagacacacugcccgaaugauuaucagucugcucacuaccugaacaaugacgggaaaauggccagcgucaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggugugugaaguuggagugcaggcccugaaaaagugcgauggccggcuuucuacggcucaugaggucgugccuuuugccguguucaaaaauuccaagaaagucuaucuggacaagcucgaccugaagaccgaagagaaccugcuccccgauagcuuuguuuguuucgagcacaaagggcaguacaagggaacaauggacucuggccaaaccaaacgcgaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucgugcagauccaagugucuggcgucuggaaaaagccucuuugcgugggguaugaaagaguuguggucaaacgggagcugagcgccaagcccauucagcgcguggaaccuuguacgacaugcaucaccaaaugugagccccacggacucguugugagauccacaggcuuuaagauuagcucugccgucgcuugcgccuccggggugugugucaccggaagccagucucccagcaccgagaucacacugaaguacccuggcauuucccaaucuagcggcggggauaucggagugcauauggcgcacgacgaucaguccguuagcucuaaaauuguguucgacugcccgccccaggauccuugucuuguccauggcugcaucgugugcgcucacgggcugaucaauuaucagugucauacggcccucuccgccuucguuguggucuuuguguucagcucuguggcuauuaucugccuggccauucuguacaagguucuccggugucugaaaaucgcucccaagaaaguccuuaacccucugauguggauuaccgccuuuauccgcuggguguauaagaagaugguggcgagagucgccgacaauaucaaccaagugaaucgggaaauuggauggauggagggcgggcagcucgcucugggcaaccccgccccgaucccucgccacgcucccauuccuagauacuccacauaccuuaugcugcuccugaucauuagcuaugccuccgcgugcucugaacugauccaggccagcucccggaucaccacauguucuaccgagggaguuaacacgaaaugccgccucagcggcacagcucugauuagagccggguccgugggagcugaagccugucuuauguucgagggcgucaaggaggaucagaccaaauuucugaagaucaaaaccgugagcucugaacucuccugccgggaggggcaaagcuacuggacaggaucuuucucccccaagugucugagcucuagacgcugccaccugguuggcgaaugucaugugaaucggugccuuagcuggagagacaacgagaccuccgccgaauuuagcuucgucggggagucuacaacgaugcgcgagaauaaaugcuuugaacaguguggcggauggggcugcggguguuucaacgugaauccuuccugccucuuuguucacaccuaucugcagagcgugcggaaggaggcucugagagucuucaacuguauugacugggugcauaagcucacacuggaaaucaccgauuuugacggauccgugucuacaauugaucuuggcgcgagcuccucucgcuucaccaauugggggagcgucucccugucucucgacgccgagggaaucagcggcuccaacagcuucucuuuuauugagucccccgggaaaggcuacgcuaucguugaugaaccguucagcgagaucccucggcagggauuucugggcgaaauuagaugcaauucugaguccagcgugcugucugcccacgaauccugucuucgcgcccccaaccucaucagcuauaagcccaugauugaccaacuggagugcacgaccaaucugaucgauccuuucguggucuuugagcgggggucccucccgcagacaagaaacgacaaaaccuucgcugccagcaagggaaaucgcggcgugcaggcguuuucuaaagggagcguucaggcugaucugacacuuauguucgacaacuuugaaguggauuucgucggagccgccguguccugugacgcugccuuucugaaucucaccggcugcuacucuuguaacgcgggggcucggguuugccugagcauuacguccacaggcaccggaacacugucugcccacaacaaggauggcagccuucauaucgugcuccccuccgagaaugggaccaaggaccaaugccagauccugcacuucaccgucccugaaguggaggaagaguuuauguauucuugugacggagaugagagaccccugcucguuaaaggcacacugauugccaucgacccuuucgaugaccggcgcgaagcugggggagagagcacgguggucaaccccaaguccggcagcuggaauuucuuugauugguucucuggccuuauguccugguuugggggaccucugaaaaccauucuccugaucugccuguacguggcccuuagcauuggccucuucuuucugcugaucuaccucgggagaacaggacugucuaagauguggcuugcugccaccaaaaaggcguccuga

SEQ ID NO: 14591 - RNA, 3204 nt, Artificial Sequence
  derived and/or modified CDS sequence (opt5) from RVFV(KEN/Bar-032/07)__HM586968.1__Gn-Gc
auggccggcaucgcuaugaccgugcugcccgcccucgcggucuucgcucuggccccuguuguguuugccgaggacccgcaccuuagaaaucggcccgggaagggacauaauuacauugauggccgccugcaggaagacgcuacaugcaaaccugugacguaugccggggcuuguagcuccuucgauguccuccuggagaagggaaaauuuccccuuuuccaaucuuacgcccaccauagaacccugcucgaagcggugcacgacacaaucauugccaaggcugauccucccagcugcgaccugcaguccgccgauggcaacaaauguaugaaggagaagcugguuaugaaaacccauugcccuaaugacuaucagucugcucacuaccucaacaaugaugggaagauggccagcgugaaauguccgcccaaguaugaacugacagaggacugcaacuuuugucggcagaugaccggagcgucccuuaaaaagggcucuuacccucugcaagaucucuucugccagagcuccgaggacgauggcagcaagcugaaaacaaagaugaaaggggucugugaagugggaguucaggcccuuaagaaaugcgacggccagcugucuaccgcucacgaggugguccccuuugccguguucaaaaauuccaagaagguguaucucgacaagcuggaucugaaaacggaagagaaccuccugccugacagcuuugucuguuucgagcauaaggggcaauacaaaggaaccauggauucuggccagacaaagcgcgaacuuaaauccuuugacaucagccagugccccaagauugggggacacggcucuaagaaaugcaccggcgaugcugccuucuguuccgccuacgagugcacagcucaguaugcgaaugccuacuguagccaugcuaacggguccggaaucguucaaauccaggugucuggcguguggaagaaaccgcugugcgucggguaugaaagagugguugugaagcgggagcucagcgccaaaccuauucagcgcgucgaacccuguaccacgugcaucacaaagugugagccucacggacuggugguuagauccaccggcuuuaagauuagcucugccguggcuugcgccuccggggucugugugacaggaagccaaucucccagcaccgagaucacccuuaaauaccccggcauuucccagucuagcgucggcgacaucggggugcacauggcgcaugaugaccaguccguuagcucuaagauuguggcucacugcccuccgcaggaucccugucugguccauggaugcaucgugugcgcccacggccucaucaauuaucaaugucauacagcccuguccgcuuucguugugauuuucgucuuuagcucuacggccaucauuugccuggcugugcucuaccgggugcugaaaugucuuaagaucgccccucgcaaaguucugaacccccucauguggauuaccgcguucaucagaugggucuauaagaagaugguggcccggguggcugacaauaucaaccaggucaaucgcgaaauuggguggauggagggaggccagcuggcccuugggaacccugcucccaucccgagacacgccccuauuccccgguacuccacauaccugaugcuccugcugaucgugagcuaugcguccgccugcucugaacucauucaggcuagcucccgcaucaccacauguucuaccgagggcguuaacacgaaaugcagacugagccacacagcccuuauccgggcuggauccgugggcgccgaagccugucugaugcucaagggggucaaagaggaucaaaccaaguuucugaaaauuaagaccgugagcucugagcuguccugcagagaaggacagagcuacuggacaggcucuuucuccccuaaaugucuuagcucucgccggugccaucucguuggggagugucacgugaauagaugccugagcuggcgcgacaacgaaaccuccgcugaguuuagcuucgucggagaaucuacaacgaugcgggagaauaagugcuuugagcaguguggcggguggggcugcggauguuucaacgugaaucccuccugccuguuuguucauaccuaucuccagagcgugagaaaggaagcgcugcgcgucuucaacuguaucgacugggugcacaaacuuacacuggagauuaccgauuuugacggcuccgugucuacaaucgaucucggggccagcuccucucgguucaccaauuggggaagcgucucccugucucuggacgcugaaggcauuagcggguccaacagcuuuucuuucaucgaguccccuggaaagggcuacgccauuguugaugagcccuucagcgaaaucccgagacaaggguuucuuggcgagauccgcugcaauucugaauccagcgugcucucugcccacgaguccugucugcgggcuccuaaccuggugagcuauaaacccaugauugaccagcucgaaugcacgaccaaucugaucgaucccuucgucguguuugagagaggaucccuuccucagacacgcaacgacaagaccuucgccgcgagcaaaggcaauagagggguucaggcuuuuucuaagggaagcgugcaagccgaucugacacuccgguucgacaacuuugaggucgauuucgugggcgccgcuguuuccugugacgccgcguuucugaaucugaccgggugcuacucuuguaacgcuggagcccgggugugccuuagcauuacguccacaggcaccgggacacucucugcccauaacaaggauggcagccugcacaucguccugccguccgaaaauggaaccaaagaccagugccagauucuccauuucaccgugcccgagguugaagaggaauuuauguauucuugugacggcgaugagcgcccucugcuugugaaggggacacugaucgcuaucgaccccuucgaugacagacgggaggccggaggcgaaagcacggucgugaacccuaaauccgggagcuggaacuuuuucgauugguucucuggacucauguccugguuuggcggcccccugaagaccauucugcuuaucugccucuacguggcucugagcauugggcuguucuuucuccugaucuaccuuggaagaacaggccugucuaaaauguggcucgccgcgaccaagaaggccuccuga

SEQ ID NO: 14592 - RNA, 3204 nt, Artificial Sequence
  derived and/or modified CDS sequence (opt5) from RVFV(TAN/Dod-002/07)__HM586971.1__Gn-Gc
auggccggcaucgcuaugacagugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggccgcaagaagugcacaggcgacgcugccuucuguucugccuacgagugcaccgcucaguaugcgaaugccuacuguucccacgcuaacgggagcggaaucguucaaauccagguguccggcguguggaaaaagccucuuugcgucggguaugaaagagugguugugaaacgggagcugucugccaagcccauucagcgcgucgaaccuuguacgacaugcaucaccaaaugugagccccacggacucgugguuagaagcacaggcuuuaagauuuccagcgccguggcuugcgccucuggggucugugugaccggaucccaaagccccucuaccgagaucacacugaaguacccuggcauuagccaguccucuggcggggauaucggaguccauauggcgcacgacgaucagagcguguccagcaaaauuguugcucauugcccgccccaggacccuugucuugugcacggcugcaucgucugcgcccaagccuggaucauuucucaguggcauacggcucuguccgccuucgugguuaucuucguguuuagcucuaccgcuauuaucugucucgccguccuguaucgggugcugaagugccucaaaauugcgccccgcaaggugcugaauccucuuauguggaucacagccuucaucagauggguuuacaaaaagauggucgcucggguggccgauaacauuaaucaggugaaccgcgaaaucggguggauggagggaggccagcuggcucucgggaaucccgccccgauuccuagacacgcgcccaucccucgguauuccaccuaccugaugcuucugcucauugucagcuacgccuccgcuuguucugaacugauccaagccagcucccgcaucacaaccugcucuacggagggcgugaacacaaaguguagacugagcggaaccgcucucauucgggccggcuccguuggggccgaggcuugccugaugcuuaaaggagugaaggaagaccagaccaaauuucugaagaucaaaacagucagcucugagcucuccuguagagaaggccagagcuauuggaccgggucuuucucccccaagugccugagcucucgccggugucaccuggugggagagugccauguuaacagaugucuuagcuggcgcgauaaugaaacauccgcggaguuuagcuucgugggcgaaucuacgaccaugcgggagaacaaaugcuuugagcagugcgggggcuggggauguggcugcuucaaugucaacccuuccugucucuuugugcacacauaccugcaaagcguuagaaaggaagcccugcgcguguucaauugcauugacuggguccauaagcucacccuggagaucacagacuuugauggguccgugucuaccauugaccuuggagcuagcuccucucgguucacgaacuggggcagcgugucccugucucucgaugccgaagggaucagcggauccaauagcuuuucuuucauugagucccccggcaaaggguaugccaucgucgacgagccguucagcgaaaucccuagacagggcuuucugggagagauucgcuguaacucugaauccagcguucugucugcucacgaguccugccuucgggcccccaaucucgugagcuacaagcccaugaucgaucagcuggaauguaccacaaaccugauugacccuuucguggucuuugagagaggcucccucccgcagacccgcaaugauaaaacauucgcggcuagcaaggggaaccggggagugcaagccuuuucuaaaggcagcguucaggccgaccugacccuuauguucgauaauuuugagguggacuucgucggggcugccguguccugcgaugcggcuuuucugaaccucacgggauguuauucuugcaaugccggcgccagaguuugucugagcaucacauccaccgggacaggcacccugucugcucacaacaaggacggaagccuucauauugugcuccccuccgaaaacggcaccaaggaucagugccaaauccugcacuucacagucccugagguggaagaggaauuuauguacucuugcgacggggacgagcggccccugcucguuaaaggaacgcugaucgccauugauccuuucgacgaucgcagagaggcuggcggggaaagcaccguggucaaucccaaguccggaagcuggaacuuuuucgacugguucucuggccuuauguccugguuuggcgggccucugaaaacaauccuccugauuugucuguauguggcccuuagcaucggacucuucuuucugcugauuuaccucggccggaccgggcugucuaagauguggcuugcggccaccaaaaaggcuuccuga

SEQ ID NO: 14593 - RNA, 3204 nt, Artificial Sequence
  derived and/or modified CDS sequence (opt5) from RVFV(KEN/Gar-004/06)__HM586964.1__Gn-Gc
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauucccaaaagguguaucuggacaaacucgaccugaagaccgaagagaaccugcuccccgauagcuuugucuguuucgagcacaaggggcaguacaaaggaacaauggacucuggccagaccaagcgggaacugaaauccuuugauaucagccagugcccgaagauugggggacauggccgcaaaaagagaacaggcgacgcugccuucugcucugccuacgaguguaccgcucaauaugcgaaugccuacugcucccgggcuaacgggagcggaaucguucagauccaggugucccgcguguggaagaaaccucuuugugucggcuaugaaagagugguugugaagcgggagcugucugccaaacccauucaacgcgucgaaccuugcacgacauguaucaccaagugcgagccccacgggcucgugguuagaagcacaggauuuaaaauuuccagcgccguggcuugugccucuggcgucugcgugaccgggucccagagccccucuaccgagaucacacugaaguacccuggaauuagccaguccucuggcggcgauaucgggguccacauggcgcaugacgaucagagcguguccagcaagauuguugcucacuguccgccccaagacccuugccuugugcauggauguaucgucugcgcccacggccugaucaauaaccagucucauuccgcccucagcgcuuucgugguuauuuucguguuuucuuccacggccaucauuugccuggcuguccuguaucgggugcucaaaugucugaagaucgcuccccgcaaagugcuuaauccucugauguggauuaccgcguucaucagauggguuuacaagaaaauggucgcccggguggcugauaacaucaaucaggugaaccgcgaaauuggguggauggagggaggccagcucgcccuggggaaccccgcuccgaucccuagacacgcccccauuccucgguauagcacauaccuuaugcugcuccugaucgucuccuacgcgucugccugcagcgaacugauucaagccuccucuagaaucaccacauguagcaccgagggcgugaauacgaagugccgccucuccggaacagcccugauccgggcuggcagcguuggggccgaagccugucuuaugcugaagggagugaaagaggaccagaccaaguuucucaaaauuaagaccgucucuuccgagcugagcugcagagaaggccagucuuauuggacaggguccuucagccccaaaugucugucuagccgccggugccaccuugugggagagugucauguuaacagaugccucuccuggcgcgauaaugaaaccagcgcugaguuuucuuucgugggcgaauccacaacgaugcgggagaacaaguguuuugagcagugcgggggcuggggaugcggcuguuucaaugucaacccuagcugccuguuugugcacaccuaccugcaauccguuagaaaagaagcgcuccgcguguucaauuguaucgacuggguccauaagcugacacuugagauuaccgacuuugaugggucugugagcacaaucgaccugggagccuccucuagccgguucaccaacuggggcuccgugucucucagccuggaugcugaagggauuuccggaagcaauucuuuuuccuucaucgagagccccggcaagggguaugccauugucgacgagccguucucugaaaucccuagacagggcuuucugggagagauccgcugcaacuccgaaagcucuguucuuuccgcccacgagagcugucuccgggcucccaaucugguguccuacaaacccaugauugaucagcuggaaugcacgaccaaccucaucgacccuuucguggucuuugagagaggcagccugccgcagacacggaaugauaagaccuucgccgcgucuaaagggaaccgcggagugcaggcuuuuagcaagggcuccguucaagccgaccuuacacugagauucgauaauuuugagguggacuucgucggggccgcugugucuugugaugccgcguuucucaaccugaccggaugcuauagcuguaacgcuggcgcccggguuugccuguccauuacgucuacagggaccggcacacuuagcgcccacaauaaagacggaucccuccauaucgugcugcccucugaaaacggcaccaaggaucagugucaaauucugcacuucaccgucccugagguggaagaggaauuuauguacagcugcgacggggacgagagaccccuccugguuaagggaacacuuaucgcuaucgauccuuucgacgaucgccgggaggccggcggggaauccacgguggucaaucccaaaagcggaucuuggaacuuuuucgacugguucuccggccugaugagcugguuuggcgggccucucaagaccauucugcugaucugccuuuauguggcucucucuauuggacuguucuuucugcucaucuaccugggcagaacagggcuuuccaaaauguggcuggccgcgaccaagaaagccagcuga

SEQ ID NO: 14594 - RNA, 1680 nt, Artificial Sequence
  derived and/or modified CDS sequence (opt5) from RVFV(ZH-548)__DQ380206.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccuguccgcccauggcaacccuuguaugaaagagaagcugguuaugaagacacacugcccgaaugauuaucagucugcucacuaccucaacaaugacgggaaaauggccagcgugaagugucccccuaaauaugaacugaccgaggauugcaacuuuuguagacagaugacaggagcgucccuuaagaaaggcucuuacccccugcaggaccucuucugccaaagcuccgaggaugacggcagcaagcugaagaccaaaaugaagggggucugugaagugggaguucaggcccuuaaaaagugcgauggccagcugucuacggcucaugagguggucccuuuugccguguucaaaaauuccaagaaaguguaucucgacaagcuggaccugaagaccgaagagaaccuccugcccgauagcuuugucuguuucgagcacaaagggcaguacaagggaacaauggacucuggccaaaccaaacgggaacuuaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucagauccaagugucuggcguguggaaaaagccucugugcgucggguaugaacgcgugguugugaaaagagagcucagcgccaagcccauucagcgggucgaaccuuguacgacaugcaucaccaaaugugagccccacggacuggugguucgcuccacaggcuuuaagauuagcucugccguggcuugcgccuccggggucugugugaccggaagccagucucccagcaccgagaucacacuuaaguacccuggcauuucccaaucuagcggcggggauaucggaguccauauggcgcacgacgaucaguccgugagcucuaaaauuguugcucauugcccgccccaggacccuugucuggugcacgauugcaucgucugcgcccauggccucaucaauuaucagugucacacggcccuguccgcuuucgugguuguguucgucuuuagcucuauugccaucauuugccuggcuauccucuacagagugcugaagugucuuaaaauugcgccccggaaggugcugaacccucucauguggaucaccgccuucauccgcuggauuuauaaaaagaugguugccagagucgcugacaauaucaaccaagugaaucgggaaauuggguggauggagggaggccagcuggugcuugggaaccccgccccgaucccucgccacgcucccauuccuagauacuccacauaccugaugcuccugcugaucgucagcuaugccuccgcg

SEQ ID NO: 14595 - RNA, 1680 nt, Artificial Sequence
  derived and/or modified CDS sequence (opt5) from RVFV(MP-12)__DQ380208.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccuguccgcccauggcaacccuuguaugaaagagaagcugguuaugaagacacacugcccgaaugauuaucagucugcucaccaucucaacaaugacgggaaaauggccagcgugaagugucccccuaaauacgaacugaccgaggauugcaacuuuuguagacagaugacaggagcgucccuuaagaaaggcucuuauccccugcaggaccucuucugccaaagcuccgaggaugacggcagcaagcugaagaccaaaaugaagggggucugugaagugggaguucaggcccuuaaaaagugcgauggccagcugucuacggcucacgagguggucccuuuugccguguucaaaaauuccaagaaaguguaccucgacaagcuggaccugaagaccgaagagaaccuccugcccgauagcuuugucuguuucgagcauaaagggcaguauaagggaacaauggacucuggccaaaccaaacgggaacuuaaguccuuugauaucagccagugcccgaaaauugggggacacggcucuaagaagugcacaggcgacgcugccuucuguuccgccuacgagugcaccgcucaguacgcgaaugccuauuguagccacgcuaacggguccggaaucguucagauccaagugucuggcguguggaaaaagccucugugcgucggguacgaacgcgugguugugaaaagagagcucagcgccaagcccauucagcgggucgaaccuuguacgacaugcaucaccaaaugugagccccauggacuggugguucgcuccacaggcuuuaagauuagcucugccguggcuugcgccuccggggucugugugaccggaagccagucucccagcaccgagaucacacuuaaguauccuggcauuucccaaucuagcggcggggauaucggaguccacauggcgcaugacgaucaguccgugagcucuaaaauuguugcucacugcccgccccaggacccuugucuggugcaugauugcaucgucugcgcccacggccucaucaauuaccagugucacacggcccuguccgcuuucgugguuguguucgucuuuagcucuauugccaucauuugccuggcuauccucuauagagugcugaagugucuuaaaauugcgccccggaaggugcugaacccucucauguggaucaccgccuucauccgcuggauuuacaaaaagaugguugccagagucgcugacaauaucaaccaagugaaucgggaaauuggguggauggagggaggccagcuggugcuugggaaccccgccccgaucccucgccaugcucccauuccuagauauuccacauaccugaugcuccugcugaucgucagcuacgccuccgcg

SEQ ID NO: 14596 - RNA, 1680 nt, Artificial Sequence
  derived and/or modified CDS sequence (opt5) from RVFV(MP12)__Z30318.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccuguccgcccauggcaacccuuguaugaaagagaagcugguuaugaagacacacugcccgaaugauuaucagucugcucaccaucucaacaaugacgggaaaauggccagcgugaagugucccccuaaauacgaacugaccgaggauugcaacuuuuguagacagaugacaggagcgucccuuaagaaaggcucuuauccccugcaggaccucuucugccaaagcuccgaggaugacggcagcaagcugaagaccaaaaugaagggggucugugaagugggaguucaggcccuuaaaaagugcgauggccagcugucuacggcucacgagguggucccuuuugccguguucaaaaauuccaagaaaguguaccucgacaagcuggaccugaagaccgaagagaaccuccugcccgauagcuuugucuguuucgagcauaaagggcaguauaagggaacaauggacucuggccaaaccaaacgggaacuuaaguccuuugauaucagccagugcccgaaaauugggggacacggcucuaagaagugcacaggcgacgcugccuucuguuccgccuacgagugcaccgcucaguacgcgaaugccuauuguagccacgcuaacggguccggaaucguucagauccaagugucuggcguguggaaaaagccucugugcgucggguacgaacgcgugguugugaaaagagagcucagcgccaagcccauucagcgggucgaaccuuguacgacaugcaucaccaaaugugagccccauggacuggugguucgcuccacaggcuuuaagauuagcucugccguggcuugcgccuccggggucugugugaccggaagccagucucccagcaccgagaucacacuuaaguauccuggcauuucccaaucuagcggcggggauaucggaguccacauggcgcaugacgaucaguccgugagcucuaaaauuguugcucacugcccgccccaggacccuugucuggugcaugauugcaucgucugcgcccacggccucaucaauuaccagugucacacggcccuguccgcuuucgugguuguguucgucuuuagcucuauugccaucauuugccuggcuauccucuauagagugcugaagugucuuaaaauugcgccccggaaggugcugaacccucucauguggaucaccgccuucauccgcuggauuuacaaaaagaugguugccagagucgcucauaauaucaaccaagugaaucgggaaauuggguggauggagggaggccagcuggugcuugggaaccccgccccgaucccucgccacgcucccauuccuagauauuccacauaccugaugcuccugcugaucgucagcuacgccuccgcg

SEQ ID NO: 14597 - RNA, 1680 nt, Artificial Sequence
  derived and/or modified CDS sequence (opt5) from RVFV(2007001811)__EU574040.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucaaauccaggugucuggcguguggaaaaagccucuuugcgucggguaugaacgcgugguugugaaaagagagcugagcgccaagcccauucagcgggucgaaccuuguacgacaugcaucaccaaaugugagccccacggacucgugguucgcuccacaggcuuuaagauuagcucugccguggcuugcgccuccggggucugugugaccggaagccaaucucccagcaccgagaucacacugaaguacccuggcauuucccagucuagcggcggggauaucggaguccauauggcgcacgacgaucaguccgugagcucuaaaauuguugcucauugcccgccccaggacccuugucuugugcacggcugcaucgucugcgcccaugggcugaucaauuaucaaugucacacggcccucuccgcuuucgugguuguguucgucuuuagcucuauugccaucauuugccuggcuauccuguacagagugcucaagugucugaaaauugcgccccggaaggugcuuaacccucugauguggaucaccgccuucauccgcuggguuuauaaaaagauggucgccagaguggcugauaauauuaaccaggugaaucgggaaaucggauggauggagggcgggcagcucguccugggcaaccccgccccgauuccucgccacgcucccaucccuagauacuccacauaccuuaugcugcuccugauugugagcuaugccuccgcg

SEQ ID NO: 14598 - RNA, 1680 nt, Artificial Sequence
  derived and/or modified CDS sequence (opt5) from RVFV(2250/74)__DQ380209.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucaaauccaggugucuggcguguggaaaaagccucuuugcgucggguaugaacgcgugguugugaaaagagagcugagcgccaagcccauucagcgggucgaaccuuguacgacaugcaucaccaaaugugagccccacggacucgugguucgcuccacaggcuuuaagauuagcucugccguggcuugcgccuccggggucugugugaccggaagccaaucucccagcaccgagaucacacugaaguacccuggcauuucccagucuagcggcggggauaucggaguccauauggcgcacgacgaucaguccgugagcucuaaaauuguugcucauugcccgccccaggacccuugucuugugcacggcugcaucgucugcgcccaugggcugaucaauuaucaaugucacacggcccucuccgcuuucgugguuguguucgucuuuagcucuauugccaucauuugccuggcuauccuguacagagugcucaagugucugaaaauugcgccccggaaggugcuuaacccucugauguggaucaccgccuucauccgcuggauuuauaaaaagaugguugccagagucgcugauaauaucaaccaggugaaucgggaaauuggauggauggagggcgggcagcucgugcugggcaaccccgccccgaucccucgccacgcucccauuccuagauacuccacauaccuuaugcugcuccugaucgucagcuaugccuccgcg

SEQ ID NO: 14599 - RNA, 1680 nt, Artificial Sequence
  derived and/or modified CDS sequence (opt5) from RVFV(T1)__DQ380201.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucaaauccaggugucuggcguguggaaaaagccucuuugcgucggguaugaacgcgugguugugaaaagagagcugagcgccaagcccauucagcgggucgaaccuuguacgacaugcaucaccaaaugugagccccacggacucgugguucgcuccacaggcuuuaagauuagcucugccguggcuugcgccuccggggucugugugaccggaagccaaucucccagcaccgagaucacacugaaguacccuggcauuucccagucuagcggcggggauaucggaguccauauggcgcacgacgaucaguccgugagcucuaaaauuguugcucauugcccgccccaggacccuugucuugugcacggcugcaucgucugcgcccaugggcugaucaauuaucaaugucacacggcccucuccgcuuucgugguuguguucgucuuuagcucuauugccaucauuugccuggcugugcuguacagagugcucaagugucugaaaaucgcgccccggaagguucuuaacccucugauguggauuaccgccuucauccgcuggaucuauaaaaagauggucgccagaguggcugauaauauuaaccaggugaaucgggaaaucggauggauggagggcgggcagcucguccugggcaaccccgccccgauuccucgccacgcucccaucccuagauacuccacauaccuuaugcugcuccugauugugagcuaugccuccgcg

SEQ ID NO: 14600 - RNA, 1680 nt, Artificial Sequence
  derived and/or modified CDS sequence (opt5) from RVFV(Ken 199800523)__KU978777.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuuuuguagccacgcuaacggguccggaaucguucaaauccaggugucuggcguguggaaaaagccucuuugcgucggguacgaacgcgugguugugaaaagagagcugagcgccaagcccauucagcgggucgaaccuuguacgacaugcaucaccaaaugugagccccacggacucgugguucgcuccacaggcuucaagauuagcucugccguggcuugcgccuccggggucugugugaccggaagccaaucucccagcaccgagaucacacugaaguauccuggcauuucccagucuagcggcggggauaucggaguccauauggcgcacgacgaucaguccgugagcucuaaaauuguugcucauugcccgccccaggacccuugucuugugcacggcugcaucgucugcgcccaugggcugaucaauuaccaaugucacacggcccucuccgcuuucgugguuguguuugucuucagcucuauugccaucauuugccuggcuauccuguauagagugcucaagugucugaaaauugcgccccggaaggugcuuaacccucugauguggaucaccgccuuuauccgcuggguuuacaaaaagauggucgccagaguggcugauaauauuaaccaggugaaucgggaaaucggauggauggagggcgggcagcucguccugggcaaccccgccccgauuccucgccacgcucccaucccuagauauuccacauaccuuaugcugcuccugauugugagcuacgccuccgcg

SEQ ID NO: 14601 - RNA, 1680 nt, Artificial Sequence
  derived and/or modified CDS sequence (opt5) from RVFV(1853/78)__DQ380220.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaguugugcaaauccaggugucuggcgucuggaaaaagccucuuugcgugggguaugaacgcguuguggucaaaagagagcugagcgccaagcccauccagcggguggaaccuuguacgacaugcauuaccaaaugugagccccacggacucguugugcgcuccacaggcuuuaagaucagcucugccgucgcuugcgccuccggggugugugucaccggaagccaaucucccagcaccgagauuacacugaaguacccuggcaucucccagucuagcggcggggauauuggagugcauauggcgcacgacgaucaguccguuagcucuaaaaucguggcucauugcccgccccaggacccuugucuuguccacggcugcauugugugcgcccaugggcugaucaauuaucaaugucacacggcccucuccgcuuucguuguggucuucguguuuagcucuaucgccauuaucugccuggcuauucuguacagagugcucaagugucugaaaaucgcgccccggaagguucuuaacccucugauguggauuaccgccuucauccgcugggucuauaaaaagaugguggccagaguggcugauaauaucaaccaggucaaucgggaaauuggauggauggagggcgggcagcucgugcugggcaaccccgccccgaucccucgccacgcucccauuccuagauacuccacauaccuuaugcugcuccugaucguuagcuaugccuccgcg

SEQ ID NO: 14602 - RNA, 1680 nt, Artificial Sequence
  derived and/or modified CDS sequence (opt5) from RVFV(73HB1449)__DQ380211.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucaaauccaggugucuggcguguggaaaaagccucuuugcgucggguaugaacgcgugguugugaaaagagagcugagcgccaagcccauucagcgggucgaaccuuguacgacaugcaucaccaaaugugagccccacggacucgugguucgcuccacaggcuuuaagauuagcucugccguggcuugcgccuccggggucugugugaccggaagccaaaaucccucuaccgagaucacacugaaguacccuggcauuagccaguccucuggcggggauaucggaguccauauggcgcacgacgaucagagcguguccagcaaaauuguugcucauugcccgccccaggacccuugucuugugcacggcugcaucgucugcgcccaugggcugaucaacuaucaaugucacacggcccucucugcuuucgugguuguguucgucuuuuccagcauugccaucauuugccuggcuauccuguacagagugcucaagugucugaaaauugcgccccggaaggugcuuaauccucugauguggaucaccgccuucauccgcuggguuuauaaaaagauggucgccagaguggcugauaacauuaaucaggugaaccgggaaaucggauggauggagggcgggcagcucguccugggcaaccccgccccgauuccucgccacgcucccaucccuagauacucuacauaccuuaugcugcuccugauuguguccuaugccagcgcg

SEQ ID NO: 14603 - RNA, 1680 nt, Artificial Sequence
  derived and/or modified CDS sequence (opt5) from RVFV(2007000234)__JF326191.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucaaauccaggugucuggcguguggaaaaagccucuuugcgucggguaugaacgcgugguugugaaaagagagcugagcgccaagcccauucagcgggucgaaccuuguacgacaugcaucaccaaaugugagccccacggacucgugguucgcuccacaggcuuuaagauuagcucugccguggcuugcgccuccggggucugugugaccggaagccaaucucccagcaccgagaucacacugaaguacccuggcauuucccagucuagcggcggggauaucggaguccauauggcgcacgacgaucaguccgugagcucuaaaauuguugcucauugcccgccccaggacccuugucuugugcacggcugcaucgucugcgcccaugggcugaucaauuaucaaugucacacggcccucuccgcuuucgugguuauuuucguguuuagcucuaccgccaucauuugccuggcuguccuguacagagugcucaagugucugaaaaucgcgccccggaaggugcuuaacccucugauguggauuacagccuucauccgcuggguuuauaaaaagauggucgccagaguggcugauaauaucaaccaggugaaucgggaaauuggauggauggagggcgggcagcucgcccugggcaaccccgcuccgaucccucgccacgcccccauuccuagauacuccaccuaccuuaugcugcuccugaucgucagcuaugcguccgcc

SEQ ID NO: 14604 - RNA, 1680 nt, Artificial Sequence
  derived and/or modified CDS sequence (opt5) from RVFV(73HB1230)__DQ380221.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaaaaggaacugaaauccuuugauaucagccagugcccgaagauugggggacauggcucuaagaaaugcacaggcgacgcugccuucuguuccgccuacgagugcaccgcucaguaugcgaaugccuacuguagccacgcuaacggguccggaaucguucaaauccaggugucuggcguguggaagaaaccucuuugcgucggguaugaacgggugguugugaagcgcgagcugagcgccaaacccauucagagagucgaaccuuguacgacaugcaucaccaagugugagccccacggacucgugguucgguccacaggcuuuaagauuagcucugccguggcuugcgccuccggggucugugugaccggaagccaaucucccagcaccgagaucacacugaaauacccuggcauuucccagucuagcggcggggauaucggaguccauauggcgcacgacgaucaguccgugagcucuaagauuguugcucauugcccgccccaggacccuugucuugugcacggcugcaucgucugcgcccaugggcugaucaauuaucaaugucacacggcccucuccgcuuucgugguuguguucgucuuuagcucuauugccaucauuugccuggcuauccuguaccgcgugcucaaaugucugaagauugcccccagaaaagugcuuaacccucugauguggaucaccgcguucauccgguggguuuauaagaagauggucgcccgcguggcugauaauauuaaccaggugaauagagaaaucggauggauggagggcgggcagcucguccugggcaaccccgccccgauuccucggcacgcucccaucccucgcuacuccacauaccuuaugcugcuccugauugugagcuaugccuccgcg

SEQ ID NO: 14605 - RNA, 1680 nt, Artificial Sequence
  derived and/or modified CDS sequence (opt5) from RVFV(ZM-657)__DQ380204.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaagccuacuguagccacgcuaauggguccggaaucguucaaauccaggugucuggcguguggaagaaaccucuuugcgucggguaugaacgcgugguugugaagagagagcugagcgccaaacccauucagcgggucgaaccuuguacgacaugcaucaccaagugugagccccacggacucgugguucgcuccacaggcuuuaagauuagcucugccguggcuugcgccuccggggucugugugaccggaagccaaucucccagcaccgagaucacacugaaauacccuggcauuucccagucuagcggcggggauaucggaguccauauggcgcacgacgaucaguccgugagcucuaagauuguugcucauugcccgccccaggacccuugucuugugcacggcugcaucgucugcgcccaugggcugaucaacuaucaaugucacacggcccucuccgcuuucgugguuguguucgucuuuagcucuauugccaucauuugccuggcuauccuguacagagugcucaaaugucugaagauugcgccccggaaagugcuuaauccucugauguggaucaccgccuucauccgcuggauuuauaagaagaugguugccagagucgcugauaacaucaaucaggugaaccgggaaauuggauggauggagggcgggcagcucgugcugggcaaucccgccccgaucccucgccacgcucccauuccuagauacuccacauaccuuaugcugcuccugaucgucagcuaugccuccgcg

SEQ ID NO: 14606 - RNA, 1680 nt, Artificial Sequence
  derived and/or modified CDS sequence (opt5) from RVFV(Kenya 83 (21445))__DQ380198.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucaaauccaggugucuggcguguggaaaaagccucuuugcgucggguaugaacgcgugguugugaaaagagagcugagcgccaagcccauucagcgggucgaaccuuguacgacaugcaucaccaaaugugagccccacggacucgugguucgcuccacaggcuuuaagauuagcucugccguggcuugcgccuccggggucugugugaccggaagccaaucucccagcaccgagaucacacugaaguacccuggcauuucccagucuagcggcggggauaucggaguccauauggcgcacgacgaucaguccgugagcucuaaaauuguugcucauugcccgccccaggacccuugucuugugcacggcugcaucgucugcgcccaugggcugaucaauuaucaaugucacacggcccucuccgcuuucgugguuguguucgucuuuagcucuauugccaucauuugccuggcuauccuguacagagugcucaagugucugaaaauugcgccccggaaggugcuuaacccucugauguggaucaccgccuucauccgcuggguuuauaaaaagauggucgccagaguggcugauaauauuaaccaggugaaucgggaaaucggauggauggagggcgggcagcucgcccugggcaaccccgcuccgauuccucgccacgcccccaucccuagauacuccacauaccuuaugcugcuccugauugucagcuaugcguccgcc

SEQ ID NO: 14607 - RNA, 1680 nt, Artificial Sequence
  derived and/or modified CDS sequence (opt5) from RVFV(SAUDI 200010901)__KU978778.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuuuuguagccacgcuaacggguccggaaucguucaaauccaggugucuggcguguggaaaaagccucuuugcgucggguacgaacgcgugguugugaaaagagagcugagcgccaagcccauucagcgggucgaaccuuguacgacaugcaucaccaaaugugagccccacggacucgugguucgcuccacaggcuucaagauuagcucugccguggcuugcgccuccggggucugugugaccggaagccaaucucccagcaccgagaucacacugaaguauccuggcauuucccagucuagcggcggggauaucggaguccauauggcgcacgacgaucaguccgugagcucuaaaauuguugcucauugcccgccccaggacccuugucuugugcacggcugcaucgucugcgcccaugggcugaucaauuaccaaugucacacggcccucuccgcuuucgugguuguguuugucuucagcucuauugccaucauuugccuggcuauccuguauagagugcucaagugucugaaaauugcgccccggaaggugcuuaacccucugauguggaucaccgccuuuauccgcuggguuuacaaaaagauggucgccagaguggcugauaauauuaaccaggugaaucgggaaaucggauggauggagggcgggcagcucguccugggcaaccccgccccgauuccucgccacgcucccaucccuagauauuccacauaccuuaugcugcuccugauuaucagcuacgccuccgcg

SEQ ID NO: 14608 - RNA, 1680 nt, Artificial Sequence
  derived and/or modified CDS sequence (opt5) from RVFV(2007004194)__EU574031.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugagcaacgacgggaaaauggccuccgugaagugucccccuaaauaugaacucaccgaggauugcaauuuuuguagacagaugacaggagcgucucugaagaaaggcagcuacccccuucaagaccuguucugccaguccagcgaggaugacggcucuaagcucaagaccaaaaugaagggggucugugaagugggaguucaggcccugaaaaagugcgauggccagcuuuccacggcucaugagguggucccuuuugccguguucaaaaacagcaagaaaguguaucuggacaagcucgaccugaagaccgaagagaaucugcuccccgauucuuuugucuguuucgagcacaaagggcaauacaagggaacaauggacuccggccagaccaaacgggaacuuaagagcuuugauaucucucagugcccgaaaauugggggacauggcuccaagaagugcacaggcgacgcugccuucuguagcgccuacgagugcaccgcucaguaugcgaacgccuacuguucccacgcuaaugggucuggaaucguucaaauccaggugagcggcguguggaaaaagccucugugcgucggguaugaacgcgugguugugaaaagagagcuguccgccaagcccauucagcgggucgaaccuuguacgacaugcaucaccaaaugugagccccacggacucgugguucgcagcacaggcuuuaagauuucuuccgccguggcuugcgccagcggggucugugugaccggaucucaaagccccuccaccgagaucacacugaaguacccuggcauuucucagagcuccggcggggauaucggaguccauauggcgcacgacgaucagagcgugucuuccaaaauuguugcucauugcccgccccaggacccuugucuugugcacggcugcaucgucugcgcccaugggcugaucaacuaucaaugucacacggcccucagcgcuuucgugguuguguucgucuuuucuuccauugccaucauuugccuggcuauccuguacagagugcucaagugucugaaaauugcgccccggaaggugcuuaauccucugauguggaucaccgccuucauccgcuggguuuauaaaaagauggucgccagaguggcugauaacauuaaucaggugaaccgggaaaucggauggauggagggcgggcagcucguccugggcaaucccgccccgauuccucgccacgcucccaucccuagauacagcacauaccuuaugcugcuccugauuguguccuaugccucugcg

SEQ ID NO: 14609 - RNA, 1680 nt, Artificial Sequence
  derived and/or modified CDS sequence (opt5) from RVFV(ZH-501-777)__DQ380202.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacccgggccagaccaaacgggaacugaagucuuuugauaucucccagugcccuaaaauugggggacauggcagcaagaagugcacaggcgacgcugccuucuguucugccuacgagugcaccgcucaguaugcgaaugccuacuguucccacgcuaacgggagcggaaucguucaaauccagguguccggcguguggaaaaagccccuuugcgucggguaugaacgcgugguugugaaaagagagcugucugccaagccuauucagcgggucgaacccuguacgacaugcaucaccaaaugugagccccacggacucgugguucgcagcacaggcuuuaagauuuccagcgccguggcuugcgccucuggggucugugugaccggaucccaaagcccuucuaccgagaucacacugaaguacccgggcauuagccaguccucuggcggggauaucggaguccauauggcgcacgacgaucagagcguguccagcaaaauuguugcucauugucccccucaggaccccugccuugugcacggcugcaucgucugcgcccaugggcugaucaauuaucaaugucacacggcccucucugcuuucgugguuguguucgucuuuuccagcauugccaucauuugccuggcugugcuguacagagugcucaagugucugaaaaucgccccucggaagguucuuaacccccugauguggauuaccgcguucauccgcuggaucuauaaaaagauggucgccagaguggcugauaauauuaaccaggugaaucgggaaaucggauggauggagggcgggcagcucguccugggcaacccggccccuauuccccgccacgcuccuauccccagauacucuacauaccuuaugcugcuccugauuguguccuaugccagcgcg

SEQ ID NO: 14610 - RNA, 1680 nt, Artificial Sequence
  derived and/or modified CDS sequence (opt5) from RVFV(ZC-3349)__DQ380207.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucaaauccaggugucuggcguguggaaaaagccucuuugcgucggguaugaacgcgugguugugaaaagagagcugagcgccaagcccauucagcgggucgaaccuuguacgacaugcaucaccaaaugugagccccacggacucgugguucgcuccacaggcuuuaagauuagcucugccguggcuugcgccuccggggucugugugaccggaagccaaucucccagcaccgagaucacacugaaguacccuggcauuucccagucuagcggcggggauaucggaguccauauggcgcacgacgaucaggcuguguccagcaaaauuguugcccauugcccgccccaggacccuugucuugugcacggcugcaucgucugcgcccaugggcugaucaauuaucaaugucacacggcucucucugccuucgugguuguguucgucuuuuccagcauugcuaucauuugccuggccauccuguacagagugcucaagugucugaaaauugcgccccggaaggugcuuaacccucugauguggaucaccgccuucauccgcuggauuuauaaaaagaugguugcuagagucgccgauaauaucaaccacgugaaucgggaaauuggauggauggagggcgggcagcucgugcugggcaaccccgcuccgaucccucgccaugcccccauuccuagauacucuacauaccuuaugcugcuccugaucgucuccuaugcgagcgcc

SEQ ID NO: 14611 - RNA, 1680 nt, Artificial Sequence
  derived and/or modified CDS sequence (opt5) from RVFV(200803166)__JF311381.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucaagaaaggaaaguuuccccuguuccaaucuuacgcccaccaucgcacacuucuggaggcggugcacgacaccaucauugccaaagcugauccucccagcugcgaccuccaguccgcccauggcaacccuuguaugaaggaaaagcugguuaugaaaacacacugcccgaaugauuaucagucugcucacuaccugaacaaugacgggaagauggccagcgugaaaugucccccuaaguaugagcucaccgaagauugcaacuuuuguagacagaugacaggagcgucccugaaaaagggcucuuacccccuucaagaccuguucugccagagcuccgaggaugacggcagcaagcucaaaaccaagaugaaaggggucugugaggugggaguucaggcccugaagaaaugcgauggccagcuuucuacggcucaugaaguggucccuuuugccguguucaaaaauuccaagaagguguaucuggacaagcucgaccugaaaaccgaggaaaaccugcuccccgauagcuuugucuguuucgagcacaaggggcaauacaaaggaacaauggacucuggccagaccaagcgggagcugaaauccuuugauaucagccagugcccgaagauugggggacauggcucuaagaaaugcacaggcgacgcugccuucuguuccgccuacgaaugcaccgcucaguaugcgaaugccuacuguagccacgcuaacggguccggaaucguucaaauccaggugucuggcguguggaagaaaccucuuugcgucggguaugagcgcgugguugugaagagagaacugagcgccaaacccauucagcgggucgagccuuguacgacaugcaucaccaagugugaaccccacggacucgugguucgcuccacaggcuuuaagauuagcucugccguggcuugcgccuccggggucugugugaccggaagccaaucucccagcaccgagaucacacugaaauacccuggcauuucccagucuagcggcggggauaucggaguccauauggcgcacgacgaucaguccgugagcucuaagauuguugcucauugcccgccccaggacccuugucuugugcacggcugcaucgucugcgcccaugggcugaucaauuaucaaugucacacggcccucuccgcuuucgugguuguguucgucuuuagcucuauugccaucauuugccuggcuauccuguacagagugcucaaaugucugaagauugcgccccggaaagugcuuaacccucugauguggaucaccgccuucauccgcuggguuuauaagaagauggucgccagaguggcugauaauauuaaccaggugaaucgggagaucggauggauggaaggcgggcagcucguccugggcaaccccgccccgauuccucgccacgcucccaucccuagauacuccacauaccuuaugcugcuccugauugugagcuaugccaccgcg

SEQ ID NO: 14612 - RNA, 1680 nt, Artificial Sequence
  derived and/or modified CDS sequence (opt5) from RVFV(1260/78)__DQ380214.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucaaauccaggugucuggcguguggaaaaagccucuuugcgucggguaugaacgcgugguugugaaaagagagcugagcgccaagcccauucagcgggucgaaccuuguacgacaugcaucaccaaaugugagccccacggacucgugguucgcuccacaggcuuuaagauuagcucugccguggcuugcgccuccggggucugugugaccggaagccaaucucccagcaccgagaucacacugaaguacccuggcauuucccagucuagcggcggggauaucggaguccauauggcgcacgacgaucaguccgugagcucuaaaauuguugcucauugcccgccccaggacccuugucuugugcacggcugcaucgucugcgcccaugggcugaucaauuaucaaugucacacggcccucuccgcuuucgugguuguguucgucuuuagcucuauugccaucauuugccuggcuauccugcacagagugcucaagugucugaaaauugcgccccggaaggugcuuaacccucugauguggaucaccgccuucauccgcuggguuuacaaaaagauggucgccagaguggcugauaauauuaaccaggugaaucgggaaaucggauggauggagggcgggcagcucguccugggcaaccccgccccgauuccucgccaugcucccaucccuagauauuccacauaccuuaugcugcuccugauugugagcuacgccuccgcg

SEQ ID NO: 14613 - RNA, 1680 nt, Artificial Sequence
  derived and/or modified CDS sequence (opt5) from RVFV(T-46 (228113))__DQ380199.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaaaagacucuggccagaccaagcgggaacugaaauccuuugauaucagccagugcccgaagauugggggacauggcucuaagaaaugcacaggcgacgcugccuucuguuccgccuacgagugcaccgcucaguaugcgaaugccuacuguagccacgcuaacggguccggaaucguucaaauccaggugucuggcguguggaagaaaccucuuugcgucggguaugaacgcgugguugugaagagagagcugagcgccaaacccauucagcgggucgaaccuuguacgacaugcaucaccaagugugagccccacggacucgugguucgcuccacaggcuuuaagauuagcucugccguggcuugcgccuccggggucugugugaccggaagccaaucucccagcaccgagaucacacugaaauacccuggcauuucccagucuagcggcggggauaucggaguccauauggcgcacgacgaucaguccgugagcucuaagauuguugcucauugcccgccccaggacccuugucuugugcacggcugcaucgucugcgcccaugggcugaucaauuaucaaugucacacggcccucuccgcuuucgugguuguguucgucuuuagcucuauugccaucauuugccuggcugugcuguacagagugcucaaaugucugaagaucgcgccccggaaaguucuuaacccucugauguggauuaccgccuucauccgcuggaucuauaagaagauggucgccagaguggcugauaauauuaaccaggugaaucgggaaaucggauggauggagggcgggcagcucguccugggcaaccccgccccgauuccucgccacgcucccaucccuagauacuccacauaccuuaugcugcuccugauugugagcuaugccuccgcg

SEQ ID NO: 14614 - RNA, 1680 nt, Artificial Sequence
  derived and/or modified CDS sequence (opt5) from RVFV(ZINGA J83 R1)__KU978776.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacugaugacaggagcgucccuuaagaaaggcucuuacccccugcaggaccucuucugccaaagcuccgaggaugacggcagcaagcugaagaccaaaaugaagggggucugugaagugggaguucaggcccuuaaaaagugcgauggccagcugucuacggcucaugagguggucccuuuugccguguucaaaaauuccaagaaaguguaucucgacaagcuggaccugaagaccgaagagaaccuccugcccgauagcuuugucuguuucgagcacaaagggcaguacaagggaacaauggacucuggccaaaccaaacgggaacuuaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucagauccaagugucuggcguguggaaaaagccucugugcgucggguaugaacgcgugguugugaaaagagagcucagcgccaagcccauucagcgggucgaaccuuguacgacaugcaucaccaaaugugagccccacggacuggugguucgcuccacaggcuuuaagauuagcucugccguggcuugcgccuccggggucugugugaccggaagccagucucccagcaccgagaucacacuuaaguacccuggcauuucccaaucuagcggcggggauaucggaguccauauggcgcacgacgaucaguccgugagcucuaaaauuguugcucauugcccgccccaggacccuugucuggugcacggcugcaucgucugcgcccaugggcucaucaauuaucagugucacacggcccuguccgcuuucgugguuguguucgucuuuagcucuauugccaucauuugccuggcuauccucuacagagugcugaagugucuuaaaauugcgccccggaaggugcugaacccucucauguggaucaccgccuucauccgcuggguuuauagaaaaauggucgcccggguggcugauaauauuaaccaagugaaucgcgaaaucggauggauggagggcgggcagcugguccuuggcaaccccgccccgauuccuagacacgugcccaucccucgguacuccacauaccugaugcuccugcugauuguuagcuaugcuuccgcc

SEQ ID NO: 14615 - RNA, 1680 nt, Artificial Sequence
  derived and/or modified CDS sequence (opt5) from RVFV(clone 13)__DQ380213.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaacaugaacucaccgaggauugcaacuuuuguagacagaugacaggagcgucccugaagaaaggcucuuauccccuucaagaccuguucugccagagcuccgaggaugacggcagcaagcucaagaccaaaaugaagggggucugugaagugggaguucaggcccugaaaaagugcgauggccagcuuucuacggcucacgagguggucccuuuugccguguucaaaaauuccaagaaaguguaccuggacaagcucgaccugaagaccgaagagaaccugcuccccgauagcuuugucuguuucgagcauaaagggcaauauaagggaacaauggacucuggccagaccaaacgggaacugaaguccuuugauaucagccagugcccgaaaauugggggacacggcucuaagaagugcacaggcgacgcugccuucuguuccgccuacgagugcaccgcucaguacgcgaaugccuauuguagccacgcuaacggguccggaaucguucaaauccaggugucuggcguguggaaaaagccucuuugcgucggguacgaacgcgugguugugaaaagagagcugagcgccaagcccauucagcgggucgaaccuuguacgacaugcaucaccaaaugugagccccauggacucgugguucgcuccacaggcuuuaagauuagcucugccguggcuugcgccuccggggucugugugaccggaagccaaaaucccucuaccgagaucacacugaaguauccuggcauuagccaguccucuggcggggauaucggaguccacauggcgcaugacgaucagagcguguccagcaaaauuguugcucacugcccgccccaggacccuugucuugugcauggcugcaucgucugcgcccacgggcugaucaacuaccaaugucacacggcccucucugcuuucgugguuguguucgucuuuuccagcauugccaucauuugccuggcuauccuguauagagugcucaagugucugaaaauugcgccccggaaggugcuuaauccucugauguggaucaccgccuucauccgcuggguuuacaaaaagauggucgccagaguggcugauaacauuaaucaggugaaccgggaaaucggauggauggagggcgggcagcucguccugggcaaccccgccccgauuccucgccaugcucccaucccuagauauucuacauaccuuaugcugcuccugauuguguccuacgccagcgcg

SEQ ID NO: 14616 - RNA, 1680 nt, Artificial Sequence
  derived and/or modified CDS sequence (opt5) from RVFV(SA01-1322)__KX096942.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuuuuguagccacgcuaacggguccggaaucguucaaauccaggugucuggcguguggaaaaagccucuuugcgucggguacgaacgcgugguugugaaaagagagcugagcgccaagcccauucagcgggucgaaccuuguacgacaugcaucaccaaaugugagccccacggacucgugguucgcuccacaggcuucaagauuagcucugccguggcuugcgccuccggggucugugugaccggaagccaaucucccagcaccgagaucacacugaaguauccuggcauuucccagucuagcggcggggauaucggaguccauauggcgcacgacgaucaguccgugagcucuaaaauuguugcucauugcccgccccaggacccuugucuugugcacggcugcaucgucugcgcccaugggcugaucaauuaccaaugucacacggcccucuccgcuuucgugguuguguuugucuucagcucuauugccaucauuugccuggcuauccuguauagagugcucaagugucugaaaauugcgccccggaaggugcuuaacccucugauguggaucaccgccuuuauccgcuggguuuacaaaaagauggucgccagaguggcugauaauauuaaccaggugaaucgggaaaucggauggauggagggcgggcagcucguccugggcgaccccgccccgauuccucgccacgcucccaucccuagauauuccacauaccuuaugcugcuccugauuaucagcuacgccuccgcg

SEQ ID NO: 14617 - RNA, 1680 nt, Artificial Sequence
  derived and/or modified CDS sequence (opt5) from RVFV(25010-24)__KM210509.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucaaauccaggugucuggcguguggaaaaagccucuuugcgucggguaugaacgcgugguugugaaaagagagcugagcgccaagcccauucagcgggucgaaccuuguacgacaugcaucaccaaaugugagccccacggacucauugugcgcuccacaggcuuuaagaucagcucugccguugcuugcgccuccggggugugugucaccggaagccaaucucccagcaccgagauuacacugaaguacccuggcaucucccagucuagcggcggggauauuggagugcauauggcgcacgacgaucaguccgucagcucuaaaaucguggcucauugcccgccccaggacccuugucuuguucacggcugcaucgugugcgcccaugggcugauuaauuaucaaugucacacggcccucuccgcuuucgucgugguuuucguguuuagcucugucgccaucauuugccuggcuauccuguacaaggugcucaaaugucugaagauugcccccaaaaaggugcuuaacccucugauguggaucaccgcguucaucagauggguuuauaagaaaauggucgcccggguggcugauaauauuaaccaggugaaucgcgaaaucggauggauggagggcgggcagcucgcccugggcaaccccgcuccgauuccuagacacgcccccaucccucgguacuccacauaccuuaugcugcuccugauugucagcuaugcguccgcc

SEQ ID NO: 14618 - RNA, 1680 nt, Artificial Sequence
  derived and/or modified CDS sequence (opt5) from RVFV(200803162)__JF311377.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucaaauccaggugucuggcguguggaaaaagccucuuugcgucggguaugaacgcgugguugugaaaagagagcugagcgccaagcccauucagcgggucgaaccuuguacgacaugcaucgccaaaugugagccccacggacucgugguucgcuccaccggcuuuaagauuagcucugcuguggccugcgcguccggggucugugugacaggaagccaaucucccagcaccgagaucacccugaaguacccuggcauuucccagucuagcggcggggauaucggaguccauauggcucacgacgaucaguccgugagcucuaaaauuguugcccauugcccgccccaggacccuugucuugugcacgauugcaucgucugcgcccauggccugaucaauuaucaaugucacacagcucucuccgccuucgugguuauuuucguguuuagcucuacggcuaucauuugccuggccguccuguacagagugcucaagugucugaaaaucgcgccccggaaggugcuuaacccucugauguggauuaccgccuucauccgcuggguuuauaaaaagauggucgcuagaguggccgacaauaucaaccaggugaaucgggaaauuggguggauggagggaggccagcucgcucugcgcaaccccgccccgaucccuagacacgcgcccauuccucgguacuccacauaccuuaugcugcuccugaucgucagcuaugccuccgcu

SEQ ID NO: 14619 - RNA, 1680 nt, Artificial Sequence
  derived and/or modified CDS sequence (opt5) from RVFV(2007002476)__EU574036.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucaaauccaggugucuggcguguggaaaaagccucuuugcgucggguaugaacgcgugguugugaaaagagagcugagcgccaagcccauucagcgggucgaaccuuguacgacaugcaucaccaaaugugagccccacggacucgugguucgcuccacaggcuuuaagauuagcucugccguggcuugcgccuccggggucugugugaccggaagccaaucucccagcaccgagaucacacugaaguacccuggcauuucccagucuagcggcggggauaucggaguccauauggcgcacgacgaucaguccgugagcucuaaaauuguugcucauugcccgccccaggacccuugucuugugcacggcugcaucgucugcgcccaugggcugaucaauuaucaaugucacacggcccucuccgcuuucgugguuauuuucguguuuagcucuaccgccaucauuugccuggcuguccuguacagagugcucaagugucugaaaaucgcgccccggaaggugcuuaacccucugauguggauuacagccuucaucaaauggguuuauaagaagauggucgcccgcguggcugauaauaucaaccaggugaauagagaaauuggauggauggagggcgggcagcucgcccugggcaaccccgcuccgaucccucggcacgcccccauuccucgcuacuccaccuaccuuaugcugcuccugaucgucagcuaugcguccgcc

SEQ ID NO: 14620 - RNA, 1680 nt, Artificial Sequence
  derived and/or modified CDS sequence (opt5) from RVFV(Hv-B375)__DQ380218.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaaaacgaacucaccgaggauugcaauuuuuguagacagaugacaggagcgucccugaagaaaggcucuuauccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaacuccaagaaaguguaccuggacaagcucgaccugaagaccgaagagaaucugcuccccgauagcuuugucuguuucgagcacaaagggcaauauaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguacgcgaacgccuauuguagccacgcuaauggguccggaaucguucaaauccaggugucuggcguguggaaaaagccucuuugcgucggguacgaacgcgugguugugaaaagagagcugagcgccaagcccauucagcgggucgaaccuuguacgacaugcaucaccaaaugugagccccacggacucgugguucgcuccacaggcuuuaagauuagcucugccguggcuugcgccuccggggucugugugaccggaagccaaucucccagcaccgagaucacacugaaguauccuggcauuucccagucuagcggcggggauaucggaguccauauggcgcacgacgaucaguccgugagcucuaaaauuguugcucauugcccgccccaggacccuugucuugugcacggcugcaucgucugcgcccaugggcugaucaacuaccaaugucacacggcccucuccgcuuucgugguuguguucgucuuuagcucuauugccaucauuugccuggcuauccuguauagagugcucaagugucugaaaauugcgccccggaaggugcuuaauccucugauguggaucaccgccuucauccgcuggguuuacaaaaagauggucgccagaguggcugauaacauuaaucaggugaaccgggaaaucggauggauggagggcgggcagcucguccugggcaaccccgccccgauuccucgccacgcucccaucccuagauauuccacauaccuuaugcugcuccugauugugagcuacgccuccgcg

SEQ ID NO: 14621 - RNA, 1680 nt, Artificial Sequence
  derived and/or modified CDS sequence (opt5) from RVFV(OS-1)__DQ380186.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaguugugcaaauccaggugucuggcgucuggaaaaagccucuuugcgugggguaugaacgcguuguggucaaaagagagcugagcgccaagcccauccagcggguggaaccuuguacgacaugcauuaccaaaugugagccccacggacucguugugcgcuccacaggcuuuaagaucagcucugccgucgcuugcgccuccggggugugugucaccggaagccaaucucccagcaccgagauuacacugaaguacccuggcaucucccagucuagcggcggggauauuggagugcauauggcgcacgacgaucaguccguuagcucuaaaaucguggcucauugcccgccccaggacccuugucuuguccacggcugcauugugugcgcccaugggcugaucaauuaucaaugucacacggcccucuccgcuuucguuguggucuucguguuuagcucuguggccaucauuugccuggcuauccuguacaagguucucaaaugucugaagauugcccccagaaaaguccuuaacccucugauguggaucaccgcguucauucgguggguguauaagaagaugguggcccgcgucgcugauaauaucaaccaggugaauagagaaaucggauggauggagggcgggcagcucgcccugggcaaccccgcuccgauuccucggcacgcccccaucccucgcuacuccacauaccuuaugcugcuccugauuguuagcuaugcguccgcc

SEQ ID NO: 14622 - RNA, 1680 nt, Artificial Sequence
  derived and/or modified CDS sequence (opt5) from RVFV(2373/74)__DQ380194.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucaaauccaggugucuggcguguggaaaaagccucuuugcgucggguaugaacgcgugguugugaaaagagagcugagcgccaagcccauucagcgggucgaaccuuguacgacaugcaucaccaaaugugagccccacggacucgugguucgcuccacaggcuuuaagauuagcucugccguggcuugcgccuccggggucugugugaccggaagccaaucucccagcaccgagaucacacugaaguacccuggcauuucccagucuagcggcggggauaucggaguccauauggcgcacgacgaucaguccgugagcucuaaaaugguugcucauugcccgccccaggacccuugucuugugcacggcugcauugucugcgcccaugggcugaucaauuaucaaugucacacggcccucuccgcuuucgugguuguguucgucuuuagcucuguggccaucauuugccuggcuauccuguacaaggugcucaaaugucugaagauugcccccagaaaaguucuuaacccucugauguggaucaccgcguucauucggugggucuauaagaagaugguggcccgcguggcugauaauaucaaccaggucaauagagaaaucggauggauggagggcgggcagcucgcccugggcaaccccgcuccgauuccucggcacgcccccaucccucgcuacuccacauaccuuaugcugcuccugauugugagcuaugcguccgcc

SEQ ID NO: 14623 - RNA, 1680 nt, Artificial Sequence
  derived and/or modified CDS sequence (opt5) from RVFV(Kenya 57 (Rintoul))__DQ380192.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaucaaacgggaacugaaguccuuugauauuagccagugcccgaaaaucgggggacauggcucuaagaagugcaccggcgacgcugccuucuguuccgccuacgagugcacagcucaguaugcgaaugccuacuguagccacgcuaacggguccggaaucguucaaauucaggugucuggcguguggaaaaagccucuuugcgucggguaugaacgcgugguugugaaaagagagcugagcgccaagcccauccagcgggucgaaccuuguaccacgugcauuacaaaaugugagccccacggacucgugguucgcuccaccggcuuuaagaucagcucugccguggcuugcgccuccggggucugugugacaggaagccaaucucccagcaccgagauuacccugaaguacccuggcaucucccagucuagcggcggggauauuggaguccauauggcgcacgacgaucaguccgugagcucuaaaaucguugcucauugcccgccccaggacccuugucuugugcacggcugcaucgucugcgcccaugggcugauuaauuaucaaugucacacagcccucuccgcuuucgugguuguguucgucuuuagcucuguggccaucauuugccuggcuauccuguacaaggugcucaaaugucugaagauugcccccagaaaaguucuuaacccucugauguggaucacggcguucauccggugggucuauaagaagaugguggcccgcguggcugauaauauuaaccaggucaauagagaaaucggauggauggagggcgggcagcucgugcugggcaaccccgccccgauuccucggcacgcucccaucccucgcuacuccaccuaccuuaugcugcuccugauuguuagcuaugccuccgcg

SEQ ID NO: 14624 - RNA, 1680 nt, Artificial Sequence
  derived and/or modified CDS sequence (opt5) from RVFV(Sudan 2V-2007)__JQ820490.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucaaauccaggugucuggcguguggaaaaagccucuuugcgucggguaugaacgcgugguugugaaaagagagcugagcgccaagcccauucagcgggucgaaccuuguacgacaugcaucaccaaaugugagccccacggacucgugguucgcuccacaggcuuuaagauuagcucugccguggcuugcgccuccggggucugugugaccggaagccaaucucccagcaccgagaucacacugaaguacccuggcauuucccagucuagcggcggggauaucggaguccauauggcgcacgacgaucaguccgugagcucuaaaauuguugcucauugcccgccccaggacccuuguuccgugcacggcugcaucgucugcgcccaugggcuuaucaauuaucaaugucacacggcccugagcgcuuucgugguuguguucgucuuuucuuccauugccaucauuugccucgcuauccuguacagagugcugaagugucucaaaauugcgccccggaaggugcugaacccucuuauguggaucaccgccuucauccgcuggguuuauaaaaagauggucgccagaguggcugauaauauuaaccaggugaaucgggaaaucggauggauggagggcgggcagcugguccucggcaaccccgccccgauuccucgccacgcucccaucccuagauacagcacauaccugaugcuucugcucauugugucccaugccucugcg

SEQ ID NO: 14625 - RNA, 1680 nt, Artificial Sequence
  derived and/or modified CDS sequence (opt5) from RVFV(200803167)__JF311382.1__Gn
auggccggcaucgcuaugaccgugcugcccgcccucgcggucuucgcucuggccccuguuguguuugccgaggaccuucaccugagaaaccggccggggaagggacauaauuacauugauggcaugacacaggaagacgcuacgugcaaacccgugaccuaugccggggcuuguagcuccuucgauguccuccuggagaagggaaaauuuccucuuuuccaaucuuacgcccaccaucgcacacugcucgaagcggugcacgacaccaucauugccaaggcugaucccccuagcugcgaccugcaguccgcccauggcaaccccuguaugaaagagaagcugguuaugaagacacacugcccuaaugauuaucagucugcucacuaccucaacaaugacgggaaaauggccagcgugaaguguccgcccaaauaugaacugaccgaggauugcaacuuuuguagacagaugacaggagcgucccuuaagaaaggcucuuacccucugcaagaccucuucugccagagcuccgaggaugacggcagcaagcugaagaccaaaaugaagggggucugugaagugggaguucaggcccuuaaaaagugcgauggccagcugucuacggcucaugaggugguccccuuugccguguucaaaaauuccaagaaaguguaucucgacaagcuggaccugaagaccgaagagaaccuccugccugauagcuuugucuguuucgagcacaaagggcaauacaagggaacaauggacucuggccagaccaaacgggaacuuaaguccuuugauaucagccagugccccaaaauugggggacauggcucuaagaagugcacaggcgacgcugccuucuguuccgccuacgagugcaccgcucaguaugcgaaugccuacuguagccacgcuaacggguccggaaucguucaaauccaggugucuggcguguggaaaaagccgcugugcgucggguaugaacgcgugguugugaaaagagagcucagcgccaagccuauucagcgggucgaacccuguacgacaugcaucaccaaaugugagccucacggacuggugguucgcuccacaggcuuuaagauuagcucugccguggcuugcgccuccggggucugugugaccggaagccaaucucccagcaccgagaucgcgcuuaaguaccccggcauuucccagucuagcggcggggauaucggaguccauauggcucacgacgaucaguccgugagcucuaaaauuguugcccauugcccuccgcaggaccccugucuggugcacggcugcaucgucugcgcccaugggcucaucaauuaucaaugucacacagcucuguccgccuucgugguuguguucgucuuuagcucuauugcuaucauuugccuggccauccucuacagagugcugaagugucuuaaaauugcgccucggaaggugcugaacccccucauguggaucacggccuucauccgcuggguuuauaaaaagauggucgcuagaguggccgauaauauuaaccaggugaaucgggaaaucggauggauggagggcgggcagcugguccuuggcaacccugcucccauuccgcgccacgccccuauccccagauacuccaccuaccugaugcuccugcugauugugagcuaugcguccgcc

SEQ ID NO: 14626 - RNA, 1680 nt, Artificial Sequence
  derived and/or modified CDS sequence (opt5) from RVFV(KEN/Gar-008/06)__HM586965.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucaaauccaggugucucgcguguggaaaaagccucuuugcgucggcuaugaaagagugguugugaaacgggagcugagcgccaagcccauucagcgcgucgaaccuuguacgacaugcaucaccaaaugugagccccacgggcucgugguuagauccacaggauuuaagauuagcucugccguggcuugcgccuccggcgucugugugaccgggagccaaucucccagcaccgagaucacacugaaguacccuggaauuucccagucuagcggcggcgauaucgggguccauauggcgcacgacgaucaguccgugagcucuaaaauuguugcucauugcccgccccaggacccuugucuugugcacggaugcaucgucugcgcccauggccugaucaauuaucaaugucacacggcccucuccgcuuucgugguuauuuucguguuuagcucuaccgccaucauuugccuggcuguccuguaccgggugcucaagugucugaaaaucgcgccccgcaaggugcuuaacccucugauguggauuacagccuucaucagauggguuuauaaaaagauggucgcccggguggcugauaauaucaaccaggugaaucgcgaaauuggguggauggagggaggccagcucgcccuggggaaccccgcuccgaucccuagacacgcccccauuccucgguacuccaccuaccuuaugcugcuccugaucgucagcuaugcguccgcc

SEQ ID NO: 14627 - RNA, 1680 nt, Artificial Sequence
  derived and/or modified CDS sequence (opt5) from RVFV(ANK-6087)__DQ380216.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaaaacuggacucuggccagacaaagcgggaacuuaaauccuuugauaucagccagugcccgaagauugggggacauggcucuaagaaaugcaccggcgacgcugccuucuguuccgccuacgagugcacagcucaguaugcgaaugccuacuguagccacgcuaacggguccggaaucguucaaauccaggugucuggcguguggaagaaaccucugugcgucggguaugaacgcgugguugugaagagagagcucagcgccaaacccauucagcgggucgaaccuuguaccacgugcaucacaaagugugagccccacggacuggugguucgcuccaccggcuuuaagauuagcucugccguggcuugcgccuccggggucugugugacaggaagccaaucucccagcaccgagaucacccuuaaauacccuggcauuucccagucuagcggcggggauaucggaguccauauggcgcacgacgaucaguccgugagcucuaagauuguugcucauugcccgccccaggacccuugucuggugcacggcugcaucgucugcgcccaugggcucaucaauuaucaaugucacacagcccuguccgcuuucgugguuguguucgucuuuagcucuauugccaucauuugccuggcuauccucuacagagugcugaaaugucuuaagauugcgccccggaaagugcugaacccucucauguggaucacggccuucauccgcuggguuuauagaaagauggucgcccggguggcugauaauauuaaccaggugaaucgcgaaaucggauggauggagggcgggcagcugguccuuggcaaccccgccccgauuccuagacacgugcccaucccucgguacuccaccuaccugaugcuccugcugauuguuagcuaugcuuccgcc

SEQ ID NO: 14628 - RNA, 1680 nt, Artificial Sequence
  derived and/or modified CDS sequence (opt5) from RVFV(763/70)__DQ380188.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauauggacucaccgaagauugcaacuuuuguagacagaugacaggcgcgucccugaagaaaggcucuuacccccuucaagaccuguucugccagagcuccgaggaugacgggagcaagcucaagaccaaaaugaagggagucugugaggugggcguucaggcccugaaaaagugcgaugggcagcuuucuacggcucaugaaguggucccuuuugccguguucaaaaauuccaagaaaguguaucuggacaagcucgaccugaagaccgaggaaaaccugcuccccgauagcuuugucuguuucgagcacaaaggacaauacaagggcacaauggacucugggcagaccaaacgggagcugaaguccuuugauaucagccagugcccgaaaauuggaggccauggcucuaagaagugcacaggggacgcugccuucuguuccgccuacgaaugcaccgcucaguaugcgaaugccuacuguagccacgcuaacggauccggcaucguucaaauccaggugucugggguguggaaaaagccucuuugcgucggauaugagcgcgugguugugaaaagagaacugagcgccaagcccauucagcgggucgagccuuguacgacaugcaucaccaaaugugaaccccacggccucgugguucgcuccacaggguuuaagauuagcucugccguggcuugcgccuccggagucugugugaccggcagccaaucucccagcaccgagaucacacugaaguacccuggcauuucccagucuagcgggggagauaucggcguccauauggcgcacgacgaucaguccgugagcucuaaaauuguugcucauugcccgccccaggacccuugucuugugcacgggugcaucgucugcgcccauggacugaucaauuaucaaugucacacggcccucuccgcuuucgugguuguguucgucuuuagcucuguggccauuaucugccuggcuauucuguacaaggugcucaaaugucugaagaucgcccccagaaaaguucuuaacccucugauguggauuaccgcguucauccggugggucuauaagaagaugguggcccgcguggcugauaauaucaaccaggucaauagagagauuggcuggauggaagggggccagcucgcccugggaaaccccgcuccgaucccucggcacgcccccauuccucgcuacuccacauaccuuaugcugcuccugaucgugagcuaugcguccgcc

SEQ ID NO: 14629 - RNA, 1680 nt, Artificial Sequence
  derived and/or modified CDS sequence (opt5) from RVFV(BIME-01)__KX609032.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucaaauccaggugucuggcguguggaaaaagccucuuugcgucggguaugaacgcgugguugugaaaagagagcugagcgccaagcccauucagcgggucgaaccuuguacgacaugcaucaccaaaugugagccccacggacucgugguucgcuccacaggcuuuaagauuagcucugccguggcuugcgccuccggggucugugugaccggaagccaaucucccagcaccgagaucacacugaaguacccuggcauuucccagucuagcggcggggauaucggaguccauauggcgcacgacgaucaguccgugagcucuaaaauuguugcucauugcccgccccaggacccuugucuugugcacggcugcaucgucugcgcccaugggcugaucaauuaucaaugucacacggcccucuccgcuuucgugguuguguucgucuuuagcucuguggccauuaucugccuggcuauucuguacaaggugcucagaugucugaaaaucgcccccaagaaaguucuuaacccucugauguggauuaccgcguucauccggugggucuauaagaagaugguggcccgcguggcugauaauaucaaccaggucaauagagaaauuggauggauggagggcgggcagcucgcccugggcaaccccgcuccgaucccucggcacgcccccauuccucgcuacuccacauaccuuaugcugcuccugaucauuagcuaugcguccgcc

SEQ ID NO: 14630 - RNA, 1680 nt, Artificial Sequence
  derived and/or modified CDS sequence (opt5) from RVFV(KEN07-KUR340)__EF460404.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucguucaaauccaggugucuggcguguggaaaaagccucuuugcgucggguaugaacgcgugguugugaaaagagagcugagcgccaagcccauucagcgggucgaaccuuguacgacaugcaucaccaaaugugagccccacggacucgugguucgcuccacaggcuuuaagauuagcucugccguggcuugcgccuccggggucugugugaccggaagccaaucucccagcaccgagaucacacugaaguacccuggcauuucccagucuagcggcggggauaucggaguccauauggcgcacgacgaucaguccgugagcucuaaaauuguugcucauugcccgccccaggacccuugucuugugcacggcugcaucgucugcgcccaugggcugaucaauuaucaaugucacacggcccucuccgcuuucgugguuauuuucguguuuagcucuaccgccaucauuugccuggcuguccuguacagaaugcucaagugucugaaaaucgcgccccggauugugcuuaacccucugauguggaucacagccuucauccgcuggguguauaagaaaaugguugccagagucgcugauaauauuaaccaggugaaucgggaaaucggauggauggagggcgggcagcucgcccugggcaaccccgcuccgauuccucgccacgcccccaucccuagauacuccaccuaccuuaugcugcuccugauugugagcuaugcguccgcc

SEQ ID NO: 14631 - RNA, 1680 nt, Artificial Sequence
  derived and/or modified CDS sequence (opt5) from RVFV(SA-51 (Van Wyck))__DQ380195.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacgcggcucuaagaagugcacaggcgacgcugccuucuguuccgccuacgagugcaccgcucaguaugcgaaugccuacuguagccaugcuaacggguccggaaucguucaaauccaggugucuggcguguggaaaaagccucuuugcgucggguaugaaagagugguugugaaacgggagcugagcgccaagcccauucagcgcgucgaaccuuguacgacaugcaucaccaaaugugagccccacggacucgugguuagauccacaggcuuuaagauuagcucugccguggcuugcgccuccggggucugugugaccggaagccaaucucccagcaccgagaucacacugaaguacccuggcauuucccagucuagcggcggggauaucggaguccacauggcgcaugacgaucaguccgugagcucuaaaauuguugcucacugcccgccccaggacccuugucuugugcauggcugcaucgucugcgcccacgggcugaucaauuaucaaugucauacggcccucuccgcuuucgugguuguguucgucuuuagcucuguggccauuaucugccuggcuauucuguacaaggugcucaaaugucugaagaucgcgccccggaaaguucuuaacccucugauguggauuaccgccuucauccgcugggucuauaagaagaugguggccagaguggcugauaauaucaaccaggucaaucgggaaauuggauggauggagggcgggcagcucgcccugggcaaccccgcuccgaucccucgccacgcccccauuccuagauacuccacauaccuuaugcugcuccugaucgugagcuaugcguccgcc

SEQ ID NO: 14632 - RNA, 1680 nt, Artificial Sequence
  derived and/or modified CDS sequence (opt5) from RVFV(Lunyo)__KU167026.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaaugguuucuggccagaccaaacgggaacugaaguccuuugacaucagccagugcccgaaaauugggggacauggcucuaagaagugcacaggcgaugcugccuucuguuccgccuacgagugcaccgcucaguaugcgaaugccuacuguagccacgcuaacggguccggaaucgugcaaauccaggugucuggcgucuggaaaaagccucuuugcgugggguaugaacgcguuguggucaaaagagagcugagcgccaagcccauucagcggguggaaccuuguacgacaugcaucaccaaaugugagccccacggacucguugugcgcuccacaggcuuuaagauuagcucugccgucgcuugcgccuccggggugugugucaccggaagccaaucucccagcaccgagaucacacugaaguacccuggcauuucccagucuagcggcggggacaucggagugcauauggcgcacgaugaccaguccguuagcucuaaaauuguggcucauugcccgccccaggauccuugucuuguccacggcugcaucgugugcgcccaugggcugaucaauuaucaaugucacacggcccucuccgcuuucguuguggucuucguguuuagcucuguggccauuaucugccuggcuauucuguacaagguucucaaaugucugaagaucgcccccagaaaaguccuuaacccucugauguggauuaccgcguucauccgguggguguauaagaagaugguggcccgcgucgcugacaauaucaaccaggugaauagagaaauuggauggauggagggcgggcagcucgcccugggcaaccccgcuccgaucccucggcacgcccccauuccucgcuacuccacauaccuuaugcugcuccugaucguuagcuaugcguccgcc

SEQ ID NO: 14633 - RNA, 1680 nt, Artificial Sequence
  derived and/or modified CDS sequence (opt5) from RVFV(2269/74)__DQ380222.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaacauaagggaacaauggacucuggccagaccaaacgggaacugaaguccuuugauaucagccagugcccgaaaauugggggacacggcucuaagaagugcacaggcgacgcugccuucuguuccgccuacgagugcaccgcucaguacgcgaaugccuauuguagccacgcuaacggguccggaaucguucaaauccaggugucuggcguguggaaaaagccucuuugcgucggguacgaacgcgugguugugaaaagagagcugagcgccaagcccauucagcgggucgaaccuuguacgacaugcaucaccaaaugugagccccauggacucgugguucgcuccacaggcuuuaagauuagcucugccguggcuugcgccuccggggucugugugaccggaagccaaucucccagcaccgagaucacacugaaguauccuggcauuucccagucuagcggcggggauaucggaguccacauggcgcaugacgaucaguccgugagcucuaaaauuguugcucacugcccgccccaggacccuugucuugugcauggcugcaucgucugcgcccacgggcugaucaauuaccaaugucacacggcccucuccgcuuucgugguuguguucgucuuuagcucuguggccauuaucugccuggcuauucuguauaaggugcucaaaugucugaagaucgcccccaaaaagguucuuaacccucugauguggauuaccgcguucaucagaugggucuacaagaaaaugguggcccggguggcugauaauaucaaccaggucaaucgcgaaauuggauggauggagggcgggcagcucgcccugggcaaccccgcuccgaucccuagacaugcccccauuccucgguauuccacauaccuuaugcugcuccugaucgugagcuacgcguccgcc

SEQ ID NO: 14634 - RNA, 1680 nt, Artificial Sequence
  derived and/or modified CDS sequence (opt5) from RVFV(MgH824)__DQ380210.1__Gn
auggccggcaucgcuaugaccgugcugcccgcccucgcggucuucgcucuggccccuguuguguuugccgaggacccgcaccuuagaaaccggcccgggaagggauacaauuauauugauggcaugacacaggaagacgcuacgugcaaaccugugaccuacgccggggcuuguagcuccuucgauguccugcucgagaagggaaaauuuccccuguuccaaucuuaugcccaucaccgcacacuucuggaagcggugcaugacaccaucauugccaaggcugauccucccagcugcgaccuccaguccgcccacggcaacccuuguaugaaagagaagcugguuaugaagacacauugcccgaaugauuaccagucugcucacuaucugaacaaugacgggaaaauggccagcgugaagugucccccuaaauacgaacucaccgaggauugcaacuuuuguagacagaugacaggagcgucccugaagaaaggcucuuauccccuucaagaccuguucugccagagcuccgaggaugacggcagcaagcucaagaccaaaaugaagggggucugugaagugggaguucaggcccugaaaaagugcgauggccagcuuucuacggcucacgagguggucccuuuugccguguucaaaaauuccaagaaaguguaccuggacaagcucgaccugaagaccgaagagaaccugcuccccgauagcuuugucuguuucgagcggaaagggcaauacaagggaacaauggacucuggccagaccaaacgcgaacugaaguccuuugauaucagccagugcccgaaaauugggggacauggcucuaagaagugcacaggcgacgcugccuucuguuccgccuaugagugcaccacgcaguacgcuaaugcguauuguagccacgccaacggguccggaguugugcaaauccaggugucuggcgucuggaaaaagccucuuugcgugggguacgaaagaguuguggucaaacgggagcugagcgcuaagcccauccagcgcguggaaccuuguacaaccugcauuacaaaaugugagccccauggacucguugugagauccaccggcuuuaagaucagcucugccgucgccugcgcuuccggggugugugucaccggaagccaaucucccagcacagagauuacgcugaaguauccuggcaucucccagucuagcggcggggauauuggagugcacauggcccacgacgaucaguccguuagcucuaaaaucguggcgcauugcccgccccaggacccuugucuuguccacggcugcauugugugcgcucaugggcugaucaauuaccaaugucacaccgcccucuccgccuucguuguggucuucguguuuagcucuaucgcuauuaucugccuggccauucuguaucgggugcucaagugucugaaaaucgcuccccgcaagguucuuaacccucugauguggauuacagccuucaucagauggaucuacaaaaagauggucgcgcggguggccgauaauauuaaccaggugaaucgcgaaaucggauggauggagggcgggcagcucguccugggcaaccccgcuccgauuccuagacaugcccccaucccucgguacuccaccuaucuuaugcugcuccugauugugagcuacgcuuccgcc

SEQ ID NO: 14635 - RNA, 1680 nt, Artificial Sequence
  derived and/or modified CDS sequence (opt5) from RVFV__JQ068143.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaaucgacucuggccagaccaaacgggaacugaaguccuuugauauuagccagugcccgaaaaucgggggacauggcucuaagaagugcacaggcgacgcugccuucuguuccgccuacgagugcaccgcucaguaugcgaaugccuacuguagccacgcuaacggguccggaaucguucaaauucaggugucuggcguguggaaaaagccucuuugcgucggguaugaacgcgugguugugaaaagagagcugagcgccaagcccauccagcgggucgaaccuuguacgacaugcauuaccaaaugugagccccacggacucgugguucgcuccacaggcuuuaagaucagcucugccguggcuugcgccuccggggucugugugaccggaagccaaucucccagcaccgagauuacacugaaguacccuggcaucucccagucuagcggcggggauauuggaguccauauggcgcacgacgaucaguccgugagcucuaaaaucguugcucauugcccgccccaggacccuugucuugugcacggcugcaucgucugcgcccaugggcugauuaauuaucaaugucacacggcccucuccgcuuucgugguuguguucgucuuuagcucuguggccaucauuugccuggcuauccuguacaaggugcucagaugucugaaaauugcccccaagaaaguucuuaacccucugauguggaucaccgcguucauccggugggucuauaagaagaugguggcccgcguggcugauaauauuaaccaggucaauagagaaaucggauggauggagggcgggcagcucgcccugggcaaccccgcuccgauuccucggcacgcccccaucccucgcuacuccacauaccuuaugcugcuccugauuaucagcuaugcguccgcc

SEQ ID NO: 14636 - RNA, 1680 nt, Artificial Sequence
  derived and/or modified CDS sequence (opt5) from RVFV(RVFBJ01/2016)__KX785331.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaacaugaacucaccgaggauugcaacuuuuguagacagaugacaggagcgucccugaagaaaggcucuuauccccuucaagaccuguucugccagagcuccgaggaugacggcagcaagcucaagaccaaaaugaagggggucugugaagugggaguucaggcccugaaaaagugcgauggccagcuuucuacggcucacgagguggucccuuuugccguguucaaaaauuccaagaaaguguaccuggacaagcucgaccugaagaccgaagagaaccugcuccccgauagcuuugucuguuucgagcauaaagggcaauauaagggaacaauggacucuggccagaccaaacgggaacugaaguccuuugauaucagccagugcccgaaaauugggggacacggcucuaagaagugcacaggcgacgcugccuucuguuccgccuacgagugcaccgcucaguacgcgaaugccuauuguagccacgcuaacggguccggaaucguucaaauccaggugucuggcguguggaaaaagccucuuugcgucggguacgaacgcgugguugugaaaagagagcugagcgccaagcccauucagcgggucgaaccuuguacgacaugcaucaccaaaugugagccccauggacucgugguucgcuccacaggcuuuaagauuagcucugccguggcuugcgccuccggggucugugugaccggaagccaaucucccagcaccgagaucacacugaaguauccuggcauuucccagucuagcggcggggauaucggaguccacauggcgcaugacgaucaguccgugagcucuaaaauuguugcucacugcccgccccaggacccuugucuugugcauggcugcaucgucugcgcccacgggcugaucaauuaccaaugucacacggcccucuccgcuuucgugguuguguucgucuuuagcucuguggccauuaucugccuggcuauucuguauaaggugcucagaugucugaaaaucgcccccaagaaaguucuuaacccucugauguggauuaccgcguucauccggugggucuacaagaagaugguggcccgcguggcugauaauaucaaccaggucaauagagaaauuggauggauggagggcgggcagcucgcccugggcaaccccgcuccgaucccucggcaugcccccauuccucgcuauuccacauaccuuaugcugcuccugaucauuagcuacgcguccgcc

SEQ ID NO: 14637 - RNA, 1680 nt, Artificial Sequence
  derived and/or modified CDS sequence (opt5) from RVFV(KEN/Kil-006/07)__HM586966.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgccgauggcaacaaauguaugaaggagaagcugguuaugaaaacacauugcccuaaugacuaucagucugcucacuaccugaacaaugaugggaagauggccagcgugaaauguccgcccaaguaugaacucaccgaggacugcaacuuuuguagacagaugacaggagcgucccugaaaaagggcucuuacccucuucaagaucuguucugccagagcuccgaggacgauggcagcaagcucaaaaccaagaugaaaggggucugugaagugggaguucaggcccugaagaaaugcgacggccagcuuucuacggcucacgaggugguccccuuugccguguucaaaaauuccaagaagguguaucuggacaagcucgaucugaaaaccgaagagaaccugcucccugacagcuuugucuguuucgagcauaaggggcaauacaaaggaacaauggauucuggccagaccaagcgggaacugaaauccuuugacaucagccagugccccaagauugggggacacggcucuaagaaaugcacaggcgaugcugccuucuguuccgccuacgagugcaccgcucaguaugcgaaugccuacuguagccaugcuaacggguccggaaucguucaaauccaggugucuggcguguggaagaaaccgcuuugcgucggguaugaacgcgugguugugaagagagagcugagcgccaaaccuauucagcgggucgaacccuguacgacaugcaucaccaagugugagccucacggacucgugguucgcuccacaggcuuuaagauuagcucugccguggcuugcgccuccggggucugugugaccggaagccaaucucccagcaccgagaucacacugaaauaccccggcauuucccagucuagcggcggggacaucggaguccacauggcgcaugaugaccaguccgugagcucuaagauuguugcucacugcccuccgcaggaucccugucuugugcauggcugcaucgucugcgcccacgggcugaucaauuaucaaugucauacggcccucuccgcuuucgugguuauuuucguguuuagcucuaccgccaucauuugccuggcuguccuguacagagugcucaaaugucugaagaucgccccucggaaagugcuuaacccccugauguggauuacagcguucauccgcuggguuuauaagaagauggucgccagaguggcugacaauaucaaccaggugaaucgggaaauuggauggauggagggcgggcagcucgcccugggcaacccugcucccaucccgcgccacgccccuauucccagauacuccaccuaccuuaugcugcuccugaucgucagcuaugcguccgcc

SEQ ID NO: 14638 - RNA, 1680 nt, Artificial Sequence
  derived and/or modified CDS sequence (opt5) from RVFV(SA-75)__DQ380189.1__Gn
auggccagaaucgcuaugaccgugcugcccgcccucgcggucuucgcucuggccccuguuguguuugccgaggacccgcaccuucggaaccgccccggcaaggggcauaauuacauugauggaaugacacaggaagacgcuacgugcaaaccugugaccuaugccggcgcuuguagcuccuucgauguccugcucgagaaggggaaauuuccccuguuccaaucuuacgcccaccauagaacacuucuggaagcggugcacgacaccaucauugccaaggcugauccucccagcugcgaccuccaguccgcccauggaaacccuuguaugaaagagaagcugguuaugaagacacacugcccgaaugauuaucagucugcucacuaccugaacaaugacggcaaaauggccagcgugaagugucccccuaaauaugaacucaccgaggauugcaacuuuugucggcagaugacaggggcgucccugaagaaaggaucuuacccccuucaagaccuguucugccagagcuccgaggaugacggcagcaagcucaagaccaaaaugaagggcgucugugaaguggggguucaggcccugaaaaagugcgauggacagcuuucuacggcucaugagguggucccuuuugccguguucaaaaauuccaagaaaguguaucuggacaagcucgaccugaagaccgaagagaaccugcuccccgauagcuuugucuguuucgagcacaaaggccaauacaaggggacaauggacucuggacagaccaaacgcgaacugaaguccuuugauaucagccagugcccgaaaauuggcgggcauggaucuaagaagugcacaggcgacgcugccuucuguuccgccuacgagugcaccgcucaguaugcgaaugccuacuguagccacgcuaacggcuccgggguugugcaaauccaggugucuggagucuggaaaaagccucuuugcgugggcuaugaaagaguuguggucaaacgggagcugagcgccaagcccauccagcgcguggaaccuuguacgacaugcauuaccaaaugugagccccacgggcucguugugagauccacaggauuuaagaucagcucugccgucgcuugcgccuccggcgugugugucaccgggagccaaucucccagcaccgagauuacacugaaguacccuggaaucucccagucuagcggcggcgauauuggggugcauauggcgcacgacgaucaguccguuagcucuaaaaucguggcucauugcccgccccaggacccuugucuuguccacggaugcauugugugcgcccauggccugaucaauuaucaaugucacacggcccucuccgcuuucguuguggucuucguguuuagcucuguggccaucauuugccuggcuauccuguacaagguucucaaaugucugaagauugcgccccggaaaguccuuaacccucugauguggaucaccguguucauucgcuggguguauaagaagauggucgccagaguggccgauaauaucaaccagguuaaucgggaaaucggguggauggagggaggccagcucgcucuggggaaccccgccccgauuccucgccacgcucccaucccuagauacuccacauaccuuaugcugcuccugauugugagcuaugccuccgcg

SEQ ID NO: 14639 - RNA, 1680 nt, Artificial Sequence
  derived and/or modified CDS sequence (opt5) from RVFV(35/74)__JF784387.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaguugugcaaauccaggugucuggcgucuggaaaaagccucuuugcgugggguaugaacgcguuguggucaaaagagagcugagcgccaagcccauccagcggguggaaccuuguacgacaugcauuaccaaaugugagccccacggacucguugugcgcuccacaggcuuuaagaucagcucugccgucgcuugcgccuccggggugugugucaccggaagccaaucucccagcaccgagauuacacugaaguacccuggcaucucccagucuagcggcggggauauuggagugcauauggcgcacgacgaucaguccguuagcucuaaaaucguggcucauugcccgccccaggacccuugucuuguccacggcugcauugugugcgcccaugggcugaucaauuaucaaugucacacggcccucuccgcuuucguuguggucuucguguuuagcucuguggccaucauuugccuggcuauccuguacaagguucucaaaugucugaagauugcccccagaaaaguccuugauccucugauguggaucaccguguucauucgguggguguauaagaagauggucgcgcgcguggccgacaacaucaaucagguuaacagagaaaucggauggauggagggcgggcagcucgcucugggcaaucccgccccgauuccucggcacgcucccaucccucgcuacuccacauaccuuaugcugcuccugauugugagcuaugccuccgcg

SEQ ID NO: 14640 - RNA, 1680 nt, Artificial Sequence
  derived and/or modified CDS sequence (opt5) from RVFV__M11157.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauauggacucaccgaagauugcaacuuuuguagacagaugacaggcgcgucccugaagaaaggcucuuacccccuucaagaccuguucugccagagcuccgaggaugacgggagcaagcucaagaccaaaaugaagggagucugugaggugggcguucaggcccauaaaaagugcgaugggcagcugucuacggcucacgaaguggucccuuuugccguguucaaaaauuccaagaaaguguaucuugacaagcuggaccucaagaccgaggaaaaccugcugcccgauagcuuugucuguuucgagcauaaaggacaauacaagggcacaauggacucugggcagaccaaacgggagcucaaguccuuugauaucagccagugcccgaaaauuggaggccacggcucuaagaagugcacaggggacgcugccuucuguuccgccuacgaaugcaccgcucaguaugcgaaugccuacuguagccacgcuaacggauccggcaucguucaaauccaggugucugggguguggaaaaagccucugugcgucggauaugagcgcgugguugugaaaagagaacuuagcgccaagcccauucagcgggucgagccuuguacgacaugcaucaccaaaugugaaccccauggccuggugguucgcuccacaggguuuaagauuagcucugccguggcuugcgccuccggagucugugugaccggcagccaaucucccagcaccgagaucacacucaaguacccuggcauuucccagucuagcgggggagauaucggcguccacauggcgcaugacgaucaguccgugagcucuaaaauuguugcucacugcccgccccaggacccuugucuggugcaugggugcaucgucugcgcccacggacuuaucaauuaucaaugucacacggcccuguccgcuuucgugguuguguucgucuuuagcucuauugccaucauuugccucgcugugcuguacagagugcugaagugucucaaaaucgcgccccggaagguucugaacccucuuauguggauuaccgccuucauccgcuggaucuauaaaaagauggucgccagaguggcucauaauauuaaccaggugaaucgggagaucggcuggauggaagggggccagcugguccucggaaaccccgccccgauuccucgccacgcucccaucccuagauacuccacauaccugaugcuucugcucauugugagcuaugccuccgcg

SEQ ID NO: 14641 - RNA, 1680 nt, Artificial Sequence
  derived and/or modified CDS sequence (opt5) from RVFV(KEN/Bar-035/07)__HM586969.1__Gn
auggccggcaucgcuaugaccgugcugcccgcccucgcggucuucgcucuggccccuguuguguuugccgaggacccgcaccuuagaaaccggcccgggaagggacauaauuacauugauggccgccugcaggaagacgcuacaugcaaaccugugacguaugccggggcuuguagcuccuucgauguccuccuggagaagggaaaauuuccccuuuuccaaucuuacgcccaccauagaacccugcucgaagcggugcacgacacaaucauugccaaggcugauccucccagcugcgaccugcaguccgccgauggcaacaaauguaugaaggagaagcugguuaugaaaacccauugcccuaaugacuaucagucugcucacuaccucaacaaugaugggaagauggccagcgugaaauguccgcccaaguaugaacugacagaggacugcaacuuuugucggcagaugaccggagcgucccuuaaaaagggcucuuacccucugcaagaucucuucugccagagcuccgaggacgauggcagcaagcugaaaacaaagaugaaaggggucugugaagugggaguucaggcccuuaagaaaugcgacggccagcugucuaccgcucacgaggugguccccuuugccguguucaaaaauuccaagaagguguaucucgacaagcuggaucugaaaacggaagagaaccuccugccugacagcuuugucuguuucgagcauaaggggcaauacaaaggaaccauggauucuggccagacaaagcgcgaacuuaaauccuuugacaucagccagugccccaagauugggggacacggcucuaagaaaugcaccggcgaugcugccuucuguuccgccuacgagugcacagcucaguaugcgaaugccuacuguagccaugcuaacggguccggaaucguucaaauccaggugucuggcguguggaagaaaccgcugugcgucggguaugaaagagugguugugaagcgggagcucagcgccaaaccuauucagcgcgucgaacccuguaccacgugcaucacaaagugugagccucacggacuggugguuagauccaccggcuuuaagauuagcucugccguggcuugcgccuccggggucugugugacaggaagccaaucucccagcaccgagaucacccuuaaauaccccggcauuucccagucuagcggcggggacaucggaguccacauggcgcaugaugaccaguccgugagcucuaagauuguugcucacugcccuccgcaggaucccugucuggugcauggcugcaucgucugcgcccacgggcucaucaauuaucaaugucauacagcccuguccgcuuucgugguuauuuucguguuuagcucuacggccaucauuugccuggcuguccucuaccgggugcugaaaugucuuaagaucgccccucgcaaagugcugaacccccucauguggauuaccgcguucaucagauggguuuauaagaagauggucgcccggguggcugacaauaucaaccaggugaaucgcgaaauuggauggauggagggcgggcagcuggcccuuggcaacccugcucccaucccgagacacgccccuauuccccgguacuccacauaccugaugcuccugcugaucgucagcuaugcguccgcc

SEQ ID NO: 14642 - RNA, 1680 nt, Artificial Sequence
  derived and/or modified CDS sequence (opt5) from RVFV(Kenya 56 (IB8))__DQ380190.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacagggggacgcuacgugcaaaccugugaccuaugccggagcuuguagcuccuucgauguccugcucgaaaagggcaaauuuccccuguuccaaucuuacgcccaccaucgcacacuucuggaggcggugcacgacaccaucauugccaaggcugauccucccagcugcgaccuccaguccgcccaugggaacccuuguaugaaagaaaagcugguuaugaagacacacugcccgaaagauuaucagucugcucacuaccugaauaacgacggaaagauggccagcgugaaaugucccccuaaguaugagcucaccgaagauugcaauuuuuguagacagaugacaggcgcgucccugaaaaagggcucuuacccccuucaagaccuguucugccagagcuccgaggaugacgggagcaagcucaaaaccaagaugaaaggagucugugaggugggcguucaggcccugaagaaaugcgaugggcagcuuucuacggcucaugaaguggucccuuuugccguguucaagaacuccaaaaagguguaucuggacaagcucgaccugaaaaccgaggaaaaucugcuccccgauagcuuugucuguuucgagcacaagggacaauacaaaggcacaauggacucugggcagaccaagcgggagcugaaauccuuugauaucagccagugcccgaagauuggaggccauggcucuaagaaaugcacaggggacgcugccuucuguuccgccuacgaaugcaccgcucaguaugcgaacgccuacuguagccacgcuaauggauccggcaucguucaaauccaggugucugggguguggaagcgcccucuuugcgucggauaugagagagugguugugaaacgggaacugagcgccaagcccauucagcgcgucgagccuuguacgacaugcaucaccaaaugugaaccccacggccucgugguuagauccacaggguuuaagauuagcucugccguggcuugcgccuccggagucugugugaccggcagccaaucucccagcaccgagaucacacugaaguacccuggcaugucccagucuagcgggggagauauuggcguccauauggcgcacgacgaucaguccgugagcucuaaaaucguugcucauugcccgccccaggacccuugucuugugcacgggugcauugucugcgcccauggacugaucaacuaucaaugucacacggcccucuccgcuuucgugguuguguucgucuuuagcucuguggccaucauuugccuggcuauccuguacaaggugcucaaaugucugaagauugcgccccggaaaguucuuaauccucugauguggaucaccgccuucauucgcugggucuauaagaagaugguggccagaguggcugauaacaucaaucaggucaaccgggagaucggcuggauggaagggggccagcccgcccucggaaauccggcuccuauuccccgccacgccccuauccccagauacuccacauaccugaugcuucugcucauugugagcuaugcguccgcc

SEQ ID NO: 14643 - RNA, 1680 nt, Artificial Sequence
  derived and/or modified CDS sequence (opt5) from RVFV(KEN/Bar-032/07)__HM586968.1__Gn
auggccggcaucgcuaugaccgugcugcccgcccucgcggucuucgcucuggccccuguuguguuugccgaggacccgcaccuuagaaaccggcccgggaagggacauaauuacauugauggccgccugcaggaagacgcuacaugcaaaccugugacguaugccggggcuuguagcuccuucgauguccuccuggagaagggaaaauuuccccuuuuccaaucuuacgcccaccauagaacccugcucgaagcggugcacgacacaaucauugccaaggcugauccucccagcugcgaccugcaguccgccgauggcaacaaauguaugaaggagaagcugguuaugaaaacccauugcccuaaugacuaucagucugcucacuaccucaacaaugaugggaagauggccagcgugaaauguccgcccaaguaugaacugacagaggacugcaacuuuugucggcagaugaccggagcgucccuuaaaaagggcucuuacccucugcaagaucucuucugccagagcuccgaggacgauggcagcaagcugaaaacaaagaugaaaggggucugugaagugggaguucaggcccuuaagaaaugcgacggccagcugucuaccgcucacgaggugguccccuuugccguguucaaaaauuccaagaagguguaucucgacaagcuggaucugaaaacggaagagaaccuccugccugacagcuuugucuguuucgagcauaaggggcaauacaaaggaaccauggauucuggccagacaaagcgcgaacuuaaauccuuugacaucagccagugccccaagauugggggacacggcucuaagaaaugcaccggcgaugcugccuucuguuccgccuacgagugcacagcucaguaugcgaaugccuacuguagccaugcuaacggguccggaaucguucaaauccaggugucuggcguguggaagaaaccgcugugcgucggguaugaaagagugguugugaagcgggagcucagcgccaaaccuauucagcgcgucgaacccuguaccacgugcaucacaaagugugagccucacggacuggugguuagauccaccggcuuuaagauuagcucugccguggcuugcgccuccggggucugugugacaggaagccaaucucccagcaccgagaucacccuuaaauaccccggcauuucccagucuagcgucggcgacaucggggugcacauggcgcaugaugaccaguccguuagcucuaagauuguggcucacugcccuccgcaggaucccugucugguccauggaugcaucgugugcgcccacggccucaucaauuaucaaugucauacagcccuguccgcuuucguugugauuuucgucuuuagcucuacggccaucauuugccuggcugugcucuaccgggugcugaaaugucuuaagaucgccccucgcaaaguucugaacccccucauguggauuaccgcguucaucagaugggucuauaagaagaugguggcccggguggcugacaauaucaaccaggucaaucgcgaaauuggguggauggagggaggccagcuggcccuugggaacccugcucccaucccgagacacgccccuauuccccgguacuccacauaccugaugcuccugcugaucgugagcuaugcguccgcc

SEQ ID NO: 14644 - RNA, 1680 nt, Artificial Sequence
  derived and/or modified CDS sequence (opt5) from RVFV(Beijing-01)__KX611606.1__Gn
auggccggcaucgcuaugaccgugcugcccgcccucgcggucuucgcucuggccccuguuguguuugccgaggacccgcaccuuagaaaccggcccgggaagggacauaauuacauugauggcgugacacaggaagacgcuacgugcaaaccugucaccuaugccggggcuuguagcuccuucgaugugcugcucgagaagggaaaauuuccccuguuccaaucuuacgcccaccaucgcacacuucuggaagcgguucacgacaccaucauugccaaggcugauccucccagcugcgaccuccaguccgcccauggcaacccuuguaugaaagagaagcuggugaugaagacacacugcccgaaugauuaucagucugcucacuaccugaacaaugacgggaaaauggccagcgucaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggugugugaaguuggagugcaggcccugaaaaagugcgauggccggcuuucuacggcucaugaggucgugccuuuugccguguucaaaaauuccaagaaagucuaucuggacaagcucgaccugaagaccgaagagaaccugcuccccgauagcuuuguuuguuucgagcacaaagggcaguacaagggaacaauggacucuggccaaaccaaacgcgaacugaaguccuuugauaucagccagugcccgaaaauugggggacauggcucuaagaagugcacaggcgacgcugccuucuguuccgccuacgagugcaccgcucaguaugcgaaugccuacuguagccacgcuaacggguccggaaucgugcagauccaagugucuggcgucuggaaaaagccucuuugcgugggguaugaaagaguuguggucaaacgggagcugagcgccaagcccauucagcgcguggaaccuuguacgacaugcaucaccaaaugugagccccacggacucguugugagauccacaggcuuuaagauuagcucugccgucgcuugcgccuccggggugugugucaccggaagccagucucccagcaccgagaucacacugaaguacccuggcauuucccaaucuagcggcggggauaucggagugcauauggcgcacgacgaucaguccguuagcucuaaaauuguguucgacugcccgccccaggauccuugucuuguccauggcugcaucgugugcgcucacgggcugaucaauuaucagugucauacggcccucuccgccuucguuguggucuuuguguucagcucuguggcuauuaucugccuggccauucuguacaagguucuccggugucugaaaaucgcucccaagaaaguccuuaacccucugauguggauuaccgccuuuauccgcuggguguauaagaagaugguggcgagagucgccgacaauaucaaccaagugaaucgggaaauuggauggauggagggcgggcagcucgcucugggcaaccccgccccgaucccucgccacgcucccauuccuagauacuccacauaccuuaugcugcuccugaucauuagcuaugccuccgcg

SEQ ID NO: 14645 - RNA, 1680 nt, Artificial Sequence
  derived and/or modified CDS sequence (opt5) from RVFV(Smithburn)__DQ380193.1__Gn
auggccggcaucgcuaugaccguguuccccgcccuggucguuuuugcgcucgcuccugugguguucgccgaggacccgcaccugagaaaccggcccgggaagggacauaauuacauugauggcaugacacaggaagacgccacgugcaaaccugucaccuaugcuggggccuguagcuccuuugaugugcuucuggagaagggaaaauucccccucuuucaaucuuacgcucaccaucgcacacugcuugaagccguucacgacaucauuaucgcgaaggccgauccucccagcugcaaccugcaguccgcucauggcaauccuuguaugaaagagaagcucgugaugaagaccuauugcccgaacgacuaccagucugcccacuaucugaauaacgaugggaaaauggcuagcgucaagugucccccuaaacacgaacugacagaggacugcaauuucuguagacagaugaccggagccucccucaaggagggcucuuacccccugcaagaucuguuuugccagagcuccgaagacgauggcagcaaacuuaagacaaagaugaaaggggugugugagguuggagugcagguccucaagaaaugcgacggccagcugucuaccgcgcaugaaguggugccuuucgccgucuuuaagaacuccaaaaagguuuaucuugauaaacuggaccucaagacggaggagaaucugcugcccgacagcuucguguguuuugaacacaaggggcaauacaaaggaaccauggauucuggccagauuaagcgggagcucaaauccuucgacaucagccagugcccgaagaucgggggacauggcucuaaaaagugcacaggcgaugcugccuuuuguuccgcuuacgaaugcaccgcccaguaugccaacgcuuacuguagccacgcgaauggguccggaauugugcaaauccaggucucuggcguguggaagaaaccucugugcguuggguaugagcgcguggucgugaagagagaacuuagcgccaaacccauucagcggguugagccuuguacaaccugcaucacgaagugugagccccacggacuggugguccgcuccacaggcuucaaaauuagcucugcuguggccugcgccuccggggucugugugaccggaagccaaucucccagcacagaaaucacccucaaguacccuggcauuucccagucuagcggcggggacaucggaguucauauggcucacgaugaccaguccgugagcucuaagaucgucgcccauugcccgccccaggauccuugucuggugcacggcugcauuguuugcgcgcaugggcuuaucaacuaucaaugucacaccgcuuucuccgccuuuguggucguguucguguuuagcucuguugucauuaucugccuggccauucucuacaaagugcugaagugucugaaaaucgcucccagaaaggugcucaauccucugauguggaucacagccuucauucggugggucuauaaaaagaugguggcucgcguugccgacaacaucaaucaggugaacagagagauuggauggauggaaggcgggcagcuuguccugggcaaccccgcgccgaucccucggcacgcccccauuccucgcuacuccacguaccucaugcugcuucugaucgugagcuaugcuuccgcc

SEQ ID NO: 14646 - RNA, 1680 nt, Artificial Sequence
  derived and/or modified CDS sequence (opt5) from RVFV(TAN/Dod-002/07)__HM586971.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauuccaagaaaguguaucuggacaagcucgaccugaagaccgaagagaaccugcuccccgauagcuuugucuguuucgagcacaaagggcaauacaagggaacaauggacucuggccagaccaaacgggaacugaaguccuuugauaucagccagugcccgaaaauugggggacauggccgcaagaagugcacaggcgacgcugccuucuguucugccuacgagugcaccgcucaguaugcgaaugccuacuguucccacgcuaacgggagcggaaucguucaaauccagguguccggcguguggaaaaagccucuuugcgucggguaugaaagagugguugugaaacgggagcugucugccaagcccauucagcgcgucgaaccuuguacgacaugcaucaccaaaugugagccccacggacucgugguuagaagcacaggcuuuaagauuuccagcgccguggcuugcgccucuggggucugugugaccggaucccaaagccccucuaccgagaucacacugaaguacccuggcauuagccaguccucuggcggggauaucggaguccauauggcgcacgacgaucagagcguguccagcaaaauuguugcucauugcccgccccaggacccuugucuugugcacggcugcaucgucugcgcccaagccuggaucauuucucaguggcauacggcucuguccgccuucgugguuaucuucguguuuagcucuaccgcuauuaucugucucgccguccuguaucgggugcugaagugccucaaaauugcgccccgcaaggugcugaauccucuuauguggaucacagccuucaucagauggguuuacaaaaagauggucgcucggguggccgauaacauuaaucaggugaaccgcgaaaucggguggauggagggaggccagcuggcucucgggaaucccgccccgauuccuagacacgcgcccaucccucgguauuccaccuaccugaugcuucugcucauugucagcuacgccuccgcu

SEQ ID NO: 14647 - RNA, 1680 nt, Artificial Sequence
  derived and/or modified CDS sequence (opt5) from RVFV(KEN/Gar-004/06)__HM586964.1__Gn
auggccggcaucgcuaugaccgugcugcccgcccucgcggucuucgcucuggccccuguuguguuugccgaggacccgcaccuuagaaaccggcccgggaagggacauaauuacauugauggcaugacacaggaagacgcuacgugcaaaccugugaccuaugccggggcuuguagcuccuucgauguccugcucgagaagggaaaauuuccccuguuccaaucuuacgcccaccaucgcacacuucuggaagcggugcacgacaccaucauugccaaggcugauccucccagcugcgaccuccaguccgcccauggcaacccuuguaugaaagagaagcugguuaugaagacacacugcccgaaugauuaucagucugcucacuaccugaacaaugacgggaaaauggccagcgugaagugucccccuaaauaugaacucaccgaggauugcaacuuuuguagacagaugacaggagcgucccugaagaaaggcucuuacccccuucaagaccuguucugccagagcuccgaggaugacggcagcaagcucaagaccaaaaugaagggggucugugaagugggaguucaggcccugaaaaagugcgauggccagcuuucuacggcucaugagguggucccuuuugccguguucaaaaauucccaaaagguguaucuggacaaacucgaccugaagaccgaagagaaccugcuccccgauagcuuugucuguuucgagcacaaggggcaguacaaaggaacaauggacucuggccagaccaagcgggaacugaaauccuuugauaucagccagugcccgaagauugggggacauggccgcaaaaagagaacaggcgacgcugccuucugcucugccuacgaguguaccgcucaauaugcgaaugccuacugcucccgggcuaacgggagcggaaucguucagauccaggugucccgcguguggaagaaaccucuuugugucggcuaugaaagagugguugugaagcgggagcugucugccaaacccauucaacgcgucgaaccuugcacgacauguaucaccaagugcgagccccacgggcucgugguuagaagcacaggauuuaaaauuuccagcgccguggcuugugccucuggcgucugcgugaccgggucccagagccccucuaccgagaucacacugaaguacccuggaauuagccaguccucuggcggcgauaucgggguccacauggcgcaugacgaucagagcguguccagcaagauuguugcucacuguccgccccaagacccuugccuugugcauggauguaucgucugcgcccacggccugaucaauaaccagucucauuccgcccucagcgcuuucgugguuauuuucguguuuucuuccacggccaucauuugccuggcuguccuguaucgggugcucaaaugucugaagaucgcgccccgcaaagugcuuaauccucugauguggauuaccgccuucaucagauggguuuacaagaaaauggucgcccggguggcugauaacaucaaucaggugaaccgcgaaauuggguggauggagggaggccagcucgcccuggggaaccccgcuccgaucccuagacacgcccccauuccucgguauagcacauaccuuaugcugcuccugaucgucuccuacgcgucugcc

SEQ ID NO: 14648 - RNA, 1521 nt, Artificial Sequence
  derived and/or modified CDS sequence (opt5) from RVFV(ZH-548)__DQ380206.1__Gc
ugcagcgagcugauccaggccuccucuagaauuaccacauguagcacggaaggcgugaacaccaagugccggcucuccgggacagcucugauccgcgccggaucugucggcgcggaggcuugucuuaugcugaaagggguuaaggaagaccaaaccaaauuccucaagauuaaaacagugagcuccgagcugucuugcagagaaggacagagcuacuggaccggcuccuuuagccccaagugucuuucuucccggcgcugccaccuggugggggagugucaugucaauagaugccucagcuggcgggauaacgagacaucugccgaguucuccuuugugggagaaagcaccacgaugcgcgaaaauaaguguuucgagcagugcggcggcuggggguguggaugcuuuaacguuaauccuucuugccuguucgugcacaccuaucugcaguccgucagaaaagaggcccuccggguguuuaacuguaucgacuggguucauaagcugacacuugaaauuaccgauuucgacggcagcguguccacaaucgaucugggggcuucuagcucccgcuuuaccaauuggggaagcgucucucucucccuggacgccgagggcaucagcgggucuaacagcuucuccuuuauugaaucuccgggaaaaggcuacgcuaucguggaugagcccuucagcgaaauuccuagacaaggcuuucuuggggagauccggugcaauuccgagagcucugugcuguccgcccacgaaagcugucuccgcgcgcccaaccugauuucuuauaagccuaugaucgaccagcuggagugcacgacaaaucucauugaucccuucgucguuuucgaaagaggaucccugccucagacccggaacgacaaaacauuugccgcuagcaagggcaaucgcggggugcaggccuucuccaagggaucugugcaagcugaucuuacccugauguuugacaacuucgaggucgauuuugugggcgccgcgguuagcugugacgccgcuuuccucaaucugaccgggugcuacuccuguaacgccggagcuagagugugccuuucuaucacaagcacgggcaccggcucccugagcgcccauaacaaagacgggucucuccacaucguccugccguccgaaaauggaacaaaggaucagugucagauucugcacuuuaccgugcccgagguugaggaagaguucauguauagcugcgacggcgaugaacggccucuccuggugaaagggacacuuaucgccauugaccccuuugaugacagacgcgaggcuggaggcgaaucuaccgucgugaacccuaaguccgggagcuggaauuucuuugauugguucucuggccugaugagcugguuuggaggcccccucaaaacgauccugcuuauuugucuguacgucgcgcucuccaucgggcuguucuuccugcucaucuaucugggacggacaggccuuagcaagauguggcuggccgcuaccaaaaaggccucu

SEQ ID NO: 14649 - RNA, 1521 nt, Artificial Sequence
  derived and/or modified CDS sequence (opt5) from RVFV(35/74)__JF784387.1__Gc
ugcagcgagcugauccaggccuccucuagaauuaccacauguagcacggaaggcgugaacaccaagugccggcucuccgggacagcucugauccgcgccggaucugucggcgcggaggcuugucuuaugcugaaagggguuaaggaagaccaaaccaaauuccucaagauuaaaacagugagcuccgagcugucuugcagagaaggacagagcuacuggaccggcuccuuuagccccaagugucuuucuucccggcgcugccaccuggugggggagugucaugucaauagaugccucagcuggcgggauaacgagacaucugccgaguucuccuuugugggagaaagcaccacgaugcgcgaaaauaaguguuucgagcagugcggcggcuggggguguggaugcuuuaacguuaauccuucuugccuguucgugcacaccuaucugcaguccgucagaaaagaggcccuccggguguuuaacuguaucgacuggguucauaagcugacacuugaaauuaccgauuucgacggcagcguguccacaaucgaucugggggcuucuagcucccgcuuuaccaauuggggaagcgucucucucucccuggacgccgagggcaucagcgggucuaacagcuucuccuuuauugaaucuccgggaaaaggcuacgcuaucguggaugagcccuucagcgaaauuccuagacaaggcuuucuuggggagauccggugcaauuccgagagcucugugcuguccgcccacgaaagcugucuccgcgcgcccaaccugauuucuuauaagccuaugaucgaccagcuggagugcacgacaaaucucauugaucccuucgucguuuucgaaagaggaucccugccucagacccggaacgacaaaacauuugccgcuagcaagggcaaucgcggggugcaggccuucuccaagggaucugugcaagcugaucuuacccugauguuugacaacuucgaggucgauuuugugggcgccgcgguuagcugugacgccgcuuuccucaaucugaccgggugcuacuccuguaacgccggagcuagagugugccuuucuaucacaagcacgggcaccggcacacuguccgcccauaacaaagacgggagccuccacaucguccugccgucugaaaauggaaccaaggaucagugucagauucugcacuuuacagugcccgagguugaggaagaguucauguauuccugcgacggcgaugaacggccucuccuggugaaagggacccuuaucgccauugaccccuuugaugacagacgcgaggcuggaggcgaaagcacggucgugaacccuaagucuggguccuggaauuucuuugauugguucagcggccugaugucuugguuuggaggcccccucaaaacaauccugcuuauuugucuguacgucgcgcucagcaucgggcuguucuuccugcucaucuaucugggacggaccggccuuuccaagauguggcuggccgcuaccaaaaaggccagc

SEQ ID NO: 14650 - RNA, 1521 nt, Artificial Sequence
  derived and/or modified CDS sequence (opt5) from RVFV(200803162)__JF311377.1__Gc
ugcagcgagcugauccaggccuccucuagaauuaccacauguagcacggaaggcgugaacaccaagugccggcucuccgggacagcucugauccgcgccggaucugucggcgcggaggcuugucuuaugcugaaagggguuaaggaagaccaaaccaaauuccucaagauuaaaacagugagcuccgagcugucuugcagagaaggacagagcuacuggaccggcuccuuuagccccaagugucuuucuucccggcgcugccaccuggugggggagugucaugucaauagaugccucagcuggcgggauaacgagacaucugccgaguucuccuuugugggagaaagcaccacgaugcgcgaaaauaaguguuucgagcagugcggcggcuggggguguggaugcuuuaacguuaauccuucuugccuguucgugcacaccuaucugcaguccgucagaaaagaggcccuccggguguuuaacuguaucgacuggguucauaagcugacacuugaaauuaccgauuucgacggcagcguguccacaaucgaucugggggcuucuagcucccgcuuuaccaauuggggaagcgucucucucucccuggacgccgagggcaucagcgggucuaacagcuucuccuuuauugaaucuccgggaaaaggcuacgcuaucguggaugagcccuucagcgaaauuccuagacaaggcuuucuuggggagauccggugcaauuccgagagcucugugcuguccgcccacgaaagcugucuccgcgcgcccaaccuggucucuuauaagccuaugauugaccagcuggagugcacgacaaaucucaucgaucccuucguuguguucgaaagaggaucccugccucagacccggaacgacaaaacauuugccgcuagcaagggcaaucgcggggugcaggccuucuccaagggaucuguccaagcugaucuuacccugauguuugacaacuucgagguggauuuuguuggcgccgcggugagcugugacgccgcuuuccucaaucugaccgggugcuacuccuguaacgccggagcuagagucugccuuucuauuacaagcacgggcaccggcacacuguccgcccauaacaaagacgggagccuccacaucgugcugccgucugaaaauggaaccaaggaucagugucagauccugcacuuuacaguucccgagguggaggaagaguucauguauuccugcgacggcgaugaacggccucuccuggucaaagggacccuuauugccaucgaccccuuugaugacagacgcgaggcuggaggcgaaagcacgguggucaacccuaagucuggguccuggaauuucuuugauugguucagcggccugaugucuugguuuggaggcccccucaaaacaauucugcuuaucugucuguacguggcgcucagcauugggcuguucuuccugcucaucuaucugggacggaccggccuuuccaagauguggcuggccgcuaccaaaaaggccagc

SEQ ID NO: 14651 - RNA, 1521 nt, Artificial Sequence
  derived and/or modified CDS sequence (opt5) from RVFV(200803166)__JF311381.1__Gc
ugcagcgagcugauccaggccuccucuagaauuaccacauguagcacggaaggcgugaacaccaagugccggcucuccgggacagcucugauccgcgccggaucugucggcgcggaggcuugucuuaugcugaaagggguuaaggaagaccaaaccaaauuccucaagauuaaaacagugagcuccgagcugucuugcagagaaggacagagcuacuggaccggcuccuuuagccccaagugucuuucuucccggcgcugccaccuggugggggagugucaugucaauagaugccucagcuggcgggauaacgagacaucugccgaguucuccuuugugggagaaagcaccacgaugcgcgaaaauaaguguuucgagcagugcggcggcuggggguguggaugcuuuaacguuaauccuucuugccuguucgugcacaccuaucugcaguccgucagaaaagaggcccuccggguguuuaacuguaucgacuggguucauaagcugacacuugaaauuaccgauuucgacggcagcguguccacaaucgaucugggggcuucuagcucccgcuuuaccaauuggggaagcgucucucucucccuggacgccgagggcaucagcgggucuaacagcuucuccuuuauugaaucuccgggaaaaggcuacgcuaucguggaugagcccuucagcgaaauuccuagacaaggcuuucuuggggagauccggugcaauuccgagagcucugugcuguccgcccacgaaagcugucuccgcgcgcccaaccugauuucuuauaagccuaugaucgaccagcuggagugcacgacaaaucucauugaucccuucgucguuuucgaaagaggaucccugccucagacccggaacgacaaaacauuugccgcuagcaagggcaaucgcggggugcaggccuucuccaagggaucugugcaagcugaucuuacccugauguuugacaacuucgaggucgauuuugugggcgccgcgguuagcugugacgccgcuuuccucaaucugaccgggugcuacuccuguaacgccggagcuagagugugccuuucuaucacaagcacgggcaccggcacacuguccgcccauaacaaagacgggagccuccacgucgugcugccgucugaaaauggaaccaaggaucagugucagauccugcacuuuacaguucccgagguggaggaagaguucauguauuccugcgacggcgaugaacggccucuccuggucaaagggacccuuauugccaucgaccccuuugaugacagacgcgaggcuggaggcgaaagcacgguggucaacccuaagucuggguccuggaauuucuuugauugguucagcggccugaugucuugguuuggaggcccccucaaaacaauucugcuuaucugucuguacguggcgcucagcauugggcuguucuuccugcucaucuaucugggacggaccggccuuuccaagauguggcuggccgcuaccaaaaaggccagc

SEQ ID NO: 14652 - RNA, 1521 nt, Artificial Sequence
  derived and/or modified CDS sequence (opt5) from RVFV(SA-51 (Van Wyck))__DQ380195.1__Gc
ugcagcgagcugauccaggccuccucuagaauuaccacauguagcacggaaggcgugaacaccaagugccggcucuccgggacagcucugauccgcgccggaucugucggcgcggaggcuugucuuaugcugaaagggguuaaggaagaccaaaccaaauuccucaagauuaaaacagugagcuccgagcugucuugcagagaaggacagagcuacuggaccggcuccuuuagccccaagugucuuucuucccggcgcugccaccuggugggggagugucaugucaauagaugccucagcuggcgggauaacgagacaucugccgaguucuccuuugugggagaaagcaccacgaugcgcgaaaauaaguguuucgagcagugcggcggcuggggguguggaugcuuuaacguuaauccuucuugccuguucgugcacaccuaucugcaguccgucagaaaagaggcccuccggguguuuaacuguaucgacuggguucauaagcugacacuugaagugaccgauuucgacggcagcgucuccacaauugaucugggggcuucuagcucccgcuuuaccaauuggggaagcgugucucucucccuggacgccgagggcaucagcgggucuaacagcuucuccuuuaucgaaucuccgggaaaaggcuacgcuauuguggaugagcccuucagcgaaaucccuagacaaggcuuucuuggggagauucggugcaauuccgagagcucuguccuguccgcccacgaaagcugucuccgcgcgcccaaccugaucucuuauaagccuaugauugaccagcuggagugcacgacaaaucucaucgaucccuucguuguguucgaaagaggaucccugccucagacccggaacgacaaaacauuugccgcuagcaagggcaaucgcggggugcaggccuucuccaagggaucuguccaagcugaucuuacccugauguuugacaacuucgagguggauuuuguuggcgccgcggugagcugugacgccgcuuuccucaaucugaccgggugcuacuccuguaacgccggagcuagagucugccuuucuauuacaagcacgggcaccggcacacuguccgcccauaacaaagacgggagccuccacaucgugcugccgucugaaaauggaaccaaggaucagugucagauccugcacuuuacaguucccgagguggaggaagaguucauguauuccugcgacggcgaugaacggccucuccuggucaaagggacccuuauugccaucgaccccuuugaugacagacgcgaggcuggaggcgaaagcacgguggucaacccuaagucuggguccuggaauuucuuugauugguucagcggccugaugucuugguuuggaggcccccucaaaacaauucugcuuaucugucuguacguggcgcucagcauugggcuguucuuccugcucaucuaucugggacggaccggccuuuccaagauguggcuggccgcuaccaaaaaggccagc

SEQ ID NO: 14653 - RNA, 1521 nt, Artificial Sequence
  derived and/or modified CDS sequence (opt5) from RVFV(ZINGA J83 R1)__KU978776.1__Gc
ugcagcgagcugauccaggccuccucuagaauuaccacauguagcacggaaggcgugaacaccaagugccggcucuccgggacagcucugauccgcgccggaucugucggcgcggaggcuugucuuaugcugaaagggguuaaggaagaccaaaccaaauuccucaagauuaaaacagugagcuccgagcugucuugcagagaaggacagagcuacuggaccggcuccuuuagccccaagugucuuucuucccggcgcugccaccuggugggggagugucaugucaauagaugccucagcuggcgggauaacgagacaucugccgaguucuccuuugugggagaaagcaccacgaugcgcgaaaauaaguguuucgagcagugcggcggcuggggguguggaugcuuuaacguuaauccuucuugccuguucgugcacaccuaucugcaguccgucagaaaagaggcccuccggguguuuaacuguaucgacuggguucauaagcugacacuugaaauuaccgauuucgacggcagcguguccacaaucgaucugggggcuucuagcucccgcuuuaccaauuggggaagcgucucucucucccuggacgccgagggcaucagcgggucuaacagcuucuccuuuauugaaucuccgggaaaaggcuacgcuaucguggaugagcccuucagcgaaauuccuagacaaggcuuucuuggggagauccggugcaauuccgagagcucugugcuguccgcccacgaaagcugucuccgcgcgcccaaccugauuucuuauaagccuaugaucgaccagcuggagugcacgacaaaucucauugaucccuucgucguuuucgaaagaggaucccugccucagacccggaacgacaaaacauuugccgcuagcaagggcaaucgcggggugcaggccuucuccaagggaucugugcaagcugaucuuacccugauguuugacaacuucgaggucgauuuugugggcgccgcgguuagcugugacgccgcuuuccucaaucugaccgggugcuacuccuguaacgccggagcuagagugugccuuucuaucacaagcacgggcaccggcacacuguccgcccauaacaaagacgggagccuccacaucguccugccgucugaaaauggaaccaaggaucagugucagauucugcacuuuacagugcccgagguugaggaagaguucauguauuccugcgacggcgaugaacggccucuccuggugagagggacccuuaucgccauugaccccuuugaugaccgccgggaggcuggaggcgaaagcacggucgugaacccuaaaucuggguccuggaauuucuuugauugguucagcggccugaugucuugguuuggaggcccccucaagacaauccugcuuauuugucuguacgucgcgcucagcaucgggcuguucuuccugcucaucuaucugggaagaaccggccuuuccaaaauguggcuggccgcuaccaagaaagccagc

SEQ ID NO: 14654 - RNA, 1521 nt, Artificial Sequence
  derived and/or modified CDS sequence (opt5) from RVFV(Entebbe)__DQ380191.1__Gc
ugcagcgagcugauccaggccuccucuagaauuaccacauguagcacggaaggcgugaacaccaagugccggcucuccgggacagcucugauccgcgccggaucugucggcgcggaggcuugucuuaugcugaaagggguuaaggaagaccaaaccaaauuccucaagauuaaaacagugagcuccgagcugucuugcagagaaggacagagcuacuggaccggcuccuuuagccccaagugucuuucuucccggcgcugccaccuggugggggagugucaugucaauagaugccucagcuggcgggauaacgagacaucugccgaguucuccuuugugggagaaagcaccacgaugcgcgaaaauaaguguuucgagcagugcggcggcuggggguguggaugcuuuaacguuaauccuucuugccuguucgugcacaccuaucugcaguccgucagaaaagaggcccuccggguguuuaacuguaucgacuggguucauaagcugacacuugaaauuaccgauuucgacggcagcguguccacagucgaucugggggcuucuagcucccgcuuuaccaauuggggaagcgugucucucucccuggacgccgagggcaucagcgggucuaacagcuucuccuuuaucgaaucuccgggaaaaggcuacgcuauuguggaugagcccuucagcgaaaucccuagacaaggcuuucuuggggagauucggugcaauuccgagagcucuguccuguccgcccacgaaagcugucuccgcgcgcccaaccugaucucuuauaagccuaugauugaccagcuggagugcacgacaaaucucaucgaucccuucguuguguucgaaagaggaucccugccucagacccggaacgacaaaacauuugccgcuagcaagggcaaucgcggggugcaggccuucuccaagggaucuguccaagcugaucuuacccugauguuugacaacuucgagguggauuuuguuggcgccgcggugagcugugacgccgcuuuccucaaucugaccgggugcuacuccuguaacgccggagcuagagucugccuuucuauuacaagcacgggcaccggcacacuguccgcccauaacaaagacgggagccuccacaucgugcugccgucugaaaauggaaccaaggaucagugucagauccugcacuuuacaguucccgagguggaggaagaguucauguauuccugcgacggcgaugaacggccucuccuggucaaagggacccuuauugccaucgaccccuuugaugacagacgcgaggcuggaggcgaaagcacgguggucaacccuaagucuggguccuggaauuucuuugauugguucagcggccugaugucuugguuuggaggcccccucaaaacaauucugcuuaucugucuguacguggcgcucagcauugggcuguucuuccugcucaucuaucugggacggaccggccuuuccaagauguggcuggccgcuaccaaaaaggccagc

SEQ ID NO: 14655 - RNA, 1521 nt, Artificial Sequence
  derived and/or modified CDS sequence (opt5) from RVFV(Sudan 2V-2007)__JQ820490.1__Gc
ugcagcgagcugauccaggccuccucuagaauuaccacauguagcacggaaggcgugaacaccaagugccggcucuccgggacagcucugauccgcgccggaucugucggcgcggaggcuugucuuaugcugaaagggguuaaggaagaccaaaccaaauuccucaagauuaaaacagugagcuccgagcugucuugcagagaaggacagagcuacuggaccggcuccuuuagccccaagugucuuucuucccggcgcugccaccuggugggggagugucaugucaauagaugccucagcuggcgggauaacgagacaucugccgaguucuccuuugugggagaaagcaccacgaugcgcgaaaauaaguguuucgagcagugcggcggcuggggguguggaugcuuuaacguuaauccuucuugccuguucgugcacaccuaucugcaguccgucagaaaagaggcccuccggguguuuaacuguaucgacuggguucauaagcugacacuugaaauuaccgauuucgacggcagcguguccacaaucgaucugggggcuucuagcucccgcuuuaccaauuggggaagcgucucucucucccuggacgccgagggcaucagcgggucuaacagcuucuccuuuauugaaucuccgggaaaaggcuacgcuaucguggaugagcccuucagcgaaauuccuagacaaggcuuucuuggggagauccggugcaauuccgagagcucugugcuguccgcccacgaaagcugucuccgcgcgcccaaccugauuucuuauaagccuaugaucgaccagcuggagugcacgacaaaucucauugaucccuucgucguuuucgaaagaggaucccugccucagacccggaacgacaaaacauuugccgcuagcaagggcaaucgcggggugcaggccuucuccaagggaucugugcaagcugaucuuacccugauguuugacaacuucgaggucgauuuugugggcgccgcgguuagcugugacgccgcuuuccucaaucugaccgggugcuacuccuguaacgccggagcuagagugugccuuucuaucacaagcacgggcaccggcacacuguccgcccauaacaaagacgggagccuccacaucguccugccgucugaaaauggaaccaaggaucagugucagauucugcacuuuacagugcccgagguugaggaagaguucauguauuccugcgacggcgaugaacggccucuccuggugaaagggacccuuauggccaucgaccccuuugaugacagacgcgaggcuggaggcgaaagcacggucgugaacccuaagucuggguccuggaauuucuuugauugguucagcggccugaugucuugguuuggaggcccccucaaaacaauucugcuuaucugucuguacgucgcgcucagcauugggcuguucuuccugcucaucuaucugggacggaccggccuuuccaagauguggcuggccgcuaccaaaaaggccagc

SEQ ID NO: 14656 - RNA, 1521 nt, Artificial Sequence
  derived and/or modified CDS sequence (opt5) from RVFV(Sudan 86-2010)__JQ820489.1__Gc
ugcagcgagcugauccaggccuccucuagaauuaccacauguagcacggaaggcgugaacaccaagugccggcucuccgggacagcucugauccgcgccggaucugucggcgcggaggcuugucuuaugcugaaagggguuaaggaagaccaaaccaaauuccucaagauuaaaacagugagcuccgagcugucuugcagagaaggacagagcuacuggaccggcuccuuuagccccaagugucuuucuucccggcgcugccaccuggugggggagugucaugucaauagaugccucagcuggcgggauaacgagacaucugccgaguucuccuuugugggagaaagcaccacgaugcgcgaaaauaaguguuucgagcagugcggcggcuggggguguggaugcuuuaacguuaauccuucuugccuguucgugcacaccuaucugcaguccgucagaaaagaggcccuccggguguuuaacuguaucgacuggguucauaagcugacacuugaaauuaccgauuucgacggcagcguguccacaaucgaucugggggcuucuagcucccgcuuuaccaauuggggaagcgucucucucucccuggacgccgagggcaucagcgggucuaacagcuucuccuuuauugaaucuccgggaaaaggcuacgcuaucguggaugagcccuucagcgaaauuccuagacaaggcuuucuuggggagauccggugcaauuccgagagcucugugcuguccgcccacgaaagcugucuccgcgcgcccaaccugauuucuuauaagccuaugaucgaccagcuggagugcacgacaaaucucauugaucccuucgucaucuucgaaagaggaucccugccucagacccggaacgacaaaacauuugccgcuagcaagggcaaucgcgggguucaggccuucuccaagggaucugugcaagcugaucuuacccugauguuugacaacuucgagguggauuuugucggcgccgcggugagcugugacgccgcuuuccucaaucugaccgggugcuacuccuguaacgccggagcuagaguuugccuuucuaucacaagcacgggcaccggcacacuguccgcccauaacaaagacgggagccuccacauugugcugccgucugaaaauggaaccaaggaucagugucagauccugcacuuuacaguccccgagguggaggaagaguucauguauuccugcgacggcgaugaacggccucuccugguuaaagggacccuuauugccaucgaccccuuugaugacagacgcgaggcuggaggcgaaagcacgguggucaacccuaagucuggguccuggaauuucuuugauugguucagcggccugaugucuugguuuggaggcccccucaaaacaauucugcuuaucugucuguacguggcgcucagcaucgggcuguucuuccugcucauuuaucugggacggaccggccuuuccaagauguggcuggccgcuaccaaaaaggccagc

SEQ ID NO: 14657 - RNA, 1521 nt, Artificial Sequence
  derived and/or modified CDS sequence (opt5) from RVFV(Kenya 56 (IB8))__DQ380190.1__Gc
ugcagcgagcugauccaggccuccucuagaauuaccacauguagcacggaaggcgugaacaccaagugccggcucuccgggacagcucugauccgcgccggaucugucggcgcggaggcuugucuuaugcugaaagggguuaaggaagaccaaaccaaauuccucaagauuaaaacagugagcuccgagcugucuugcagagaaggacagagcuacuggaccggcuccuuuagccccaagugucuuucuucccggcgcugccaccuggugggggagugucaugucaauagaugccucagcuggcgggauaacgagacaucugccgaguucuccuuugugggagaaagcaccacgaugcgcgaaaauaaguguuucgagcagugcggcggcuggggguguggaugcuuuaacguuaauccuucuugccuguucgugcacaccuaucugcaguccgucagaaaagaggcccuccggguguuuaacuguaucgacuggguucauaagcugacacuugaaauuaccgauuucgacggcagcguguccacaaucgaucugggggcuucuagcucccgcuuuaccaauuggggaagcgucucucucucccuggacgccgagggcaucagcgggucuaacagcuucuccuuuauugaaucuccgggaaaaggcuacgcuaucguggaugagcccuucagcgaaauuccuagacaaggcuuucuuggggagauccggugcaauuccgagagcucugugcuguccgcccacgaaagcugucuccgcgcgcccaaccugauuucuuauaagccuaugaucgaccagcuggagugcacgacaaaucucauugaucccuucgucgccuucgaaagaggaucccugccucagacccggaacgacaaaacauuugcugccagcaagggcaaucgcgggguucaggcuuucuccaagggaucugugcaagccgaucuuacccugauguuugacaacuucgagguggauuuugucggcgcggccgugagcugugacgcugccuuccucaaucugaccgggugcuacuccuguaacgcuggagccagaguuugccuuucuaucacaagcacgggcaccggcacacuguccgcccauaacaaagacgggagccuccacaucgugcugccgucugaaaauggaaccaaggaucagugucagauucugcacuuuacaguccccgagguggaggaagaguucauguauuccugcgacggcgaugaacggccucuccugguuaaagggacccuuaucgcuauugaccccuuugaugacagacgcgaggcgggaggcgaaagcacgguggucaacccuaagucuggguccuggaauuucuuugauugguucagcggccugaugucuugguuuggaggcccccucaaaacaauccugcuuauuugucuguacguggcccucagcaucgggcuguucuuccugcucaucuaucugggacggaccggccuuuccaagauguggcuggcugccaccaaaaaggccagc

SEQ ID NO: 14658 - RNA, 1521 nt, Artificial Sequence
  derived and/or modified CDS sequence (opt5) from RVFV(ARD-38388)__DQ380187.1__Gc
ugcagcgagcugauccaggccuccucuagaauuaccacauguagcacggaaggcgugaacaccaagugccggcucuccgggacagcucugauccgcgccggaucugucggcgcggaggcuugucuuaugcugaaagggguuaaggaagaccaaaccaaauuccucaagauuaaaacagugagcuccgagcugucuugcagagaaggacagagcuacuggaccggcuccuuuagccccaagugucuuucuucccggcgcugccaccuggugggggagugucaugucaauagaugccucagcuggcgggauaacgagacaucugccgaguucuccuuuaucggagaaagcaccacgaugcgcgaaaauaaguguuucgagcagugcggcggcuggggguguggaugcuuuaacgugaauccuucuugccuguucguucacaccuaucugcaguccgugagaaaagaggcccuccgggucuuuaacuguauugacugggugcauaagcugacacuugaaaucaccgauuucgacggcagcguuuccacaaucgaucugggggcuucuagcucccgcuuuaccaauuggggaagcgugucucucucccuggacgccgagggcauuagcgggucuaacagcuucuccuuuaucgaaucuccgggaaaaggcuacgcuauugucgaugagcccuucagcgaaaucccuagacaaggcuuucuuggggagauucggugcaauuccgagagcucuauccuguccgcccacgaaagcugucuccgcgcgcccaaccugauuucuuauaagccuaugaucgaccagcuggagugcacgacaaaucucaucgaucccuucgugguguucgaaagaggaucccugccucagacccggaacgacaaaacauuugccgcuagcaagggcaaucgcgggguccaggccuucuccaagggaucuguucaagcugaucuuacccugauguuugacaacuucgagguggauuuugugggcgccgcggucagcugugacgccgcuuuccucaaucugaccgggugcuacuccuguaacgccggagcuagagugugccuuucuauuacaagcacgggcaccggcacacuguccgcccauaacaaagacgggagccuccacaucguucugccgucugaaaauggaaccaaggaucagugucagauucugcacuuuacagugcccgaggucgaggaagaguucauguauuccugcgacggcgaugaacggccucuccuggugaaagggacccuuaucgccauugaccccuuugaugacagacgcgaggcuggaggcgaaagcacgguugugaacccuaagucuggguccuggaauuucuuugauugguucagcggccugaugucuugguuuggaggcccccucaaaacaauccugcuuaucugucuguacgucgcgcucagcauugggcuguucuuccugcucaucuaucugggacggaccggccuuuccaagauguggcuggccgcuaccaaaaaggccagc

SEQ ID NO: 14659 - RNA, 1521 nt, Artificial Sequence
  derived and/or modified CDS sequence (opt5) from RVFV(Sudan 28-2010)__JQ820491.1__Gc
ugcagcgagcugauccaggccuccucuagaauuaccacauguagcacggaaggcgugaacaccaagugccggcucuccgggacagcucugauccgcgccggaucugucggcgcggaggcuugucuuaugcugaaagggguuaaggaagaccaaaccaaauuccucaagauuaaaacagugagcuccgagcugucuugcagagaaggacagagcuacuggaccggcuccuuuagccccaagugucuuucuucccggcgcugccaccuggugggggagugucaugucaauagaugccucagcuggcgggauaacgagacaucugccgaguucuccuuugugggagaaagcaccacgaugcgcgaaaauaaguguuucgagcagugcggcggcuggggguguggaugcuuuaacguuaauccuucuugccuguucgugcacaccuaucugcaguccgucagaaaagaggcccuccggguguuuaacuguaucgacuggguucauaagcugacacuugaaauuaccgauuucgacggcagcguguccacaaucgaucugggggcuucuagcucccgcuuuaccaauuggggaagcgucucucucucccuggacgccgagggcaucagcgggucuaacagcuucuccuuuauugaaucuccgggaaaaggcuacgcuaucguggaugagcccuucagcgaaauuccuagacaaggcuuucuuggggagauccggugcaauuccgagagcucugugcuguccgcccacgaaagcugucuccgcgcgcccaaccugauuucuuauaagccuaugaucgaccagcuggagugcacgacaaaucucauugaucccuucgucguuuucgaaagaggaucccugccucagacccggaacgacaaaacauuugccgcuagcaagggcaaucgcggggugcaggccuucuccaagggaucugugcaagcugaucuuacccugauguuugacaacuucgaggucgauuuugugggcgccgcgguuagcugugacgccgcuuuccucaaucugaccgggugcuacuccuguaacgccggagcuagagugugccuuucuaucacaagcacgggcaccggcacacuguccgcccauaacaaagacgggagccuccacaucguccugccgucugaaaauggaaccaaggaucagugucagauucugcacuuuacagugcccgagguugaggaagaguucauguauuccugcgacggcgaugaacggccucuccuggugaaagggacccuuaucgccauugaccccuuugaugacagacgcgaggcuggaggcgaaagcacggucgugaacccuaagucuggguccuggaauuucuuugauugguucagcggccugaugucuugguuuggaggcccccucaaaacaauccugcuuauuugucuguacgucgugcucagcaucgggcuguucuuccugcucaucuaucugggacggaccggccuuuccaagauguggcuggcggccaccaaaaaggcuagc

SEQ ID NO: 14660 - RNA, 1521 nt, Artificial Sequence
  derived and/or modified CDS sequence (opt5) from RVFV(200803167)__JF311382.1__Gc
ugcagcgagcugauccaggccuccucuagaauuaccacauguagcacggaaggcgugaacaccaagugccggcucuccgggacagcucugauccgcgccggaucugucggcgcggaggcuugucuuaugcugaaagggguuaaggaagaccaaaccaaauuccucaagauuaaaacagugagcuccgagcugucuugcagagaaggacagagcuacuggaccggcuccuuuagccccaagugucuuucuucccggcgcugccaccuggugggggagugucaugucaauagaugccucagcuggcgggauaacgagacaucugccgaguucuccuuugugggagaaagcaccacgaugcgcgaaaauaaguguuucgagcagugcggcggcuggggguguggaugcuuuaacguuaauccuucuugccuguucgugcacaccuaucugcaguccgucagaaaagaggcccuccggguguuuaacuguaucgacuggguucauaagcugacacuugaaauuaccgauuucgacggcagcguguccacaaucgaucugggggcuucuagcucccgcuuuaccaauuggggaagcgucucucucucccuggacgccgagggcaucagcgggucuaacagcuucuccuuuauugaaucuccgggaaaaggcuacgcuaucguggaugagcccuucagcgaaauuccuagacaaggcuuucuuggggagauccggugcaauuccgagagcucugugcuguccgcccacgaaagcugucuccgcgcgcccaaccugauuucuuauaagccuaugaucgaccagcuggagugcacgacaaaucucauugaucccuucgucguuuucgaaagaggaucccugccucagacccggaacgacaaaacauuugccgcuagcaagggcaaucgcggggugcaggccuucuccaagggaucugugcaagcugaucuuacccugauguuugacaacuucgaggucgauuuugugggcgccgcgguuagcugugacgccgcuuuccucaaucugaccgggugcuacuccuguaacgccggagcuagagugugccuuucuaucacaagcacgggcaccggcacacuguccgcccauaacaaagacgggagccuccacaucguccugccgucugaaaauggaaccaaggaucagugucagauucugcacuuuacagugcccgagguugaggaagaguucauguauuccugcgacggcgaugaacggccucuccuggugaaagggacccuuaucgccauugaccccuuugaugacagacgcgaggcuggaggcgaaagcacggucgugaacccuaagucuggguccuggaauuucuuugauugguucagcggccugaugucuugguuuggaggcccccucaaaacaaugcugcuuaucugucuguacgucgcgcucagcauugggcuguucuuccugcucaucuaucugggacggaccggccuuuccaagauguggcuggccgcuaccaaaaaggccagc

SEQ ID NO: 14661 - RNA, 1521 nt, Artificial Sequence
  derived and/or modified CDS sequence (opt5) from RVFV(73HB1230)__DQ380221.1__Gc
ugcagcgagcugauccaggccuccucuagaauuaccacauguagcacggaaggcgugaacaccaagugccggcucuccgggacagcucugauccgcgccggaucugucggcgcggaggcuugucuuaugcugaaagggguuaaggaagaccaaaccaaauuccucaagauuaaaacagugagcuccgagcugucuugcagagaaggacagagcuacuggaccggcuccuuuagccccaagugucuuucuucccggcgcugccaccuggugggggagugucaugucaauagaugccucagcuggcgggauaacgagacaucugccgaguucuccuuugugggagaaagcaccaucaugcgcgaaaauaaguguuucgagcagugcggcggcuggggguguggaugcuuuaacguuaauccuucuugccuguucgugcacacguaucugcaguccgucagaaaagaggcccuccggguguuuaacuguauugacuggguucauaagcugacccuugaaaucacagauuucgacggcagcguguccaccaucgaucugggggcuucuagcucccgcuuuacaaauuggggaagcgucucucucucccuggacgccgagggcauuagcgggucuaacagcuucuccuuuaucgaaucuccgggaaaaggcuacgcuauuguggaugagcccuucagcgaaaucccuagacaaggcuuucuuggggagauucggugcaauuccgagagcucugugcuguccgcccacgaaagcugucuccgcgcgcccaaccugaucucuuauaagccuaugauugaccagcuggagugcaccacgaaucucaucgaucccuucgucguuuucgaaagaggaucccugccucagacacggaacgacaaaaccuuugccgcuagcaagggcaaucgcggggugcaggccuucuccaagggaucugugcaagcugaucuuacacugauguuugacaacuucgaggucgauuuugugggcgccgcgguuagcugugacgccgcuuuccucaaucugaccgggugcuacuccuguaacgccggagcuagagugugccuuucuaucaccagcacaggcacgggcacccuguccgcccauaacaaagacgggagccuccacauuguccugccgucugaaaauggaacaaaggaucagugucagauccugcacuuuaccgugcccgagguugaggaagaguucauguauuccugcgacggcgaugaacggccucuccuggugaaagggacacuuauugccaucgaccccuuugaugacagacgcgaggcuggaggcgaaagcaccgucgugaacccuaagucuggguccuggaauuucuuugauugguucagcggccugaugucuugguuuggaggcccccucaaaacgauucugcuuaucugucuguacgucgcgcucagcaucgggcuguucuuccugcucauuuaucugggacggacaggccuuuccaagauguggcuggccgcuaccaaaaaggccagc

SEQ ID NO: 14662 - RNA, 1521 nt, Artificial Sequence
  derived and/or modified CDS sequence (opt5) from RVFV(2250/74)__DQ380209.1__Gc
ugcagcgagcugauccaggccuccucuagaauuaccacauguagcacggaaggcgugaacaccaagugccggcucuccgggacagcucugauccgcgccggaucugucggcgcggaggcuugucuuaugcugaaagggguuaaggaagaccaaaccaaauuccucaagauuaaaacagugagcuccgagcugucuugcagagaaggacagagcuacuggaccggcuccuuuagccccaagugucuuucuucccggcgcugccaccuggugggggagugucaugucaauagaugccucagcuggcgggauaacgagacaucugccgaguucuccuuugugggagaaagcaccacgaugcgcgaaaauaaguguuucgagcagugcggcggcuggggguguggaugcuuuaacguuaauccuucuugccuguucgugcacaccuaucugcaguccgucagaaaagaggcccuccggguguuuaacuguaucgacuggguucauaagcugacacuugaaauuaccgauuucgacggcagcguguccacaaucgaucugggggcuucuagcucccgcuuuaccaauuggggaagcgucucucucucccuggacgccgagggcaucagcgggucuaacagcuucuccuuuauugaaucuccgggaaaaggcuacgcuaucguggaugagcccuucagcgaaauuccuagacaaggcuuucuuggggagauccggugcaauuccgagagcucugugcuguccgcccacgaaagcugucuccgcgcgcccaaccugauuucuuauaagccuaugaucgaccagcuggagugcacgacaaaucucauugaucccuucgucguuuucgaaagaggaucccugccucagacccggaacgacaaaacauuugccgcuagcaagggcaaucgcggggugcaggccuucuccaagggaucugugcaagcugaucuuacccugauguuugacaacuucgaggucgauuuugugggcgccgcgguuagcugugacgccgcuuuccucaaucugaccgggugcuacuccuguaacgccggagcuaaagugugccuuucuaucacaagcacgggcaccggcucccugagcgcccauaacaaggacgggucucuccacaucguccugccguccgaaaauggaacaaaagaucagugucagauucugcacuuuaccgugcccgagguugaggaagaguucauguauagcugcgacggcgaugaaagaccucuccuggugaaggggacacuuaucgccauugaccccuuugaugaccggagagaggcuggaggcgaaucuaccgucgugaacccuaaauccgggagcuggaauuucuuugauugguucucuggccugaugagcugguuuggaggcccccucaagacgauccugcuuauuugucuguacgucgcgcucuccaucgggcuguucuuccugcucaucuaucugggacgcacaggccuuagcaaaauguggcuggccgcuaccaagaaggccucu

SEQ ID NO: 14663 - RNA, 1521 nt, Artificial Sequence
  derived and/or modified CDS sequence (opt5) from RVFV(SAUDI 200010901)__KU978778.1__Gc
ugcagcgagcugauccaggccuccucuagaauuaccacauguagcacggaaggcgugaacaccaagugccggcucuccgggacagcucugauccgcgccggaucugucggcgcggaggcuugucuuaugcugaaagggguuaaggaagaccaaaccaaauuccucaagauuaaaacagugagcuccgagcugucuugcagagaaggacagagcuacuggaccggcuccuuuagccccaagugucuuucuucccggcgcugccaccuggugggggagugucaugucaauagaugccucagcuggcgggauaacgagacaucugccgaguucuccuuugugggagaaagcaccacgaugcgcgaaaauaaguguuucgagcagugcggcggcuggggguguggaugcuuuaacguuaauccuucuugccuguucgugcacaccuaucugcaguccgucagaaaagaggcccuccggguguuuaacuguaucgacuggguucauaagcugacacuugaaauuaccgauuucgacggcagcguguccacaaucgaucugggggcuucuagcucccgcuuuaccaauuggggaagcgucucucucucccuggacgccgagggcaucagcgggucuaacagcuucuccuuuauugaaucuccgggaaaaggcuacgcuaucguggaugagcccuucagcgaaauuccuagacaaggcuuucuuggggagauccggugcaauuccgagagcucugugcuguccgcccacgaaagcugucuccgcgcgcccaaccugauuucuuauaagccuaugaucgaccagcuggagugcacgacaaaucucauugaucccuucgucguuuucgaaagaggaucccugccucagacccggaacgagaaaacauuugccgcuagcaagggcaaucgcggggugcaggccuucuccaagggaucugugcaagcugaccuuacccugauguuugauaacuucgaagucgacuuugugggcgccgcgguuagcugugaugccgcuuuccucaaucugaccgggugcuacuccuguaacgccggagcuagagugugccuuucuaucacaagcacgggcaccggcacacuguccgcccauaacaaagacgggagccuccacaucguccugccgucugagaauggaaccaaggaccagugucagauucugcacuuuacagugcccgagguugaagaggaguucauguauuccugcgauggcgacgaacggccucuccuggugaaagggacccuuaucgccauugaucccuuugacgauagacgcgaagcuggaggcgagagcacggucgugaacccuaagucuggguccuggaauuucuuugacugguucagcggccugaugucuugguuuggaggcccccucaaaacaauccugcuuauuugucuguacgucgcgcucagcaucgggcuguucuuccugcucaucuaucugggacggaccggccuuuccaagauguggcuggccgcuaccaaaaaggccagc

SEQ ID NO: 14664 - RNA, 1521 nt, Artificial Sequence
  derived and/or modified CDS sequence (opt5) from RVFV(Lunyo)__KU167026.1__Gc
ugcagcgagcugauccaggccuccucuagaauuaccacauguagcacggaaggcgugaacacccggugccgccucuccgggacagcucugaucagagccggaucugucggcgcggaggcuugucuuaugcugaaggggguuaaagaagaccaaaccaaguuccucaaaauuaagacagugagcuccgagcugucuugccgggaaggacagagcuacuggaccggcuccuuuagccccaaaugucuuucuucccgcagaugccaccuggugggggagugucaugucaaucggugccucagcuggcgcgauaacgagacaucugccgaguucuccuuugugggagaaagcaccacgaugagagaaaauaaguguuucgagcagugcggcggcuggggguguggaugcuuuaacguuaauccuucuugccuguucgugcacaccuaucugcaguccguccggaaggaggcccuccgcguguuuaacuguaucgacuggguucauaaacugacacuugaaauuaccgauuucgacggcagcguguccacaaucgaucugggggcuucuagcuccagauuuaccaauuggggaagcgucucucucucccuggacgccgagggcaucagcgggucuaacagcuucuccuuuauugaaucuccgggaaagggcuacgcuaucguggaugagcccuucagcgaaauuccucggcaaggcuuucuuggggagauccgcugcaauuccgagagcucugugcuguccgcccacgaaagcugucucagagcgcccaaccugauuucuuauaaaccuaugaucgaccagcuggagugcacgacaaaucucauugaucccuucgucguuuucgaacggggaucccugccucagacccgcaacgacaagacauuugccgcuagcaaaggcaauagaggggugcaggccuucuccaagggaucugugcaagcugaucuuacccugauguuugacaacuucgaggucgauuuugugggcgccgcgguuagcugugacgccgcuuuccucaaucugaccgggugcuacuccuguaacgccggagcucgggugugccuuucuaucacaagcacgggcaccggcacacuguccgcccauaacaaggacgggagccuccacaucguccugccgucugaaaauggaaccaaagaucagugucagauucugcacuuuacagugcccgagguugaggaagaguucauguauuccugcgacggcgaugaaagaccucuccuggugaaggggacccuuaucgccauugaccccuuugaugaccgccgggaggcuggaggcgaaagcacggucgugaacccuaaaucuggguccuggaauuucuuugauugguucagcggccugaugucuugguuuggaggcccccucaagacaauccugcuuauuugucuguacgucgcgcucagcaucgggcuguucuuccugcucaucuaucugggaagaaccggccuuuccaaaauguggcuggccgcuaccaagaaagccagc

SEQ ID NO: 14665 - RNA, 1521 nt, Artificial Sequence
  derived and/or modified CDS sequence (opt5) from RVFV(25010-24)__KM210509.1__Gc
ugcagcgagcugauccaggccuccucuagaauuaccacauguagcacggaaggcgugaacaccaagugccggcucuccgggacagcucugauccgcgccggaucugucggcgcggaggcuugucuuaugcugaaagggguuaaggacgaucaaaccaaauuccucaagauuaaaacagugagcuccgaacugucuugcagagagggacagagcuacuggaccggcuccuuuagccccaagugucuuucuucccggcgcugccaccuggugggggaaugucaugucaauagaugccucagcuggcgggacaacgagacaucugccgaguucuccuuugugggagaaagcaccacgaugcgcgagaauaaguguuucgaacagugcggcggcuggggguguggaugcuuuaacguuaauccuucuugccuguucgugcacaccuaucugcaguccgucagaaaagaggcccuccggguguuuaacuguaucgauuggguucauaagcugacacuugagauuaccgacuucgauggcagcguguccacaaucgaccugggggcuucuagcucccgcuuuaccaauuggggaagcgucucucucucccuggaugccgaaggcaucagcgggucuaacagcuucuccuuuauugagucuccgggaaaaggcuacgcuaucguggacgaacccuucagcgagauuccuagacaaggcuuucuuggggaaauccggugcaauuccgagagcucugugcuguccgcccacgagagcugucuccgcgcgcccaaccugauuucuuauaagccuaugaucgaucagcuggaaugcacgacaaaucucauugaccccuucgucguuuucgagagaggaucccugccucagacccggaacgauaaaacauuugccgcuagcaagggcaaucgcggggugcaggccuucuccaagggaucugugcaagcugaccuuacccugauguuugauaacuucgaagucgacuuugugggcgccgcgguuagcugugacgccgcuuuccucaaucugaccgggugcuacuccuguaacgccggagcuagagugugccuuucuaucacaagcacgggcaccggcacacuguccgcccauaacaaagaugggagccuccacaucguccugccgucugagaauggaaccaaggaccagugucagauucugcacuuuacagugcccgaaguugaggaggaguucauguauuccugcgauggcgacgaacggccucuccuggugaaagggacccuuaucgccauugaucccuuugacgauagacgcgaagcuggaggcgagagcacggucgugaacccuaagucuggguccuggaauuucuuugacugguucagcggccugaugucuugguuuggaggcccccucaaaacaauccugcuuauuugucuguacgucgcgcucagcaucgggcuguucuuccugcucaucuaucugggacggaccggccuuuccaagauguggcuggccgcuaccaaaaaggccagc

SEQ ID NO: 14666 - RNA, 1521 nt, Artificial Sequence
  derived and/or modified CDS sequence (opt5) from RVFV(2007000253)__JF326192.1__Gc
ugcagcgagcugauccaggccuccucuagaauuaccacauguagcacggaaggcgugaacaccaagugccggcucuccgggacagcucugauccgcgccggaucugcgggcgcugaggccugucuuaugcugaaaggggucaaggaagaccaaaccaaauuccucaagauuaaaacaguuagcuccgagcugucuugcagagaaggacagagcuacuggaccggcuccuuuagccccaagugucuuucuucccggcgcugccaccuggugggggagugucaugugaauagaugccucagcuggcgggauaacgagacaucugccgaguucuccuuugucggagaaagcaccacgaugcgcgaaaauaaguguuucgagcagugcggcggcuggggguguggaugcuuuaacgugaauccuucuugccuguucguucacaccuaucugcaguccgugagaaaagaggcucuccgggucuuuaacuguaucgacugggugcauaagcugacacuugaaauuaccgauuucgacggcagcguuuccacaaucgaucugggggccucuagcucccgcuuuaccaauuggggaagcgugucucucucccuggacgcugagggcaucagcgggucuaacagcuucuccuuuauugaaucuccgggaaaaggcuacgccaucgucgaugagcccuucagcgaaauuccuagacaaggcuuucuuggggagauccggugcaauuccgagagcucugugcuguccgcgcacgaaagcugucuccgcgcccccaaccuggugucuuauaagccuaugauugaccagcuggagugcacgacaaaucucaucgaucccuucgucguuuucgaaagaggaucccugccucagacccggaacgacaaaacauuugcugccagcaagggcaaucgcggggugcaggcuuucuccaagggaucugugcaagccgaucuuacccugauguuugacaacuucgaggucgauuuugugggcgcggccguuagcugugacgcugccuuccucaaucugaccgggugcuacuccuguaacgcuggagccagagugugccuuucuauuacaagcacgggcaccggcacacuguccgcccauaacaaagacgggagccuccacaucguccugccgucugaaaauggaaccaaggaucagugucagauccugcacuuuacagugcccgagguugaggaagaguucauguauuccugcgacggcgaugaacggccucuccuggugaaagggacccuuauugcuaucgaccccuuugaugacagacgcgaggcgggaggcgaaagcacggucgugaacccuaagucuggguccuggaauuucuuugauugguucagcggccugaugucuugguuuggaggcccccucaaaacaauucugcuuaucugucuguacgucgcccucagcauugggcuguucuuccugcucaucuaucugggacggaccggccuuuccaagauguggcuggcugccaccaaaaaggccagc

SEQ ID NO: 14667 - RNA, 1521 nt, Artificial Sequence
  derived and/or modified CDS sequence (opt5) from RVFV(ZC-3349)__DQ380207.1__Gc
ugcagcgagcugauccaggccuccucuagaauuaccacauguagcacggaaggcgugaacaccaagugccggcucuccgggacagcucugauccgcgccggaucugucggcgcggaggcuugucuuaugcugaaagggguuaaggaagaccaaaccaaauuccucaagauuaaaacagugagcuccgagcugucuugcagagaaggacagagcuacuggaccggcuccuuuagccccaagugucuuucuucccggcgcugccaccuggugggggagugucaugucaauagaugccucagcuggcgggauaacgagacaucugccgaguucuccuuugugggagaaagcaccacgaugcgcgaaaauaaguguuucgagcagugcggcggcuggggguguggaugcuuuaacguuaauccuucuugccuguucgugcacaccuaucugcaguccgucagaaaagaggcccuccggguguuuaacuguaucgacuggguucauaagcugacacuugaaauuaccgauuucgacggcagcguguccacaaucgaucugggggcuucuagcucccgcuuuaccaauuggggaagcgucucucucucccuggacgccgagggcaucagcgggucuaacagcuucuccuuuauugaaucuccgggaaaaggcuacgcuaucguggaugagcccuucagcgaaauuccuagacaaggcuuucuuggggagauccggugcaauuccgagagcucugugcuguccgcccacgaaagcugucucaaggcgcccaaccugauuucuuauaaaccuaugaucgaccagcuggagugcacgacaaaucucauugaucccuucgucguuuucgaacgcggaucccugccucagaccagaaacgacaagacauuugccgcuagcaagggcaaucgcggggugcaggccuucuccaaaggaucugugcaagcugaucuuacccugauguuugacaacuucgaggucgauuuugugggcgccgcgguuagcugugacgccgcuuuccucaaucugaccgggugcuacuccuguaacgccggagcucgggugugccuuucuaucacaagcacgggcaccggcucccugagcgcccauaacaaggacgggucucuccacaucguccugccguccgaaaauggaacaaaagaucagugucagauucugcacuuuaccgugcccgagguugaggaagaguucauguauagcugcgacggcgaugaaagaccucuccuggugaaggggacacuuaucgccauugaccccuuugaugaccggagagaggcuggaggcgaaucuaccgucgugaacccuaaauccgggagcuggaauuucuuugauugguucucuggccugaugagcugguuuggaggcccccucaagacgauccugcuuauuugucuguacgucgcgcucuccaucgggcuguucuuccugcucaucuaucugggacgcacaggccuuagcaaaauguggcuggccgcuaccaagaaggccucu

SEQ ID NO: 14668 - RNA, 1521 nt, Artificial Sequence
  derived and/or modified CDS sequence (opt5) from RVFV(OS-1)__DQ380186.1__Gc
ugcagcgagcugauccaggccuccucuagaauuaccacauguagcacggaaggcgugaacaccaagugccggcucuccgggacagcucugauccgcgccggaucugucggcgcggaggcuugucuuaugcugaaagggguuaaggaagaccaaaccaaauuccucaagauuaaaacagugagcuccgagcugucuugcagagaaggacagagcuacuggaccggcuccuuuagccccaagugucuuucuucccggcgcugccaccuggugggggagugucaugucaauagaugccucagcuggcgggauaacgagacaucugccgaguucuccuuugugggagaaagcaccacgaugcgcgaaaauaaguguuucgagcagugcggcggcuggggguguggaugcuuuaacguuaauccuucuugccuguucgugcacaccuaucugcaguccgucagaaaagaggcccucaagguguuuaacuguaucgacuggguucauaaacugacacuugaaauuaccgauuucgacggcagcguguccacaaucgaucugggggcuucuagcucccgguuuaccaauuggggaagcgucucucucucccuggacgccgagggcaucagcgggucuaacagcuucuccuuuauugaaucuccgggaaagggcuacgcuaucguggaugagcccuucagcgaaauuccucgccaaggcuuucuuggggagaucagaugcaauuccgagagcucugugcuguccgcccacgaaagcugucuccgggcgcccaaccugauuucuuauaaaccuaugaucgaccagcuggagugcacgacaaaucucauugaucccuucgucguuuucgaacgcggaucccugccucagaccagaaacgacaagacauuugccgcuagcaagggcaaucgcggggugcaggccuucuccaaaggaucugugcaagcugaucuuacccugauguuugacaacuucgaggucgauuuugugggcgccgcgguuagcugugacgccgcuuuccucaaucugaccgggugcuacuccuguaacgccggagcucgggugugccuuucuaucacaagcacgggcaccggcacacuguccgcccauaacaaggacgggagccuccacaucguccugccgucugaaaauggaaccaaagaucagugucagauucugcacuuuacagugcccgagguugaggaagaguucauguauuccugcgacggcgaugaaagaccucuccuggugaaggggacccuuaucgccauugaccccuuugaugaccggagagaggcuggaggcgaaagcacggucgugaacccuaaaucuggguccuggaauuucuuugauugguucagcggccugaugucuugguuuggaggcccccucaagacaauccugcuuauuugucuguacgucgcgcucagcaucgggcuguucuuccugcucaucuaucugggacgcaccggccuuuccaaaauguggcuggccgcuaccaagaaggccagc

SEQ ID NO: 14669 - RNA, 1521 nt, Artificial Sequence
  derived and/or modified CDS sequence (opt5) from RVFV(KEN/Gar-004/06)__HM586964.1__Gc
ugcagcgagcugauccaggccuccucuagaauuaccacauguagcacggaaggcgugaacaccaagugccggcucuccgggacagcucugauccgcgccggaucugucggcgcggaggcuugucuuaugcugaaagggguuaaggaagaccaaaccaaauuccucaagauuaaaacagugagcuccgagcugucuugcagagaaggacagagcuacuggaccggcuccuuuagccccaagugucuuucuucccggcgcugccaccuggugggggagugucaugucaauagaugccucagcuggcgggauaacgagacaucugccgaguucuccuuugugggagaaagcaccacgaugcgcgaaaauaaguguuucgagcagugcggcggcuggggguguggaugcuuuaacguuaauccuucuugccuguucgugcacaccuaucugcaguccgucagaaaagaggcccuccggguguuuaacuguaucgacuggguucauaagcugacacuugaaauuaccgauuucgacggcagcguguccacaaucgaucugggggcuucuagcucccgcuuuaccaauuggggaagcgucucucucucccuggacgccgagggcaucagcgggucuaacagcuucuccuuuauugaaucuccgggaaaaggcuacgcuaucguggaugagcccuucagcgaaauuccuagacaaggcuuucuuggggagauccggugcaauuccgagagcucugugcuguccgcccacgaaagcugucuccgcgcgcccaaccuggucucuuauaagccuaugauugaccagcuggagugcacgacaaaucucaucgaucccuucguuguguucgaaagaggaucccugccucagacccggaacgacaaaacauuugccgcuagcaagggcaaucgcggggugcaggccuucuccaagggaucuguccaagcugaucuuacccugagauuugacaacuucgagguggauuuuguuggcgccgcggugagcugugacgccgcuuuccucaaucugaccgggugcuacuccuguaacgccggagcucgggucugccuuucuauuacaagcacgggcaccggcacacuguccgcccauaacaaagacgggagccuccacaucgugcugccgucugaaaauggaaccaaggaucagugucagauccugcacuuuacaguucccgagguggaggaagaguucauguauuccugcgacggcgaugaaagaccucuccuggucaaagggacccuuauugccaucgaccccuuugaugaccgccgggaggcuggaggcgaaagcacgguggucaacccuaagucuggguccuggaauuucuuugauugguucagcggccugaugucuugguuuggaggcccccucaaaacaauucugcuuaucugucuguacguggcgcucagcauugggcuguucuuccugcucaucuaucugggaagaaccggccuuuccaagauguggcuggccgcuaccaaaaaggccagc

SEQ ID NO: 14670 - RNA, 1521 nt, Artificial Sequence
  derived and/or modified CDS sequence (opt5) from RVFV(Smithburn)__DQ380193.1__Gc
ugcagcgagcugauccaggccuccucuagaauuaccacauguagcacggaaggcgugaacaccaagugccggcucuccgggacagcucugauccgcgccggaucugucggcgcggaggcuugucuuaugcugaaagggguuaaggaagaccaaaccaaauuccucaagauuaaaacagugagcuccgagcugucuugcagagaaggacagagcuacuggaccggcuccuuuagccccaagugucuuucuucccggcgcugccaccuggugggggagugucaugucaauagaugccucagcuggcgggauaacgagacaucugccgaguucuccuuugugggagaaagcaccacgaugcgcgaaaauaaguguuucgagcagugcggcggcuggggguguggaugcuuuaacguuaauccuucuugccuguucgugcacaccuaucugcaguccgucagaaaagaggcccuccggguguuuaacuguaucgacuggguucauaagcugacacuugaaauuaccgauuucgacggcagcguguccacagucgaucugggggcuucuagcucccgcuuuaccaauuggggaagcgugucucucucccuggacgccgagggcaucagcgggucuaacagcuucuccuuuaucgaaucuccgggaaaaggcuacgcuauuguggaugagcccuucagcgaaaucccuagacaaggcuuucuuggggagauucggugcaauuccgagagcucuguccuguccgcccacgaaagcugucuccgcgcgcccaaccugaucucuuauaagccuaugauugaccagcuggagugcacgacaaaucucaucgaucccuucguuguguucgaaagaggaucccugccucagacccggaacgacaaaacauuugccgcuagcaagggcaaucgcggggugcaggccuucuccaagggaucuguccaagcugaucuuacccugauguuugacaacuucgagguggauuuuguuggcgccgcggugagcugugacgccgcuuuccucaaucugaccgggugcuacuccuguaacgccggagcuagagucugccuuucuauuacaagcacgggcaccggcacacuguccgcccauaacaaagacgggagccuccacaucgugcugccgucugaaaauggaaccaaggaucagugucagauccugcacuuuacaguucccgagguggaggaagaguucauguauuccugcgacggcgaugaacggccucuccuggucaaagggacccuuauugccaucgaccccuuugaugacagacgcgaggcuggaggcgaaagcacgguggucaacccuaagucuggguccuggaauuucuuugauugguucagcggccugaugucuugguuuggaggcccccucaaaacaauucugcuuaucugucuguacguggcgcucagcauugggcuguucuucuuucugaucuaucucggacggaccggccuguccaagauguggcuugccgcuaccaaaaaggccagc

SEQ ID NO: 14671 - RNA, 1521 nt, Artificial Sequence
  derived and/or modified CDS sequence (opt5) from RVFV(2008/00101)__HE687306.1__Gc
ugcagcgagcugauccaggccuccucuagaauuacaacauguagcacggaaggcgugaacaccaagugccggcucuccgggacagcucugauccgcgccggaucugucggcgcggaggcuugucuuaugcugaaagggguuaaggaagaccaaaccaaauuccucaagauuaaaacagugagcuccgagcugucuugcagagaaggacagagcuacuggaccggcuccuuuagccccaagugucuuucuucccggcgcugccaccuggugggggagugucaugucaauagaugccucagcuggcgggauaacgagacaucugccgaguucuccuuugugggagaaagcaccacgaugcgcgaaaauaaguguuucgagcagugcggcggcuggggguguggaugcuuuaacguuaauccuucuugccuguucgugcacaccuaucugcaguccgucagaaaagaggcccuccggguguuuaacuguaucgacuggguucauaagcugacacuugaaauuaccgauuucgacggcagcguguccacaaucgaucugggggcuucuagcucccgcuuuaccaauuggggaagcgucucucucucccuggacgccgagggcaucagcgggucuaacagcuucuccuuuauugaaucuccgggaaaaggcuacgcuaucguggaugagcccuucagcgaaauuccuagacaaggcuuucuuggggagauccggugcaauuccgagagcucugugcuguccgcccacgaaagcugucuccgcgcgcccaaccuggucucuuauaagccuaugauugaccagcuggagugcacgacaaaucucaucgaucccuucguuguguucgaaagaggaucccugccucagacccggaacgacaaaacauuugccgcuagcaagggcaaucgcggggugcaggccuucuccaagggaucuguccaagcugaucuuacccugauguuugacaacuucgagguggauuuuguuggcgccgcggugagcugugacgccgcuuuccucaaucugaccgggugcuacuccuguaacgccggagcuagagucugccuuucuauuacaagcacgggcaccggcacacuguccgcccauaacaaagacgggagccuccacaucgugcugccgucugaaaauggaaccaaggaucagugucagauccugcacuuuacaguucccgagguggaggaagaguucauguauuccugcgacggcgaugaacggccucuccuggucaaagggacccuuauugccaucgaccccuuugaugacagacgcgaggcuggaggcgaaagcacgguggucaacccuaagucuggguccuggaauuucuuugauugguucagcggccugaugucuugguuuggaggcccccucaaaacaacccugcuuauuugucuguacguggcgcucagcaucgggcuguucuuccugcucauuuaucugggacggaccggccuuuccaagauguggcuggccgcuaccaaaaaggccagc

SEQ ID NO: 14672 - RNA, 1521 nt, Artificial Sequence
  derived and/or modified CDS sequence (opt5) from RVFV(2007001292)__EU574046.1__Gc
ugcagcgagcugauccaggccuccucuagaauuaccacauguagcacggaaggcgugaacaccaagugccggcucuccgggacagcucugauccgcgccggaucugucggcgcggaggcuugucuuaugcugaaagggguuaaggaagaccaaaccaaauuccucaagauuaaaacagugagcuccgagcugucuugcagagaaggacagagcuacuggaccggcuccuuuagccccaagugucuuucuucccggcgcugccaccuggugggggagugucaugucaauagaugccucagcuggcgggauaacgagacaucugccgaguucuccuuugugggagaaagcaccacgaugcgcgaaaauaaguguuucgagcagugcggcggcuggggguguggaugcuuuaacguuaauccuucuugccuguucgugcacaccuaucugcaguccgucagaaaagaggcccuccggguguuuaacuguaucgacuggguucauaagcugacacuugaaauuaccgauuucgacggcagcguguccacaaucgaucugggggcuucuagcucccgcuuuaccaauuggggaagcgucucucucucccuggacgccgagggcaucagcgggucuaacagcuucuccuuuauugaaucuccgggaaaaggcuacgcuaucguggaugagcccuucagcgaaauuccuagacaaggcuuucuuggggagauccggugcaauuccgagagcucugugcuguccgcccacgaaagcugucuccgcgcgcccaaccuggucucuuauaagccuaugauugaccagcuggagugcacgacaaaucucaucgaucccuucguuguguucgaaagaggaucccugccucagacccggaacgacaaaacauuugccgcuagcaagggcaaucgcggggugcaggccuucuccaagggaucuguccaagcugaucuuacccugauguuugacaacuucgagguggauuuuguuggcgccgcggugagcugugacgccgcuuuccucaaucugaccgggugcuacuccuguaacgccggagcuagagucugccuuucuauuacaagcacgggcaccggcacacuguccgcccauaacaaagacgggagccuccacaucgugcugccgucugaaaauggaaccaaggaucagugucagauccugcacuuuacaguucccgagguggaggaagaguucauguauuccugcgacggcgaugaacggccucuccuggucaaagggacccuuauugccaucgaccccuuugaugacagacgcgaggcuggaggcgaaagcacgguggucaacccuaagucuggguccuggaaucuguucgauugguuuagcggccucaugucuugguucggaggcccccugaaaacaauucuucugaucugucucuacguggcgcugagcauugggcuguuuuuccuccugaucuaucuuggacggaccggccuguccaagauguggcucgccgcuaccaaaaaggccagc

SEQ ID NO: 14673 - RNA, 1521 nt, Artificial Sequence
  derived and/or modified CDS sequence (opt5) from RVFV(2007002445)__EU574037.1__Gc
ugcagcgagcugauccaggccuccucuagaauuaccacauguagcacggaaggcgugaacaccaagugccggcucuccgggacagcucugauccgcgccggaucugucggcgcggaggcuugucuuaugcugaaagggguuaaggaagaccaaaccaaauuccucaagauuaaaacagugagcuccgagcugucuugcagagaaggacagagcuacuggaccggcuccuuuagccccaagugucuuucuucccggcgcugccaccuggugggggagugucaugucaauagaugccucagcuggcgggauaacgagacaucugccgaguucuccuuugugggagaaagcaccacgaugcgcgaaaauaaguguuucgagcagugcggcggcuggggguguggaugcuuuaacguuaauccuucuugccuguucgugcacaccuaucugcaguccgucagaaaagaggcccuccggguguuuaacuguaucgacuggguucauaagcugacacuugaaauuaccgauuucgacggcagcguguccacaaucgaucugggggcuucuagcucccgcuuuaccaauuggggaagcgucucucucucccuggacgccgagggcaucagcgggucuaacagcuucuccuuuauugaaucuccgggaaaaggcuacgcuaucguggaugagcccuucagcgaaauuccuagacaaggcuuucuuggggagauccggugcaauuccgagagcucugugcuguccgcccacgaaagcugucuccgcgcgcccaaccuggucucuuauaagccuaugauugaccagcuggagugcacgacaaaucucaucgaucccuucguuguguucgaaagaggaucccugccucagacccggaacgagaaaacauuugccgcuagcaagggcaaucgcggggugcaggccuucuccaagggaucuauucaagcugaccuuacccugauguuugauaacuucgaagucgacuuugugggcgccgcgguuagcugugaugccgcuuuccucaaucugaccgggugcuacuccuguaacgccggagcuagagugugccuuucuaucacaagcacgggcaccggcacacuguccgcccauaacaaagacgggagccuccacaucguccugccgucugagaauggaaccaaggaccagugucagauucugcacuuuacagugcccgagguugaagaggaguucauguauuccugcgauggcgacgaacggccucuccuggugaaagggacccuuaucgccauugaucccuuugacgauagacgcgaagcuggaggcgagagcacggucgugaacccuaagucuggguccuggaauuucuuugacugguucagcggccugaugucuugguuuggaggcccccucaaaacaauccugcuuauuugucuguacgucgcgcucagcaucgggcuguucuuccugcucaucuaucugggacggaccggccuuuccaagauguggcuggccgcuaccaaaaaggccagc

SEQ ID NO: 14674 - RNA, 1521 nt, Artificial Sequence
  derived and/or modified CDS sequence (opt5) from RVFV(Ken 199800523)__KU978777.1__Gc
ugcagcgagcugauccaggccuccucuagaauuaccacauguagcacggaaggcgugaacaccaagugccggcucuccgggacagcucugauccgcgccggaucugucggcgcggaggcuugucuuaugcugaaagggguuaaggaagaccaaaccaaauuccucaagauuaaaacagugagcuccgagcugucuugcagagaaggacagagcuacuggaccggcuccuuuagccccaagugucuuucuucccggcgcugccaccuggugggggagugucaugucaauagaugccucagcuggcgggauaacgagacaucugccgaguucuccuuugugggagaaagcaccacgaugcgcgaaaauaaguguuucgagcagugcggcggcuggggguguggaugcuuuaacguuaauccuucuugccuguucgugcacaccuaucugcaguccgucagaaaagaggcccuccggguguuuaacuguaucgacuggguucauaagcugacacuugaaauuaccgauuucgacggcagcguguccacaaucgaucugggggcuucuagcucccgcuuuaccaauuggggaagcgucucucucucccuggacgccgagggcaucagcgggucuaacagcuucuccuuuauugaaucuccgggaaaaggcuacgcuaucguggaugagcccuucagcgaaauuccuagacaaggcuuucuuggggagauccggugcaauuccgagagcucugugcugaacgcccacgaauccugucuccgcgcgcccaaucugauuagcuauaagccuaugaucgaccagcuggagugcacgacaaaccucauugaucccuucgucguuuucgaaagaggaucucugccucagacccggaaugacaaaacauuugccgcuuccaagggcaaccgcggggugcaggccuucagcaagggauccgugcaagcugaucuuacccugauguuugacaauuucgaggucgauuuugugggcgccgcgguuucuugugacgccgcuuuccucaaccugaccgggugcuacagcuguaacgccggagcuagagugugccuuuccaucacaucuacgggcaccggcacacugagcgcccauaauaaagaagggucccuccacaucguccugccgagcgagaacggaaccaaggaccagugucagauucugcacuuuacagugcccgagguugaagaggaguucauguauucuugcgauggcgacgaacggccucuccuggugaaagggacccuuaucgccauugaucccuuugacgauagacgcgaagcuggaggcgaguccacggucgugaauccuaagagcgggucuuggaacuucuuugacugguucuccggccugaugagcugguuuggaggcccccucaaaacaauccugcuuauuugucuguacgucgcgcucucuaucgggcuguucuuccugcucaucuaucugggacggaccggccuuagcaagauguggcuggccgcuaccaaaaaggccucc

SEQ ID NO: 14675 - RNA, 1521 nt, Artificial Sequence
  derived and/or modified CDS sequence (opt5) from RVFV(clone 13)__DQ380213.1__Gc
ugcagcgagcugauccaggccuccucuagaauuaccacauguagcacggaaggcgugaacaccaagugccggcucuccgggacagcucugauccgcgccggaucugucggcgcggaggcuugucuuaugcugaaagggguuaaggacgaucaaaccaaauuccucaagauuaaaacagugagcuccgaacugucuugcagagagggacagagcuacuggaccggcuccuuuagccccaagugucuuucuucccggcgcugccaccuggugggggaaugucaugucaauagaugccucagcuggcgggacaacgagacaucugccgaguucuccuuugugggagaaagcaccacgaugcgcgagaauaaguguuucgaacagugcggcggcuggggguguggaugcuuuaacguuaauccuucuugccuguucgugcacaccuaucugcaguccgucagaaaagaggcccuccggguguuuaacuguaucgauuggguucauaagcugacacuugagauuaccgacuucgauggcagcguguccacaaucgaccugggggcuucuagcucccgcuuuaccaauuggggaagcgucucucucucccuggaugccgaaggcaucagcgggucuaacagcuucuccuuuauugagucuccgggaaaaggcuacgcuaucguggacgaacccuucagcgagauuccuagacaaggcuuucuuggggaaauccggugcaauuccgagagcucugugcuguccgcccacgagagcugucuccgcgcgcccaaccugauuucuuauaagccuaugaucgaucagcuggaaugcacgacaaaucucauugaccccuucgucguuuucgagagaggaucccugccucagacccggaacgagaaaacauuugccgcuagcaagggcaaucgcggggugcaggccuucuccaagggaucugugcaagcugaucuuacccugauguuugacaacuucgaagucgauuuugugggcgccgcgguuagcugugacgccgcuuuccucaaucugaccgggugcuacuccuguaacgccggagcuagagugugccuuucuaucacaagcacgggcaccggcacacuguccgcccauaacaaagacgggagccuccacaucguccugccgucugaaaauggaaccaaggaucagugucagauucugcacuuuacagugcccgagguugaggaagaguucauguauuccugcgacggcgaugaacggccucuccuggugaaagggacccuuaucgccauugaccccuuugaugacagacgcgaggcuggaggcgaaagcacggucgugaacccuaagucuggguccuggaauuucuuugauugguucagcggccugaugucuugguuuggaggcccccucaaaacaauccugcuuauuugucuguacgucgcgcucagcaucgggcuguucuuccugcucaucuaucugggacggaccggccuuuccaagauguggcuggccgcuaccaaaaaggccagc

SEQ ID NO: 14676 - RNA, 1521 nt, Artificial Sequence
  derived and/or modified CDS sequence (opt5) from RVFV(2373/74)__DQ380194.1__Gc
ugcagcgagcugauccaggccuccucuagaauuaccacauguagcacggaaggcgugaacaccaagugccggcucuccgggacagcucugauccgcgccggaucugucggcgcggaggcuugucuuaugcugaaagggguuaaggaagaccaaaccaaauuccucaagauuaaaacagugagcuccgagcugucuugcagagaaggacagagcuacuggaccggcuccuuuagccccaagugucuuucuucccggcgcugccaccuggugggggagugucaugucaauagaugccucagcuggcgggauaacgagacaucugccgaguucuccuuugugggagaaagcaccacgaugcgcgaaaauaaguguuucgagcagugcggcggcuggggguguggaugcuuuaacguuaauccuucuugccuguucgugcacaccuaucugcaguccgucagaaaagaggcccuccggguguuuaacuguaucgacuggguucauaagcugacacuugaaauuaccgauuucgacggcagcguguccacacuggaucucggggcuucuagcucccgcuuuaccaauuggggaagcgucucucugucccuugacgccgagggcaucagcgggucuaacagcuucuccuuuaucgaaucuccgggaaaaggcuacgcuauuguggaugagcccuucagcgaaaucccuagacaaggcuuucugggggagauucggugcaauuccgagagcucugugcucuccgcccacgaaagcugucugcgcgcgcccaaccugaucucuuauaagccuaugauugaccagcucgagugcacgacaaaucugaucgaucccuucgucguuuucgaaagaggaucccuuccucagacccggaacgagaaaacauuugccgcuagcaagggcaaucgcggggugcaggccuucuccaagggaucugugcaagcugaccugacccucauguuugauaacuucgaagucgacuuugugggcgccgcgguuagcugugaugccgcuuuccugaaucuuaccgggugcuacuccuguaacgccggagcuagagugugccugucuauuacaagcacgggcaccggcacacucuccgcccauaacaaagacgggagccugcacaucguccugccgucugagaauggaaccaaggaccagugucagauccuccacuuuacagugcccgagguugaagaggaguucauguauuccugcgauggcgacgaacggccucugcuugugaaagggacccugauugccaucgaucccuuugacgauagacgcgaagcuggaggcgagagcacggucgugaacccuaagucuggguccuggaauuucuuugacugguucagcggccucaugucuugguuuggaggcccccugaaaacaauucuucugaucugucucuacgucgcgcugagcauugggcuguucuuccuccugaucuaucuuggacggaccggccuguccaagauguggcucgccgcuaccaaaaaggccagc

SEQ ID NO: 14677 - RNA, 1521 nt, Artificial Sequence
  derived and/or modified CDS sequence (opt5) from RVFV(OS-8)__DQ380185.1__Gc
ugcagcgagcugauccaggccuccucuagaauuaccacauguagcacggaaggcgugaacaccaagugccggcucuccgggacagcucugauccgcgccggaucugucggcgcggaggcuugucuuaugcugaaagggguuaaggaagaccaaaccaaauuccucagaauuaagacagugagcuccgagcugucuugccgggaaggacagagcuacuggaccggcuccuuuagccccaaaugucuuucuucccgcagaugccaccuggugggggagugucaugucaaucggugccucagcuggcgcgauaacgagacaucugccgaguucuccuuugugggagaaagcaccacgaugagagaaaauaaguguuucgagcagugcggcggcuggggguguggaugcuuuaacguuaauccuucuugccuguucgugcacaccuaucugcaguccguccggaaggaggcccuccgcguguuuaacuguaucgacuggguucauaaacugacacuugaaauuaccgauuucgacggcagcguguccacaaucgaucugggggcuucuagcuccagauuuaccaauuggggaagcgucucucucucccuggacgccgagggcaucagcgggucuaacagcuucuccuuuauugaaucuccgggaaagggcuacgcuaucguggaugagcccuucagcgaaauuccucggcaaggcuuucuuggggagauccgcugcaauuccgagagcucugugcuguccgcccacgaaagcugucucagagcgcccaaccugauuucuuauaaaccuaugaucgaccagcuggagugcacgacaaaucucauugaucccuucgucguuuucgaacggggaucccugccucagacccgcaacgacaagacauuugccgcuagcaaaggcaauagaggggugcaggccuucuccaagggaucugugcaagcugaucuuacccugauguuugacaacuucgaggucgauuuugugggcgccgcgguuagcugugacgccgcuuuccucaaucuguccgggugcuacucuuguaacgccggagcucgggugugccuuagcaucaccuccacaggcacgggcacccugagcgcccauaacaaggacgggucucuccacaucguccugccguccgaaaauggaacaaaagaucagugucagauucugcacuuuaccgugcccgagguugaggaagaguucauguauagcugcgacggcgaugaaagaccucuccuggugaaggggacacuuaucgccauugaccccuuugaugaccgccgggaggcuggaggcgaaucuaccgucgugaacccuaaauccgggagcuggaauuucuuugauugguucucuggccugaugagcugguuuggaggcccccucaagacgauccugcuuauuugucuguacgucgcgcucuccaucgggcuguucuuccugcucaucuaucugggaagaacaggccuuagcaaaauguggcuggccgcuaccaagaaagccucu

SEQ ID NO: 14678 - RNA, 1521 nt, Artificial Sequence
  derived and/or modified CDS sequence (opt5) from RVFV(KEN/Bar-035/07)__HM586969.1__Gc
ugcagcgagcugauccaggccuccucuagaauuaccacauguagcacggaaggcgugaacaccaagugccggcucuccgggacagcucugauccgcgccagaucugucggagcggaggcuugucuuaugcugaaaggcguuaaggaagaccaaaccaaauuccucaagauuaaaacagugagcuccgagcugucuugccgggaagggcagagcuacuggaccggauccuuuagccccaagugucuuucuucccgcagaugccaccuggugggcgagugucaugucaaucggugccucagcuggcgcgauaacgagacaucugccgaguucuccuuugugggggaaagcaccacgaugagagaaaauaaguguuucgagcagugcggaggcuggggcugugggugcuuuaacguuaauccuucuugccuguucgugcacaccuaucugcaguccguccggaaagaggcccuccgcguguuuaacuguaucgacuggguucauaagcugacacuugaaauuaccgauuucgacggaagcguguccacaaucgaucugggcgcuucuagcuccagauuuaccaauugggggagcgucucucucucccuggacgccgagggaaucagcggcucuaacagcuucuccuuuauugaaucuccggggaaaggauacgcuaucguggaugagcccuucagcgaaauuccucggcaaggcuuucuuggcgagauccgcugcaauuccgagagcucugugcuguccgcccacgaaagcugucucagagcgcccaaccuggucucuuauaagccuaugauugaccagcuggagugcacgacaaaucucaucgaucccuucguuguguucgaacgggggucccugccucagacccgcaacgacaaaacauuugccgcuagcaagggaaauagaggcgugcaggccuucuccaaggggucuguccaagcugaucuuacccugauguuugacaacuucgagguggauuuuguuggagccgcggugagcugugacgccgcuuuccucaaucugaccggcugcuacuccuguaacgccggggcucgggucugccuuucuauuacaagcacgggaaccggcacacuguccgcccauaacaaagacggcagccuccacaucgugcugccgucugaaaaugggaccaaggaucagugucagauccugcacuuuacaguucccgagguggaggaagaguucauguauuccugcgacggagaugaaagaccucuccuggucaaaggcacccuuauugccaucgaccccuuugaugaccgccgggaggcugggggagaaagcacgguggucaacccuaagucuggcuccuggaauuucuuugauugguucagcgggcugaugucuugguuuggcggaccccucaaaacaauucugcuuaucugucuguacguggcgcucagcauuggccuguucuuccugcucaucuaucuggggagaaccggacuuuccaagauguggcuggccgcuaccaaaaaggccagc

SEQ ID NO: 14679 - RNA, 1521 nt, Artificial Sequence
  derived and/or modified CDS sequence (opt5) from RVFV(MgH824)__DQ380210.1__Gc
ugcagcgagcugauccaggccuccucuagaauuaccacauguagcacggaaggcguggacaccaagugccggcucuccgggacagcucugauccgcgccggaucugucggcgcggaggcuugucuuaugcugaaagggguuaaggaagaucaaaccaaauuccucaagauuaaaacagugagcuccgagcugucuugcagagaaggacagagcuacuggaccggcuccuuuagccccaagugucuuucuucccggcgcugccaccuggugggggagugucaugucaacagaugccucagcuggcgggacaaugagacaucugccgaguucuccuuugugggagaaagcaccacgaugcgcgaaaacaaguguuucgagcagugcggcggcuggggguguggaugcuuuaauguuaacccuucuugccuguucgugcacaccuaucugcaguccgucagaaaagaggcccuccggguguuuaauuguaucgauuggguucauaagcugacacuugaaauuaccgacuucgauggcagcguguccacaaucgaccugggggcuucuagcucccgcuuuaccaacuggggaagcgucucucucucccuggaugccgagggcaucagcgggucuaauagcuucuccuuuauugaaucuccgggaaaaggcuacgcuaucguggacgagcccuucccugaaauucccagacaaggcuuucuuggggagauccggugcaacagcgaguccagcgugcugucugcccacgaauccugucuccgcgcgccuaaucugauuagcuauaagcccaugaucgaucagcuggagugcacgacaaaccucauugacccuuucgucguuuucgaaagaggaucucugccgcagacccggaaugauaaaacauuugccgcuuccaagggcaaccgcggggugcaggccuucagcaagggauccgugcaagcugaccuuacccugauguuugauaauuucgaggucgacuuugugggcgccgcgguuucuugugacgccgcuuuccucaaccugaccgggugcuacagcuguaaugccggagcuagagugugccuuuccaucacaucuacgggcaccggcagccuguccgcccauaacaaagaugggagccuccacaucguccugcccucugaaaacggaacaaaggaccagugucagauucugcacuuuaccgugccugagguugaggaagaguucauguauuccugcgauggcgacgaacggccccuccuggugaaagggacacuuaucgccauugauccuuuugacgauagacgcgaggcuggaggcgaaagcaccgucgugaaucccaagucuggguccuggaacuucuuugacugguucagcggccugaugucuugguuuggaggcccgcucaaaacgauccugcuuauuugucuguacgucgcgcucagcaucgggcuguucuuccugcucaucuaucugggacggacaggccuuuccaagauguggcuggccgcuaccaaaaaggccagc

SEQ ID NO: 14680 - RNA, 1521 nt, Artificial Sequence
  derived and/or modified CDS sequence (opt5) from RVFV(200803169)__JF311384.1__Gc
ugcagcgagcugauccaggccuccucuagaauuaccacauguagcacggaaggcgugaacaccaagugccggcucuccgggacagcucugauccgcgccggaucugucggcgcggaggcuugucuuaugcugaaagggguuaagguggaccaaaccaaauuccucaagauuaaaacagugagcuccgaacugucuugcagagagggacagagcuacuggaccggcuccuuuagccccaagugucuuucuucccggcgcugccaccuggucggggaaugucaugugaauagaugccucagcuggcgggauaacgagacaucugccgaguucuccuuuguuggagaaagcaccacgaugcgcgagaauaaguguuucgaacagugcggcggcuggggguguggaugcuuuaacgugaauccuucuugccuguucguccacaccuaucugcaguccgugagaaaagaggcccuccggguuuuuaacuguaucgacugggugcauaagcugacacuugagauuaccgauuucgacggcagcgucuccacaaucgaucugggggcuucuagcucccgcuuuaccaauuggggaagcgugucucucucccuggacgccgaaggcaucagcgggucuaacagcuucuccuuuauugagucuccgggaaaaggcuacgcuaucguggaugaacccuucagcgagauuccuagacaaggcuuucuuggggaaguccggugcaauuccgagagcucuguucuguccgcccacgagagcugucuccgcgcgcccaaccuggugucuuauaagccuaugaucgaccagcuggaaugcacgacaaaucucauugaucccuucguggucuucgagagaggaucccugccucagacccggaacgacaaaacauuugccgcuagcaagggcaaucgcggggugcaggccuucuccaagggaucuguucaagcugaucuuacccugauguuugacaacuucgaaguggauuuugucggcgccgcggugagcugugacgccgcuuuccucaaucugaccgggugcuacuccuguaacgccggagcuagaguuugccuuucuaucacaagcacgggcaccggcacacuguccgcccauaacaaagacgggagccuccacauugugcugccgucugagaauggaaccaaggaucagugucagauccugcacuuuacaguccccgaaguggaggaggaguucauguauuccugcgacggcgaugaacggccucuccuggucaaagggacccuuaucgccauugaccccuuugaugacagacgcgaagcuggaggcgagagcacggugguuaacccuaagucuggguccuggaauuucuuugauugguucagcggccugaugucuugguuuggaggcccccucaaaacaauccugcuuauuugucuguacguggcgcucagcaucgggcuguucuuccugcucauuuaucugggacggaccggccuuuccaagauguggcuggccgcuaccaaaaaggccagc

SEQ ID NO: 14681 - RNA, 1521 nt, Artificial Sequence
  derived and/or modified CDS sequence (opt5) from RVFV(2007001811)__EU574040.1__Gc
ugcagcgagcugauccaggccuccucuagaauuaccacauguagcacggaaggcgugaacaccaagugccggcucuccgggacagcucugauccgcgccggaucugucggcgcggaggcuugucuuaugcugaaagggguuaaggaagaccaaaccaaauuccucaugauuaagacagugagcuccgagcugucuugcagagaaggacagagcuacuggaccggcuccuuuagccccaaaugucuuucuucccggcgcugccaccuggugggggagugucaugucaauagaugccucagcuggcgggauaacgagacaucugccgaguucuccuuugugggagaaagcaccacgaugcgcgaaaauaaguguuucgagcagugcggcggcuggggguguggaugcuuuaacguuaauccuucuugccuguucgugcacaccuaucugcaguccgucagaaaggaggcccuccggguguuuaacuguaucgacuggguucauaaacugacacuugaaauuaccgauuucgacggcagcguguccacaaucgaucugggggcuucuagcucccgcuuuaccaauuggggaagcgucucucucucccuggacgccgagggcaucagcgggucuaacagcuucuccuuuauugaaucuccgggaaagggcuacgcuaucguggaugagcccuucagcgaaauuccuagacaaggcuuucuuggggagauccggugcaauuccgagagcucugugcuguccgcccacgaaagcugucuccgcgcgcccaaccugauuucuuauaaaccuaugaucgaccagcuggagugcacgacaaaucucauugaucccuucgucguuuucgaaagaggaucccugccucagacccggaacgagaagacauuugccgcuagcaaaggcaaucgcggggugcaggccuucuccaagggaucugugcaagcugaccuuacccugauguuugauaacuucgaagucgacuuugugggcgccgcgguuagcugugaugccgcuuuccucaaucugaccgggugcuacuccuguaacgccggagcuagagugugccuuucuaucacaagcacgggcaccggcacacuguccgcccauaacaaggacgggagccuccacaucguccugccgucugagaauggaaccaaagaccagugucagauucugcacuuuacagugcccgagguugaagaggaguucauguauuccugcgauggcgacgaacggccucuccuggugaaggggacccuuaucgccauugaucccuuugacgauagacgcgaagcuggaggcgagagcacggucgugaacccuaaaucuggguccuggaauuucuuugacugguucagcggccugaugucuugguuuggaggcccccucaagacaauccugcuuauuugucuguacgucgcgcucagcaucgggcuguucuuccugcucaucuaucugggacggaccggccuuuccaaaauguggcuggccgcuaccaagaaagccagc

SEQ ID NO: 14682 - RNA, 1521 nt, Artificial Sequence
  derived and/or modified CDS sequence (opt5) from RVFV(Kenya 57 (Rintoul))__DQ380192.1__Gc
ugcagcgagcugauccaggccuccucuagaauuaccacauguagcacggaaggcgugaacaccaagugccggcucuccgggacagcucugauccgcgccggaucugucggcgcggaggcuugucuuaugcugaaagggguuaaggaagaccaaaccaaauuccucaagauuaaaacagugagcuccgagcugucuugcagagaaggacagagcuacuggaccggcuccuuuagccccaagugucuuucuucccggcgcugccaccuggugggggagugucaugucaauagaugccucagcuggcgggauaacgagacaucugccgaguucuccuuugugggagaaagcaccacgaugcgcgaaaauaaguguuucgagcagugcggcggcuggggguguggaugcuuuaacguuaauccuucuugccuguucgugcacaccuaucugcaguccgucagaaaagaggcccuccggguguuuaacuguaucgacuggguucauaagcugacacuugaaauuaccgauuucgacggcagcguguccacagucgaucugggggcuucuagcucccgcuuuaccaauuggggaagcgugucucucucccuggacgccgagggcaucagcgggucuaacagcuucuccuuuaucgaaucuccgggaaaaggcuacgcuauuguggaugagcccuucagcgaaaucuccagacaaggcuuucuuggggagauucggugcaauagcgagucuuccguccugagcgcccacgaaucuugucuccgcgcgccuaaccugaucuccuauaagcccaugauugaccagcuggagugcacgacaaaucucaucgauccuuucguuguguucgaaagaggaagccugccccagacccggaacgacaaaacauuugccgcuuccaagggcaaucgcggggugcaggccuucucuaagggaagcguccaagcugaucuuacccugauguuugacaacuucgagguggauuuuguuggcgccgcgguguccugugacgccgcuuuccucaaucugaccgggugcuacucuuguaacgccggagcuagagucugccuuagcauuacauccacgggcaccggcacacugagcgcccauaacaaagacgggucucuccacaucgugcugccuuccgaaaauggaaccaaggaucagugucagauccugcacuuuacaguuccggagguggaggaagaguucauguauagcugcgacggcgaugaacggccccuccuggucaaagggacccuuauugccaucgacccuuuugaugacagacgcgaggcuggaggcgaaucuacgguggucaaccccaaguccgggagcuggaauuucuuugauugguucucuggccugaugagcugguuuggaggcccucucaaaacaauucugcuuaucugucuguacguggcgcucuccauugggcuguucuuccugcucaucuaucugggacggaccggccuuagcaagauguggcuggccgcuaccaaaaaggccucu

SEQ ID NO: 14683 - RNA, 1521 nt, Artificial Sequence
  derived and/or modified CDS sequence (opt5) from RVFV(Beijing-01)__KX611606.1__Gc
ugcagcgagcugauccaggccuccucuagaauuaccacauguagcacggaaggcgugaauaccaagugccggcucuccgggacagcucugauccgcgccggaucugucggcgcggaggcuugucuuauguucgaagggguuaaagaggaccaaaccaaguuucugaaaauuaagacagugagcuccgaacucucuugcagagagggacagagcuacuggaccggcuccuucagccccaaaugucugucuucccggcgcugccaccuugugggggagugucaugucaauagaugccugagcuggcgggauaacgaaacaucugccgaguuuuccuucgugggagaaagcaccacgaugcgcgagaauaaguguuuugagcagugcggcggcuggggguguggaugcuucaacguuaauccuucuugccucuuugugcacaccuaucugcaguccgucagaaaggaagcccugcggguguucaacuguaucgacuggguucauaaacucacacuggagauuaccgauuuugacggcagcguguccacaaucgaucuuggggcuucuagcucccgcuucaccaauuggggaagcgucucucugucccucgacgccgaaggcaucagcgggucuaacagcuuuuccuucauugagucuccgggaaagggcuacgcuaucguggaugaacccuuuagcgagauuccuagacaaggcuuccugggggagauccggugcaauuccgaaagcucugugcuuuccgcccacgagagcugucugcgcgcgcccaaccucauuucuuauaaaccuaugaucgaccagcuggaaugcacgacaaaucugauugaucccuucgucguuuuugagagaggaucccucccucagacccggaacgacaagacauucgccgcuagcaaaggcaaucgcggggugcaggccuuuuccaagggaucugugcaagcugaucugacccuuauguucgacaacuuugaagucgauuucgugggcgccgcgguuagcugugacgccgcuuuucugaaucucaccgggugcuacuccuguaacgccggagcuagagugugccugucuaucacaagcacgggcaccggcacacuuuccgcccauaacaaggacgggagccugcacaucguccucccgucugagaauggaaccaaagaucagugucagauucugcacuucacagugcccgagguugaagaggaauuuauguauuccugcgacggcgaugagcggccucugcucgugaaggggacccugaucgccauugaccccuucgaugacagacgcgaagcuggaggcgagagcacggucgugaacccuaaaucuggguccuggaacuuuuucgauugguuuagcggccuuaugucuugguucggaggcccccugaagacaauccuccugauuugucuuuacgucgcgcugagcaucggacucuucuuucugcugaucuaucucgggcggaccggccuguccaaaauguggcuugccgcuaccaagaaagccagc

SEQ ID NO: 14684 - RNA, 1521 nt, Artificial Sequence
  derived and/or modified CDS sequence (opt5) from RVFV(ANK-6087)__DQ380216.1__Gc
ugcagcgagcugauccaggccuccucuagaauuaccacauguagcacggaaggcgugaacaccaagugccggcucuccgggacagcucugauccgcgccggaucugucggcgcggaggcuugucuuaugcugaaagggguuaaggaagaccaaaccaaauuccucaagauuaaaacagugagcuccgagcugucuugcagagaaggacagagcuacuggaccggcuccuuuagccccaagugucuuucuucccggcgcugccaccuggugggggagugucaugucaauagaugccucagcuggcgggauaacgagacaucugccgaguucuccuuugugggagaaagcaccacgaugcgcgaaaauaaguguuucgagcagugcggcggcuggggguguggaugcuuuaacguuaauccuucuugccuguucgugcacaccuaucugcaguccgucagaaaagaggcccuccggguguuuaacuguaucgacuggguucauaagcugacacuugaaauuaccgauuucgacggcagcguguccacaaucgaucugggggcuucuagcucccgcuuuaccaauuggggaagcgucucucucucccuggacgccgagggcaucagcgggucuaacagcuucuccuuuauugaaucuccgggaaaaggcuacgcuaucguggaugagcccuucagcgaaauuccuagacaaggcuuucuuggggagauccggugcaauuccgagagcucugugcuguccgcccacgaaagcugucuccgcgcgcccaaccugauuucuuauaagccuaugaucgaccagcuggagugcuccacgaaucucauugaucccuucgucguuuucaaaagaggaagccugccucagacacggaacgacaagaccuuugccgcuuccaagggcaaucgcggggugcaggccuucucuaaaggaagcgugcaagcugaucuuacacugauguuugacaacuucgaagucgauuuugugggcgccgcgguuuccugugacgccgcuuuccucaaucugaccgggugcuacucuuguaacgccggagcuagagugugccuuagcaucaccuccacaggcacgggcacccugagcgcccauaacaaggacgggucucuccacaucguccugccguccgagaauggaacaaaagaucagugucagauucugcacuuuaccgugcccgaaguugaggaggaguucauguauagcugcgacggcgaugaacggccucuccuggugagagggacacuuaucgccauugaccccuuugaugaccgccgggaagcuggaggcgagucuaccgucgugaacccuaaguccgggagcuggaauuucuuugauugguucucuggccugaugagcugguuuggaggcccccucaaaacgauccugcuuauuugucuguacgucgcgcucuccaucgggcuguucuuccugcucaucuaucugggaagaacaggccuuagcaagauguggcuggccgcuaccaaaaaggccucu

SEQ ID NO: 14685 - RNA, 1521 nt, Artificial Sequence
  derived and/or modified CDS sequence (opt5) from RVFV(MP12)__Z30318.1__Gc
ugcagcgagcugauccaggccuccucuagaauuaccacauguagcacggaaggcgugaacaccaagugccggcucuccgggacagcucugauccgcgccggaucugucggcgcggaggcuugucuuaugcugaaagggguuaaggaagaccaaaccaaauuccucaagcugaaaacagugagcuccgagcuuucuugcagagaaggacagagcuacuggaccggcuccuuuagccccaagugucugucuucccggcgcugccaccucgugggggagugucaugucaauagaugccugagcuggcgggauaacgagacaucugccgaguucuccuuugugggagaaagcaccacgaugcgcgaaaauaaguguuucgagcagugcggcggcuggggguguggaugcuuuaacguuaauccuucuugccuguucgugcacaccuaucuccaguccgucagaaaagaggcccugcggguguuuaacuguauugacuggguucauaaacuuacacuggaaaucaccgauuucgacggcagcguguccacaauugaucucggggcuucuagcucccgcuuuaccaauuggggaagcgucucucugucccuugacgccgagggcaucagcgggucuaacagcuucuccuuuaucgaaucuccgggaaagggcuacgcuauuguggaugagcccuucagcgaaaucccuagacaaggcuuucugggggagauucggugcaauuccgagagcucugugcucuccgcccacgaaagcugucugcgcgcgcccaaccugaucucuuauaagccuaugauugaccagcucgagugcacgacaaaucugaucgaucccuucgucguuuucgaaagaggaucccuuccucagacccggaacgacaaaacauuugccgcuagcaagggcaaucgcggggugcaggccuucuccaagggaucugugcaagcugaucugacccucauguuugacaacuucgaggucgauuuugugggcgccgcgguuagcugugacgccgcuuuccugaaucuuaccgggugcuacuccuguaacgccggagcuagagugugccugucuauuacaagcacgggcaccggcucccucagcgcccauaacaaagacgggucucugcacaucguccugccguccgaaaauggaacaaaggaucagugucagauccuccacuuuaccgugcccgagguugaggaagaguucauguauagcugcgacggcgaugaacggccucugcuugugaaagggacacugauugccaucgaccccuuugaugacagacgcgaggcuggaggcgaaucuaccgucgugaacccuaaguccgggagcuggaauuucuuugauugguucucuggccucaugagcugguuuggaggcccccugaaaacgauucuucugaucugucucuacgucgcgcuguccauugggcuguucuuccuccugaucuaucuuggaggcacagggcugagcaagauguggcucgccgcuaccaaaaaggccucu

SEQ ID NO: 14686 - RNA, 1521 nt, Artificial Sequence
  derived and/or modified CDS sequence (opt5) from RVFV(KEN/Bar-032/07)__HM586968.1__Gc
ugcagcgagcugauccaggccuccucuagaauuaccacauguagcacggaaggcgugaacaccaagugccggcucucccacacagcucugauccgcgccgggucugucggagcggaggcuugucuuaugcugaaaggcguuaaggaagaccaaaccaaauuccucaagauuaaaacagugagcuccgagcugucuugcagagaagggcagagcuacuggaccggauccuuuagccccaagugucuuucuucccggcgcugccaucuggugggcgagugucacgucaauagaugccucagcuggcgggauaacgagacaucugccgaguucuccuuugugggggaaagcaccacgaugcgcgaaaauaaguguuucgagcagugcggaggcuggggcugugggugcuuuaacguuaauccuucuugccuguucgugcauaccuaucugcaguccgucagaaaagaggcccuccggguguuuaacuguaucgacuggguucacaagcugacacuugaaauuaccgauuucgacggaagcguguccacaaucgaucugggcgcuucuagcucccgcuuuaccaauugggggagcgucucucucucccuggacgccgagggaaucagcggcucuaacagcuucuccuuuauugaaucuccggggaaaggauacgcuaucguggaugagcccuucagcgaaauuccuagacaaggcuuucuuggcgagauccggugcaauuccgagagcucugugcuguccgcccaugaaagcugucuccgcgcgcccaaccuggucucuuauaagccuaugauugaccagcuggagugcacgacaaaucucaucgaucccuucguuguguucgaaagagggucccugccucagacccggaacgacaaaacauuugccgcuagcaagggaaaucgcggcgugcaggccuucuccaaggggucuguccaagcugaucuuacccugagauuugacaacuucgagguggauuuuguuggagccgcggugagcugugacgccgcuuuccucaaucugaccggcugcuacuccuguaacgccggggcucgggucugccuuucuauuacaagcacgggaaccggcacacuguccgcccacaacaaagacggcagccuccacaucgugcugccgucugaaaaugggaccaaggaucagugucagauccugcauuuuacaguucccgagguggaggaagaguucauguauuccugcgacggagaugaaagaccucuccuggucaaaggcacccuuauugccaucgaccccuuugaugaccgccgggaggcugggggagaaagcacgguggucaacccuaagucuggcuccuggaauuucuuugauugguucagcgggcugaugucuugguuuggcggaccccucaaaacaauucugcuuaucugucuguacguggcgcucagcauuggccuguucuuccugcucaucuaucuggggagaaccggacuuuccaagauguggcuggccgcuaccaaaaaggccagc

SEQ ID NO: 14687 - RNA, 4020 nt, Artificial Sequence
  derived and/or modified CDS sequence (opt5) from SFNV(Toscana)__NC_006320.1__GP
auguucaucgccaagcugcuccugauuagcugccuugugcagcaggcuuaccugaaauauaccaucauuuccgagaucggcaacgggacaagaacgucuuuuuguuacagcucccggaccucucucggaagccugcuugaagccugggacaauauuacagaguccaucggccugaccucugggacaugcaaggucggaagccucgaaaaccgcgauuguaaaagagacaucauguccaauuauguugcggaggugcacagcaaccugcauggccugggggcuaugaugcacaauuacggagaugacaagcggguggaaguccucaacgaugugauucccgacgagcugaauccuggccgccauaacugcucugaucuugacagaaaaccguucuggaccgaguuuaucaauguugccaagcccgccaacaagauugcuccuaucuccgugauucccccucccaucgucaaaccuauuccgaucgccgaaagcacaaucaagaaaaccauucccuucgauaagcugcucucugaggcugaaaaagagcugaaucaaacgaagauccggcuugagaccgaacgcagauccaacgccgaggaagcggcccgggagcgcgcuagaaugcgggaaauugaggacaagcugcgcaaaaauugggagcucgaaagagagcggaaggaugccguggcugacgaucuggccaaagaaaucgcgcgcagacgggagauugaaagaaaggcccacgagcuggacaaaaugcucaagaaaaaggagcgcgaagaccagguugcuaucgagcgggugagcgaagauaugagaaaccauguccgccggccuaauacaaccaucgcccccgcuccuacaauuaucaccacgcugcuuauggccucugccgugauggcuggcccccuggagaacagagaaacaaaccaccuccugaaucgcccggggaacggagcguauacccuuuccgacuuugccgagagcacauguacccuggcuuacggcuccaagugcaaaucuugggagcaccagcucgaugaacugagcuuccccuuuuuccauuccaaucuggacaaguauagcaugcucgaggccgccaccgaaacaauuccuauccugaacaaaucuuccgcuguguguacgauuagcccuucuacccacagcuccaaugccugcgggcgggaggcgucucuuaucaagaaaaaguguggaaacaauaugagcgccuuuuucuacgucaaccuggcuggccaaaucacaguugugaagugcgauaccaaucaugugcucuccaacgacugugggaauugcauuagcaaaacacugucuggacagaagaucuacacccccguccaggauauguuuugccagagaggcuggacggaguccauucccagcacacgcuauucuaaagaccuuuguuccaucggccugcacaccgugaaggaaugcaaaaccgggacaaccaacuucgagcggguuggauuuauuguggucaagagcagaaagauguacaucgaacaaaugaaaaugcgcucccggcaggaguucucugaagaucaguuccucuguuauaagagcgaguccucuagcggcuccagcgugaaacugaagaaaguuaagguggagucuugcaagggggucacaacguccagcgccucuaaauguuccggagacgaauacuuuugcagcagauauccuugugagaccgcuaauguggaagcccacugcauucugcggcgccauucugcugucaucgaggugaacguuaauggcgugugggucgugccgagauguaucggguacgaagagguucucgugcggagaacaagccugaagauggaggauaccuccagccgcgaaugcgacacaugucuuugggagugcgggaaaaacaagcugauugucaaaacccacggccccaagaucguguaugccacggcgugcucucauggcuccuguaaaagcgugaugcagaagccugccaccuucguuuaccuccccuacccugggaacuccgaaauugucggaggcgacaucggggugcacaugacagaggaaucuagccccuccaauauucauaugguggcucacugcccggccaaggauucuugugaggucagcuccugccuguuuugugugcacggacugcuuaacuaucaaugccauacccucuucucugcucugcugaucagcacaaccguuauguccauccucacgcugcuucugcuccuggugaaaggcgccaaggaccuggucaaaaagcucuuuuacuggcucauuacaccucuguguuggcugagcguguucugcggguggaugaucaaaucuuggaagaagaaaguuggcuccgcgauuagccggaccaaugauacaaucggauggagagacaaccgcagauauggccgggauguggagcgcgcccaguacaccgggggagcucccggcgccaaguauucuuuuuacggggucaugauucucggacugcuuggcaaugugcacuccuguagcgaaucuguuaucgcugacuccaaagugaugcagugcaccacaagcggguccagcacgcuguguaaggccucuggcaccgucaucaugaaacucggaccuauuggcagcgaguccugccugauccugaaggggcuuaaggauaacgaaaaacaauucauuucuaucaagacaauuagcuccgagcuuaccugcagagagggagaaucuuuuuggacaacccuguauacgcccgugugucugagcucccggcgcugccaucucaugggcgaguguugcucugacagaugucugaaauggaagacaaaugaaaccagcgccgaguucaccgggaaagcucacggagaagugaugcacgagaaccggugcuuugagcaguccggcgggaucggcuacggauguuucaaugucaacccuagcugccuuuacguucauucuauccugaaguccguguauaagaauggcuuuaaaauuuuccgcuguguggcguggaaccacagaauccggcucgaagucacaacccauagccgcaaguuccccauggugcugauggccaugucuacacagccgacggauuggggguccauuggacugauccuugacagcgagggcauuaccgggacaaaugcuuacuccuuuaugaaacacggaucuggcagccucgccaucauugaugacccuuauucccccgaacccagaaagggguuccugggcgagguucggugcccuaccgaagagacagccaucagagcuagcccgucuuguaaaauggcccccaaccugaucgaguaccagccugaaauggauaccgcggagugcacgaccaauaugauugaccccauggcuaucuuuaaccgcggaucccucccucaagugcgggacggcaugacauucacccagagcauugaaaagaacacaguccaggcccugaccacaggggaggugagagccucuauccgccuuacccuggaugacuaugauguuguguaccauaauagccaguccgacugcucugcuacguuuaaaaaccucacaggauguuauagcugcgaugaaggcucccggauguguuaccaagucaaggccgagggggagaccauuuuccacuuugugaaugaagacgagucuaucaacguuaucaauaaggugagccccgaugucuccgacuacugcaccgugcugcacuucagcagaccugugauuucuaucgaaggacgcuaugauuguggccuguccaaaagccccauggucauuaagggcacacuuaucgcgaccgcuccgcaugacgaucggaaacacgagggaggauccucucugguugugaacccuaagggcgggacgguggacuuuuucggaugggucagcggccucacauccuggcucgggggaccccugaaaaccuuucugacaauucuuggcuuccuggcccucggccugcugcuugugguuaucaucauuaccaucgccagaacagggguggagcaggcucugaagaagaaaaauaaguga

SEQ ID NO: 14688 - RNA, 3972 nt, Artificial Sequence
  derived and/or modified CDS sequence (opt5) from SFNV__HM566171.1__GP
augcugaacaccaagagcaucauucucaucacaugccuggugcagcaaguccaccuuaaauacacgauuaucuccgagguuaccaagggcgccagagaagugucuuguuauagcuccacaacccggcuggaccagcuccuggaggcuugggaaaauaaaucugcccuuauggggcugcgcaagggaaacugcaaacucggcgcgauggaacagguggauuguaaucuggaccugaugagcaacuacgucuccaauguguaugauaacccccaugggcucggagcuaugauguacaaugacaagagaauugagguucugaacgaucagaucccugacucuaugaucccgggcgggcacaauugcagccuucuggagcggaagcccuucugggccgaucucauuccuuccaaaaaggagaacccccgcccuagccugaucucucuugugcccacaccuagauccgacuuuaaacggaaguucgaagaggccgaagaggagaugaaaaagauucgcaaggaacugcaagaugagagacaggcucagcucagcgucaucgaagagggacggaaacgcaugagagaccuggaagauaagcugaugcggcaguggaaugaggagaaacaaaagaaaggccuccuggaagagacccuugaaaagaaacgccagcugaagaacaaggcccuccuggacgcucauaaucuugauaaacagcugaaggagaaagacagagaauuuaagacagccauggaggagcaccagaacgaacggcaucgcauuaauucuaacaugaucagaccgcccauuaccacgccugcggccgugauccucaccucccugcugagcgcuucuguugugcucggcuucgagcuggaaaaccggaauacaaaccacgcccuuaauagacccgggaacggaggcuauuccaucagcgacaauaaccugauugaggcuaaauguaugaucaccuacgggaauaagugcccuuccugggaaaugcaacucgaucccgucucuuauccguuuuucagcuccaacuuugagaaguacagccugcuugagucuauuuccgaaacaagcccuaucauuggaaaauucucugaggugugugugcugagcaaucuccccggcgcccagaagaccugcgcgaaagaagccucccugaucaagaaacaguguucugacgauaugcgcgcuuacuuuuauaucaacagccuggggaagcucgccauugucacgugcccugagaauaacguucugucccaagacuguaauuucugccuucggaaggcuaaaggagagcaguacguguauaagcccauccaggauggcuuuugccagaacggcggggugagcucuguccccuccauuagauacagcaaagacaucuguucuauuggaccuacaaaggugaaaaauugccacaagggcaccucccgcuaugaacggacagccuucaucagcaccggggauaagaaaguuuaccuggaggaaaucaagauuagaucccgccaagaguaugaaccggaccaguuucucuguuacaaagugaaggauucuagcuccucuccccuggccuacgagaaaguccaggugagcaagugcaaaggaaucgagaccaacuccccuaagaaguguacaggcgacgaauauuucugcagcaaauaccccugugagucuacguccccugaagcuaacugcuuccugcggaagcauagcgcgauucuugagguuaauaucgggggaauguggauuaaacccaaguguaucggcuaugaaauggcccucgugaaaagagucggccugcgcucugaggauguguccagcaaggagugcgcuaccugucugugggaaugcucuagcggguacauuuccaucacaacccacggaccgaagaucagcuaugccacagccugcucucauggcuccuguaaaagcauuguccagaacccuuccaccucuauccggauuagcuaccccggaaauuccgagaucgugggaggcgacauugggauccaccucacggaagacucuagcccuaucaaccugcaccuuaagauucauugcucccccaaagauucuugugagguuagcgacugcaucuuuugugugcacggccugcucaauuaucaaugccauuccgucgcuagcgcccugcugcuuucuacaauuaccgcgucccucaucgugcugaugauuuacaugcugagcaagaccaaauucguuaugaagaagcucaucccuaucaugcugacaccccuuuguuggugcuuugugcugcucgcuuggcugaccaaaucuuggaagggaaaaaugagaaacgccauucaguccgccaauagcacaaucggcuggacggaacgcgaggagcggauugucgcugaaagaccgcggucucgcaacaccgugagauacuccuucuauggggugguuauccuggccaugcuugagagcgcuuuuggauguuccgaaagccucauugccgagucuaaggucaugcagugcaauaucgcgaacggcaaaacaagcugucgggccuccgggaccaucauuaugaagcugggaccuaucggcucugaggcuugccugauucucaaggggcugagagauagcgacaaacaguacaucuccgugaagacagaaucuagcgagcuuauuugccgcgaaggcgaguccuucuggaccucucuguauacgcccgugugucucagcucccggagaugccaccugaugggagaauguaccggcgaucugugccuuaaauggaaaagcaauaagacaucucucgaguuugccgggaagacccgcuccgacgucaucaacgagaauaaauguuucgaacaaagcggaggccugggguacggaugcuuuaacgugaaucccucuugucuguauacacaugcuuaccucaaguccguuuauagaaacggcuuccggguguuuaagugcgccagcuggacccaccgcgucaaacugacgauuacaacccacuccagaacauucccuaugacccuugcggccaugucuacccagccgacagauugggggagcaucggccugauccucgacuccgagggaauuagcggcacgaacucuuuuuccuucaugaagcaugggcuggggagcuucgcuaucauugaugaacccuacucuauggagccucggaaaggcuuuaucggggaagugcgcugucccaccgaggaggccgcuauuaaggccagcacacugugcaaaaccgccccucagcuuaucgaauaccagcccgagauggacuccgcugaauguacaaccaauaugaucgauccuaugucuguuuucaacagaggaagccugccccaagugcgggagggcaugacguuuacacaguccauggaaaagaauaccguccaggcgaugaccacaggggaggugcacgccucuauucgcaucguucucgacgauuaugagguggaauaccugagcucccaagucgacugcgacgcuaccuucaagaaccucacaggcugcuauagcugugaugagggagccagagugugcaugcagauuaucgcccauggcgacacgauuuuucacuuccggaauccggaugugucuaucaacauccugcagaaagucaauaccaacacacuuauuuacuguuccguugugcacuuuagcaagccugugaucaaagaagaggggaccuaugacugcggagcuggcgagaagcccaugauucugaaagggacacucgucgccguguccccucauaaugaucgccuggaacagggaggcucuagcaucguuauuaaccccaagggcgggggaguggacuuccugggcuggcuuuccggguuuucuagcugguucggaggcccgcugaaggcgauccucauggucauuggguuucugcuccugggacuuauccuguucgugaccaucgcuauuggccucaaauuugcccugagacaaaugaucguuaagcggaugaaauga

SEQ ID NO: 14689 - RNA, 3873 nt, Artificial Sequence; identical to SEQ ID NO: 14372
  derived and/or modified CDS sequence (opt5) from SFNV(Namru)__HM566169.1__GP

SEQ ID NO: 14690 - RNA, 3990 nt, Artificial Sequence
  derived and/or modified CDS sequence (opt5) from SFNV/SFNV-like(Poona)__HM566177.1__GP
augcugaacgucaagagcgugauccucauuaccugccugguucagcaagcccaccuuaaauacacaaucauuuccgagguggcuaagggcgccagagaagugucuuguuauagcuccacgacccggcuggaccagcuccuggaggcgugggaaaauaaaucugcucuuaucgggcugaagcgcggaaacugcaaacucggcgccauggagcagauuaauuguaaccuggaucugaugagcaauuacgucuccaacguguaugacaauccccaugggcucggagccaugauguacaacacagauucugacaagagaaucgaaguucugaaugaucagaucccugacagcaugauuccgggcgggcacaacugcucccuucuggagcggaagcccuucugggcugaucucaucccucccaaaaaggagaaagaacuggacccuaagcccagccuuauuucucuggugccuaccccgcgcgaugacuuuaaaaagaaguucgaggaagccgaggaggaaaugaaaaagaucagaaaagagcuccaaaaugaacggcaggcucagcuguccgucauggaggauagccgcaagaaaaugagagaccuggaagaucggcucaugcgccagugggaggaggaaaagcagaaaaagggacugcuugaggaaacacuggagaaggaaagacaacucaaaaacaaggcccugcuugacgcgcaugaccuggauaaacagcucaaggagcgggaccgcgaguuuaaaaccgccauggaggaacaccagaaugaaagacggcgcauuaacucuaauaugaucagacccuaugugacaaccccugcugccauuauccugacgucccugcucagcgcuucuguuguggucggcuucgagcuggaaaaccggaacaccaaucaugugcuuaacagacccggcaaugggggauacuccaucagcgauaacaaucugauugaggccaaguguaugaucacauauggcaccaagugccucuccugggagaugcaacugaacccugugucuuaccccuuuuucagcuccaauuuugaaaaauacagccuucuggagucugucuccgaaacaaccccgauuaucgggaaguucagcgagguuugugugcucucuaaccugagcggagcgcagaaaacgugcgccaaggaggcuucccugauuaaaaagcaguguccugacgauauccgcgccuauuuuuacaucaauucucucggcaagcuggcuauugugacaugccccgaaaacaauguccuuagccaagacuguaacuucugcgugccuaaagccaagggggagcgguauaucuacaaacccauucaggauggauuuugccagaauggcggcguuuccaccgugcccagcgucagauauucuaaggacaucuguuccauugggccucugaaagugaagaacugccacaagggaacaagccgcuacgaacggaccgccuucaucucuaccggcgauaaaaagguuuaucucgaggaagugaaaaucagaucccgccaggaguacgagccggaccaauuucuguguuacaaggucaaagaugggagcuccucuccccugguguaugaaaagguccaggugagcaaaugcaagggaauugagacaaauuccccuaagaaauguacgggcgacgaauacuucugcucuaaguaucccugugagagcaccuccccugaagcuaacugcuaccuucggaaacacagcgcgaucauugagguuaacaucgggggaaugugggugaagcccaaaugugucggcuaugagauggcccucgugaagagaguuggccugcgcucugaagacgugucccugaaggagugcgcuacaugucucugggaaugcucuagcuccuacauuagcaucaccacacaugggccgaaaauuucuuaugccaccgccugcagccacggauccuguaagagcgucgugcagucuccuuccacgagcaucaaaaucuccuaccccggcaauucugagauugugggcggagauaucggcauucaucugacagaagacagcuccccuguuaaccuucaccugaagauccacugcccgccuaaagauucuugugaggucagcgacugcauucucugugugcaugggcugcugaauuaccagugccacuccguggcuucugcccuucuccugagcaccaucaucgcgucccugauugcucucgucguguauaugcugagcaagacccgguucguuaugagaaagaucgugcccauuauguuuaucccguucuguuggugcuuuguccuucuggccuggcucacacgcucuuggaaaggcaaggugcggaacgccauucaauccgcuaauaacaccaucggauggacagagagagaggaacggguuaucgccgaacgcccuggcgggagaaauacgauucgguacagcuucuauggaguggucauccuggcuauucuggagucugccuuuggcuguuccgagagccuuaucgcggaaucuaaaauuaugcagugcaacaucgccaaugggaagaccuccuguagagcuagcggaacaaucauuaugaaacucggccccaucggguccgaggccugccugauucugaagggccuccgcgauagcgacaagcaguacaucucugugaaaaccgaaagcuccgagcugauuugccgggaaggagagucuuucuggacaagccuuuauacccccguuugucuguccucuagacgcugccaucucaugggcgaguguacgggggaucugugccugaaguggaaaagcaacaagaccucccuugaauuugcuggaaaaacacacucugaggugaugaaugaaaacagauguuucgagcagagcggcgggcucggauacggcugcuuuaauaucaacccuuccugucuguauacccaugccuaccucaagagcgucuaccggaauggguuccgcguguuuaaaugcgcgucuuggacacacagagugcggcugaccauuacgacacacucccgcaccuucccgaugacacuggccgcuaugagcacccaacccaccgacuggggcucuaucggacuuauccuggauuccgaaggcauuagcgggacaaacuccuuuucuuucaugaagcauggacucggcagcuucgccaucauugacgagccuuauuccauggagcccagaaagggguuuaucggagaaguccgguguccuacggaggaagcugccauuaaagccagcacccugugcaagacagcuccccagcugaucgaguaccagccugaaauggauucuguugaguguaccacaaacaugaucgaccccauguccauuuucaaucgcggcagccuuccccaggugagagaggggaugaccuuuacgcaaucuauggagaaaaacacagugcaggcgaugaccaccggcgaaguccacgccagcauccggcuggugcucgaugacuaugaaguugaguaccuguccaaucagguggacugcgaugcuacauucaagaaccucaccggaugcuauucuugugacgagggcgcccgcgucugcaugcaaauuaaagcccauggggauacaaucuuucacuucaagaauagcgacauguccaugaacauucugcagaaggugucuacgaauacccuuaucuacuguagcguugugcacuuuuccaaaccugucaucaaggaagagggaguguaugauugcggcgcuggggaaaaacccaugauucugaagggaacacucguugccgugagcccucauaacgacagacuggagcagggcgggucuuccaucgucauuaaucccaaagggagcggaguggauuuccugggcuggcuuuccggguuuucuagcugguucggaggcccgcugaaggcgauccucaccgugauuggguuucugcuccugggauuccuucuguuuaugcucgucacaaucggccugcgguacgcucugucccagguugugaccaagaaaaugaaguga

SEQ ID NO: 14691 - RNA, 4002 nt, Artificial Sequence
  derived and/or modified CDS sequence (opt5) from Arrabida virus(PoSFPhlebV/126/2008)__KP863800.1__GP
auguucuacgccaaguuuauccugcuccugugcuucgugcagggagcccuucugaaauauaccauuaucagcaaggucggguccucuacauacaaaagaguuugucucagccacacgaccgaccuggauacacuucuggacaugaccucccgggagaugucuaacauuaagcucacaggaggcagcugcucccugggggaucugaccaaacccgacuguucuccugacuuuuucagcaauuauguggcuaacauccaauccagcaauacaaagauuaccggaaaguuucaggauaucaucggcgaacgcgagauggaagugacgaacgaugucgugccggacucuuucgggcccggaccucaugauugcguuuccuuugacaaaaagcccuucuggagcgaucuccugccuaccucuguguccaaagaggaacccaagccuauuaucagcacacuuucuguccugccggcggcucccccuauuaaagacuuuucccacaaggugguugaggccgaggaaauggugaaggagaucgaaggcgagcucaugaaagagaaggaaagaaauagcgccaaagaggaagaggcucggcagcgcaugagagaacuggaggaugaccuucggaagcagugggccgcugagcgcauggccaaacaaaacauguccucuguccuggaaagagagcggcaggaaaagcagagccucgagcgcagaaugcaugaaguggacaaaaagcugcgggcguccgaggaucgcgcccagaaguaccaagagagagcugaacaggccgagaaaagccacucuaagcugcucucccggagcggcgcugccaccacaauggcgaccguggucuucacgucucugcuugccagcgggcuggcuguugugacagaacucgagaaacgcgacaccaaucaucugcuuaacagacccggaaauggcguguauauggccaacgcugauucccugauucagacagaauguacccucaauuacgggcagcggugccuggccugggagcugcaaaucaccccugucagauaucccuuuuucacaucuaacguggacaaguacagccuccuggaguccauuacggaaaccccgagcauccuugagaaaaauaacgaaucuugucagcuggccacaaccuccggaagccucaagacaugcgcuaaggaggcgucuaccaucaaaaagcacuguacggaugacguucgcgccuuuuucuucauuaauuccgugggcaaacugacaaucguccggugcgcugauaaccacauucuuagcgaggacuguaacuuuugcaucuccaaggccagaaauucuaaccagaauauguucaugccugugcaagaugccuuuugccagcgccaggggagcgacaccgcucccgccauucgguacuccaaagauaucuguucuaucggagcgauuaagaucaagcagugccauaaagcuaccagcaaguucgaaagaaugggcuuuauuuccguuggccagaaaaagcuguauaucgaggaacucaaacugcgcuaccggcaagaguaugacccugaccaguucauguguuacaagauuaagagcucuagcccccugaaauaugaaaaggugagcucuaaaaagugcaaagaggucgauacagggggaaaccagaaguguuccggcgacgagcacuuuugcaauagauaccccugugauaccgccaacccugaagcccauugccucacacgcaaacacagcgcuaucgccgaggugaauaucgggggagucuggauucggccgaagugugugggcuaugaaaugguucuggugaagagaucugggcuuaaaagcgaggaccuguccauccgcgauugccccagcugucucugggaaugcaagaaaucucggauuacgaucaagacccacggaccuaaaauugucuccgcuacagccugcagccauggcuccuguaagucugugaugcaaaagcccagcaccuucguugagaucccuuaccccggcaacuccgagauuaucgggggagacaucggcgugcacaugacagaaagagggucuccgagcaauauucauguccggacccacugcccuccccgcgauuccugugacgugucugauugcauguuuugugugcauggaauccugaacuaccagugccacacgcuggcgagcgcccuuaccauugcuacaaucguuuccgccguccucgugguggucuauuuccugcuggcuagaagcaaacgggccgugaaguuuauuaccucucuccugaucguuccuuucaaauggcuuacacugcucuccaucuggguggucaagaauuggaaaagaaagaugagcaagcuggcgcgcgccaccaacaaugcuauuggcugggaccaggauguggagcgggggagaccccgcgccgcugccggccaccagaaccaaguugccagauacacguuuuauggagcuacaauccugucucuuaugaccuccggccucuguugcacagaaagcgugauugcggagucuaauaucaugcaguguaccaccuccgacagcacaacgaccugcaaagccuccgggacaauuauccugcggcugggaccuaucggcagcgaaucuugucucauucugaaggggcuucgcgauagcgagaaacaguucaucuccauuagaaccgucucuagcgagcugacaugccgggaaggagacuccuucuggaccucucucuacacgcccaucugccugagcucccgcagaugucaucugaugggcgagugcacaggggacaacugucuuaaguggcaggauaacaaaaccucuagcgaauuuaccggccggacacacuccgaggugcuccaugagaauaagugcuucgaacaaagcggaggcauuggguauggauguuuuaacguuaauccgucuugccugauggugcacuccuaccugaagccuaucuauaaaaacgcuuucaaggucuuucgcuguguggccuggaaucacagagugaaacucgccaucaccacacauaagaaauccuucgacgucacgcugauggcuaugucuacccagcccacagauuggggcuccauugggcuuauccuggacagcgagggaauuaccggcacaaacuccuacucuuuuaugaaguacgggguuggcagcuucgccaucauugaugaacccuuuuccaucgagccucggaaaggauuccucggcgaagugcgcugcccgaccgaggagacggcggugaaggcuagccccucuuguaaggccgccccucagauuaucgaauaucaccccgagauggacaccgucgaaugcaucacaaauaugauggauccuauggcuauuuuuaacagagggucccugccccaagugcgggacggaguuaccuucgcccagagcaucgagaaaaauucugugcaggcgcugacaaccggcgaaauuaaggcuagcgucagacuugugcucgaugacuacgagguugaguauaaaguguccgaaaacgauugugacucuacauuuaucaauauuaccgggugcuacagcugcgaugagggagcccgccuguguguccggaucagaacgcugggcgacuccaucuaucauuucacagacucugaagauaugaugaacgugauguucaagguuaauagcuccgugaccgaguacugcaccguccuccacuuuagcaaaccuguggugaacuucgaagggaaguaugacuguggcaagucucgcaaacccaugauuaucaagggaacacugauugccauggcuccgcaugaugaccggguccacuccggcgggagcuccaucguugugaauccuaaaucuaagggaguggauuuucuuggcuggcugagcgggcucuccucuuggcugggaggcccccugaaaaccguccuuacggugcugggcuuccucauucuggggcucguuuuugugaucgucgugaucuuccugguuagagugggcauucgccaggcccuucugaagaagaugaaauga

SEQ ID NO: 14692 - RNA, 4005 nt, Artificial Sequence
  derived and/or modified CDS sequence (opt5) from Massilia virus(127)__KT906100.1__GP
auguucuacgccaaguuugugaucagccugugccucgagcccggcuucucccugaaauauaccauuaucucuaagagcggguccggaacaauuagacagaucugucuuucucacagcacggacauugauaaaguccuggaacucuccucuggcgagaugaacaccaucgggauccugggaggccuuugcacauuuggggaacugaagcgggaggacuguagcccugauguuuucuccaauuacguggcuaacauguauggaaccgcccauccgagcucuugcaaauuuguggacauuacaggcgaucgcuccaucgaaguccucaaugacgcggugcccgauagcuucaccccuggcgcucacaacuguucuuccuuugagaagaagcccuucuggacagaccugauuccugccaaaaauagcucuggggccauccccuccguugugagcguccugccuuccguggcugagcaugauuuuaaccucaagguuaaagaagccaaugacaagcuggaggugauucaaagagaacuugcugccgagaaagcgcggucuggacgccuggaggaugaagccagagcuaagaugaaggcccucgaggacgaacugcggaacggcuggcuugcugagcgcgaagccaaagagcuggccaagagcgcgcucgagaaagaaagaaucaauaagcuggaggucgaacggaaacugcacgaucucgggaagaaacugcgccaguccgaggacgacguggaaaagaugagagugcaucacaagaaaggacggaaggagagcgaugaggaaaugaaaauugcucgcaccacggccccgucugucuccaccacacuugcuaccguuguguucacaagccugcucgccaccggccuggccgcuaucgagcccaucgaagacagaaacgugaaucacauucuuaaccggccugggucuggagucuacauggcgagccccacgcugacacagaaugagugcucccucgauuauggcaaggaauguaaagccugggagcuccaggugucuccucugcauuaccccuuuuucaccagcaacguugacaaguauacauuucucgaguccaucacccugcuuccgccuauucugcucaucaauaacgaguucugcgaacugaccacaagcucuggcccccuuaagcaaugucagaaagaauccagccugauuaagaaaugcuguacggaggaugcucgcgccuacuucuuuaucgaccucgaggggaagcugucuaucgugcacugcuccaacaaucagguccugagcgaagauugcaacuucugugugaccaaauccggaggcguuucucauaagauuuuuaugccuauccaggacgccuucugccaaaaagggggaagcgaguccauucccguggucagauacucuaaagauaucuguagcauuggccucuccaaggugaaaagcugccacaagucuacaucccgguaugaaagaaugggguuuaucgucgcuggaaagaagaagcuguacaucgaggaccuuaaaaugcgcuaucggcaggaauacgaugaggaccaguucuuuuguuauaaggugaauaaaaccagcccccuggaguacggcaaggaaucuccuuccaaaugcaagggcguugggagcaacgagcagaaauguaauggagacgaauauuucugcaacagauacccgugugagacaaauucucccgaagcccacugcagccuccgccggcaugcggcuguggucgagguguacguuggcggggccuggauuaagccuaagugugugggauaugagaaaguccuggugaagagaggcgggcugaaaaccgaagaucuuuccgugcgcgagugcacgagcugccucugggaaugugagaagaacaaaaucguuauuaagacacacggccccaagaucgucucugccaccgcuugcggaggccgguccuggaaaagcgugaugcaaaagccuuccaccuuucuggaccugcccuacccggggaauagcgaaauuaucggaggcgauagagggaaccaucucagcgagcgcggauccccuuauaauauucacucuacaauccauucucccccugaggacucccgggaugccucugacuguaucuacugcagacacggccugcuuaacuaucagagccacuccguggaaagcgcuauucugcucucuaccgucguggccacaauccuggcgcugacggggguugugcuuucccgcagcaaaucugccguccgguuccucgcuuccgccguggcuguucccuuuagaugggugagccugcuggucguguggguuaugaagaaauggaaggcccggguggcgaccgccauucgcgcuacaaauaacgccaucggcugggauaauggacucgagcaggcuagagucgaaaacgccgcccggagacaacagaccgcuggccgcuggcggucucuggacgcguccacaauucuuagcgugcuguccaccgggcucuguugcacggagagccugaucgccgagucuagcaucaugcaguguaccacaggagaaggcuccaccacaugcaaggcuaccgggacggugguccugaaacuuggaccuauuggcucugagagcugucucauccugaaggggcugagagauaacgaacgccaguucauuuccaucaaaacaauuucuagcgagcugaccugcagagaaggcgaguccuuuuggacaccccuguacaccccgguuugucuuucuagccggcgcugccaucugaugggagagugcaccggcgacaugugucucaaguggaaauccaauaagacaagcucugaguucacggggaagacccacuccgaagugauccaugaaaacaaaugcuucgagcaaagcggaggcaucggguauauguguuuuaaugugaacccuucuugccugaugguccacuccuaccugaagcccauuuacaaaaaugccuucaagguguuuagauguaucgccuggaaccaccggguucgccuuggaauuacaacccauaaaagaaaguucgaagugacacucauggcuaugagcacccagcaggccgauuggggcuccaucgggcugauucuggacucugagggcaucagcggaacaaauuccuauagcuuuaugaaacacggccucgggucuuacgcgaucauugaugagcccuauuccgucgaaccucggaagggauaccugggcgaggugcgcugcccgacggaagagaccgcuaucaaggccagccccucuuguaaaguugccccugggcuuguggaauaucagcccgagauggacacccuggagugcacaaccaacaugauggacccuauggcuauuuucaauagaggaagccucccccaaguccggggcggcuggacauuuucccagucuaucgaaaagaacagccgccaggcccugaauacgggggcgauuaacgcuuccgugagacauguucuggaugaguacgaguucgacuauaaagugaagaccaaugauugugacucuacauuugucaacaucaccggaugcuacagcugugaugaaggcgcccggcuuugcgugaaagugagaacauccagcgaggccauuuaccacuucaccgacucuggguauaauaucaacguccuguuuaagguugaauccggagugcaugaucacugcacgauccuccacuucagcaagccugugauuuccaucgagggcaaauacgacugugggaagaacaaaaagcccaugcugauuaaaggaacccucaucgcuauggccccgcaugaugaccgcgucgugucuggcggcagcuccacaguugugaauccuaaggggcagggagucgauuuucugggcuggcuuucucggcugagcuccugguucgggggaggcccccucaagaccuuccugauggugacaggguuucugaugaccggaguuauuggcggcaucgugacaaucauucuuaucagaauuguccugcaacaggcucucgccaaaaaggugaaauga

SEQ ID NO: 14693 - RNA, 4005 nt, Artificial Sequence
  derived and/or modified CDS sequence (opt5) from Massilia virus(130)__KT906101.1__GP
auguucuacgccaaguuugugaucagccugugccucgagcccggcuucucccugaaauauaccauuaucucuaagagcggguccggaacaauuagacagaucugucuuucucacagcacggacauugauaaaguccuggaacucucccggggcgagauggacaccaucucuauccuugggggacugugcacauuuggcgaacugaagcgcgaggauuguagcccugacguuuucuccaacuacguggcuaauauguaugggaccacacauccgagcucuugcaaauuuguggauauuaucggagacagauccauugaaguccucaacgaugccgugcccgacagcuucaccccuggcgcgcacaauuguucuuccuuugagaagaagcccuucuggacagaucugaucccugcuaaaaacagcucuggcgccauucccuccguugugagcguccugccuuccguggccgagcaugacuuuaaucucaagguuaaagaagcuaacgagaagcuggaagugauccaacgggagcuugccgcugagaaagcccgcucugggagacuggaagaugaggcgcgggccaagaugaaggcucucgaagacgagcugcgcaauggauggcuugccgaaagagaggcuaaagagcuggccaagagcgcgcucgaaaaagagcggauuaacaagcuggaagucgagcgcaaacugcacgaucucggcaagaaacugagacaguccgaagacgacguggagaagaugcgggugcaucacaagaaacgcagaaaggagagcgaugaagagaugaaaaucgccaagaccacggcuccgucugucuccaccacacuugccaccguuguguucacaagccugcucgcuaccgggcuggccgccaucgaacccauugaggaccggaaugugaaccacauccuuaaucgcccuggaucuggcgucuacauggcuagccccacgcugacacagaacgaaugcucccucgauuaugggaaagaguguaaggcgugggagcuccaggugucuccucugcauuaccccuuuuucaccagcaauguugacaaguauuccauucuggaaagcaucacacaaucuuccccgauucugcuuaaaaacaauaacagcugcgagcugaccaccucuccuggaacacagaagcagugucagaaagaauccagcacgaucaagaaauacugcaccgaugacgccagagcuuacuuuuucaucgaucucgagggcaagcuguccauugugcacuguacaaacaauuauauccuuucugaggacugcaacuucugcgucagcaagcugggcgaaguggggcauaaaauuuuuaugcccauccaagaugccuucugucagaagggaggcuccgagucuauuccuaucguucgguacagcaaagacaucugcuccauugggcucuuuaagaucaaaaauugucacaagagcaccucuagauaugaacgcaugggauucauuguggccggcaagaaaaagcuguacaucgaggaacugaaaaugcgguauagacaggaguacgaugaggaccaguuuuucugcuauaaggucaaaaagacaagcccccucgaauacgcuaaagugucccccucuaaguguaagggggucggauccaacgagcaaaaaugcaauggcgacgaauacuuuuguaaccgcuauccuugcgagaccaauagcccggaagcccacuguucucugcggagacaugcggcugugguugagguguacgucggcggggccuggauuaagcccaaaugcgugggauaugagaagguucuugugaaacgcggcgggcugaagacggaagaucucagcguccgggaguguacauccugccugugggaaugcgagaagaacaaaaucgugauuaagacccacggaccuaaaaucgugagcgccaccgcuuguggccaugggucuugcaaguccguuaugcagaaacccagcacauuccuggaccuuccuuaccccggcaauuccgaaaucauuggaggcgauagagggaaccaccucucugagcgcggaagcccguauaauauccauuccaccauucacuguccucccgaggacucucgggaugccagcgacugcaucuacuguagacacggccugcugaacuaucagucccauucugucgcuagcgccauucuccuguccacagugguggcgacgauccuugcccugaccggggucgugcucagccgcucuaaguccgcuguucgguuucuggccagcgcuguggccgucccuuucagaugggugucucugcuuguugugugggucaugaagaaauggaaggcgcgggugacaaccgccauccgcgcuacaaauaacgccauuggaugggauaauggccucgaacaaguuagaguggagaacgcugcccggagacagcagcccgccguccgcuggcggucccuggacgcuagcaccauccugucuauucucgggacgggccugugcuguaccgaaucccuuaucgcggagagcuccauuaugcagugcacaaccgaggaaggaagcacaaccuguaaagccacgggcacaguggugcugaagcucgggccuaucggaucugagagcugccugauccugaaaggccuuagagauaacgaaaagcaauuuauuuccaucaagaccauuucuagcgagcucacaugucgcgaaggggaguccuucuggaccucucuguacacccccgucugccugagcuccagacggugccaccucaugggagaguguacaggcgacaucugccugaaauggaagucuaauaaaacgagcuccgaauuuaccgggaagacacauagcgagguuauucacgaaaacaaauguuucgagcagucuggcggaaucggcuacaugugcuucaaugugaacccguccugucuuauggugcacagcuaucugaagccuaucuacaaaaaugcuuuuaaggucuuccgcugcauugccuggaaccauagagugcggcucgggaucaccacacacaagcgcaaauuugaaauuacccugauggccaugucuacgcagcagacagauuggggauccaucggccugauucuugacagcgaggggguugcuggaaccaaugccuauuccuucaugaagcauggccucgggucuuuugcgaucauugaugagcccuacagcguggaacccagaaaaggcuaucugggagaggucaagggcccucgggaagagaccgcuaucaaagccuccccgagcugucaaguggcccccgggcugguugaauaccagccugugauggacacagucgagugcaccacaaacaugauggacccccucgcuaucuucaaucgcggaucucugccucaggugagaggcggguggacguuuucccagagcauugagaagaacucucuucaagcccugaauaccggagcgauccacgcuagcguucggcaugugcucgaugaauaugaguucgaauacaaggucaaauccaacgacugugauucuacauuugugaauauuaccggcugcuacagcugugacgagggcgcccgccugugcgugaaggucagaacauccucugaggccaucuaucacuucaccgauagcggguacaacauuaauguucuguuuaaaguggacuccggagugcacgaucauugcacgauccuucacuucagcaagcccgucaucucuauugaaggcaaauaugacugugggaagaacaagaaaccuaugcugaucaagggaacccucauugcuauggcuccccaugaugaccgggugguuuccggcgggagcuccacaguggucaacccgaaaggacagggcguggauuuucugggcuggcucucugggcugagcuccugguucggaggcgggccucuuaagaccuuccugaugguuacaggauuucucaugaccggcgugaucucugggauugucacaaucauccugauuagaaucgugcugcagcaggcccuugccaaaaaggucaaguga

SEQ ID NO: 14694 - RNA, 3999 nt, Artificial Sequence
  derived and/or modified CDS sequence (opt5) from Massilia virus(W)__EU725772.1__GP
auguucuacgccaaguuugugaucauucugugccucguccagggcuucagccugaaauauaccaucauuuccaagucugggagcggaacaaucagacaaauuugucuuucccacucuacggacaucgauaaaguucuggagcucagcuccggcgaaauggacaccaucaacauucaagggggacugugcacauuuggcgagcuuaagcgggaagauuguucucccgacguguucagcaauuacaucgcuaacauguaugggaccacacauccuuccagcugccgcuuucuggauauuaucggagacagaucuauugaggugaugaaugaugccuccccggacagcuucacccccggcgcgcacaacuguucuuccuuugaaaaagcuccuuucuggagcgaucucauccccgccaagaauggcucugggccuucccccagcgucguguccguucugccuucugccacagagagcgacuuuucccugaaggugaaaaaggcuaacgagcggcucgaagucauucagcgcgagcuggccgcugaaaaagccagaagcggacggcuugaggaugaggcgcgcaccaagaugagagcccuggaagacgagcuccggaauggcuggcuggcugaacgcgaggccaaagaacuugcuaagucugaucuggagaaggagagagugaacaaacucgaaguugagcggaagcugcaugaccugaauaaaaagcuccgccaguccgaagacgaggccgaaagacugcgggaguaccacaacaaacgcagaaaggagagcgaugagaaaaugaagaugacgaagaccguggcgccgaaugucucuacaacccuugccacaguggugcugaccagccuccuggcuacggggcuugccgcuaucgagcccaucgaagaccggaacacaaaucauauucugaacagaccuggaaccggcgucuauauggccucccccacacucaccgagaaugauugcucucuggacuacgggaaagaauguaaggccugggagcugcagguuagcccucuccacuaucccuucuuuaccuccaacguggauaaauacagccugcuugagucuaucacacaggcuuccccgauucugaucaagaacaauaacagcugcgaacucacgaccucuccuggaucccagaaacagugucaaaaggagagcuccacaauuaagaaauacugcaccgacgaugcgcgcgccuauuucuuuguggaccuggaaggcaaucuuucuaucguccacuguagcaacaauaacauccuguccgaggauugcaauuucugcauuucuaagagcggcgugacagggcagaaaaucuucaugcccauucaggacgcuuuuugucagcggggaggcuccgagagccucccuguuaucagauacucuaaggauauuugcuccaucgggcuguucaaaaucaagagcugucauaagucuaccucccgcuaugaacggaugggauuuauuguggucggccgcaaaaagcuguaccucgaggaacugaaaaugagauaucggcaagaguacgacgaagaccaguucuauugcuacaaggccaaaacgacaagccagcuucaauaccagaaggugucucccagcaaguguaaagggguuggauccaaggaucagaaaugcaacggcgacgaguauuuuuguaauagauuccccugcgagaccaacaauccugaugcccacuguagccugcgccggcaugcugccguggucgaagugaacgucggcggggcgugggugaagccgaaaugcguuggauacgagaaggugcucgucaaaagaggcgggcugaagaccgaagaccugucugugcgcgaguguacauccugccuuugggaaugcgagaagaauaaaaucguuauuaagacccacggacccaaaaucgugagcgcuacagccuguucccacggcucuugcaagagcgucaugcagaaaccuuccacguuucucgaucugcccuauccugggaacucugagauuaucggcggagacauuggcauccauaugagcgaacgggggucccccucuaauauccacauuaccauccauuguccgccuaaggauagcugcgacguguccgauuguauuuucugcagacacggaauccugaacuaccaaugucauagcguggccucugcuauucuccuguccacaguugucgccaccauccuugcucugacaggcgugaucauuagccggucuaaguuugccgugcgcuuccucgcguccgccgucgcuauccccuuuagaugggugagccugcugguugugugggucaugaaaaaguggaaaucucggauugccaccgcuaucagagccacgaacaaugcgauugggugggacaacggacuugaacaggugcgcguugaaaaugccgcucggagaccucagcccgccgugcgcuaugcuuucuacgccaccacaauccucuccauccugggcagcgggcugugcuguaccgagucccucauugccgaaagcucuaucaugcagugcacaaccgaggauagcuccacgacauguaaggcuaccggcacagucgugcugaaacuuggaccuauuggcucugagagcugccugauccucaaggggcugagagacaacgaaaagcaauuuauuuccaucaaaaccaucucuagcgagcugaccugccgggaaggagaguccuucuggacaucucuuuauacgcccguuugucucagcucccgcagaugccaccugaugggcgaguguaccggggauauuugccugaaguggaaaagcaauaagacaucuuccgaguucaccggaaaagcgcacagcgaagugauccaugaaaacaaguguuuugagcagucuggcgggauuggcuacggaugcuucaaugucaacccguccugucucauggugcacagcuaccugaagccuaucuauaaaaaugccuuucggguguuccgcugcauugcuuggaaccauagaguccggcuuggcguuacaacccacaagcgcaaauuugaaaucacgcugauggccauguccacacagcagaccgacugggggucuauuggacucauccuggacagcgagggcaucgaggggaccaaugccuacuccuucaugaagcacggacugggcagcuuugcuauuguggaugaacccuauucuguggagcccagaaaaggguaccuuggcgaaguccgguguccuacagaggaaaccgccaucaaggcguccccgagcugcaaaguggcucccggacucauugaguaucaaccugagauggacacaguugaauguacgaccaacaugauggaucccauggccaucuucaaucgcggcucucugccucaggugagagaggggaagacauuuacccagagcauugaaaagaacuccguccaggcccugacaaccggagagauccaugcuucugugcggcucguucuggacgaauacgagaucgaguauaaagugacgagcaaugauugcgacuccaccuucgucaacauuacaggcugcuacucuugugaugaaggggccagacuuugcgugaagguuaaaagcuccagcgaggcgaucuaccacuuuaccgacucuuccuucagcgugaacguccuguuuaaggugacacccuccgugcaugauuauuguaccauucuccacuucucucgcccugucaucagcauugaaggaaaauacgacugcggcaagaauaagaaacccaugcugaucaagggcacacugaucgcuauggccccgcaugaugaccggguuauuaacgggggauccucuaccguggugaauccuaaaggccacggggucgauuuccuuggauggcugagcggccucuccagcugguuugggggaccccugaagacguuccucauggugaugggcuuucugaugaucggcguuauuaucgugauugucacaaucauucuuaucagaaucgggcugcaacaggcccucgcuaaaaaguucaaguga

SEQ ID NO: 14695 - RNA, 3996 nt, Artificial Sequence
  derived and/or modified CDS sequence (opt5) from Punique virus(PI-B4-2008)__JF920134.1__GP
auguucuacgccaaguuugugaucauucugugccucguccagggcuucagccugaaauauaccaucauuuccaaacuugggucuggaacaacgagacaaguuugucugagccacuccaccgaccucgauaaggugcuggagaucucuaacauggaaauggacgcuauuaaucuucugggcggguuuugcacacucggagagcugcggcgcgaagauuguagccccaacguguucuccaauuacgucgugaacguucauggcaccauccacucuagcaauugcaaguuuguggacaucgucggggauagauccauugaggugcugaacgacgccacaccugauagcuucaccccgggagcgcauaauuguucuuccuuugaaaaacccccuuucuggacagaccucguucccaagaagaacgauaccgacccuagccccucucugcuuuccgugcugccugcugccgccgagcucgauuuuaaucugaaacuuaaggaggcuaacgacaaagucgaagccauccagcgggagcugguggcugaaaaggcccgcagcggcagaauugaggaugaggcgcggacgaaaaugcgcgaacucgaggacgaacugagacggggcuggaucgccgagcgcgaagcuaaggagcuggcccacaagaaucucgaggaagagagagugucuaaacuggaaauugagcggcgcaugcaugaccuugauaagaaacugagacaguccgaaaacgacgcugaucggcuccgcgagcaguauaauaagaaaagaaagagcgaggaagaggucaaaaccccgaaggccuccacacugaacgcgaccacaacccuugccacgguugugcugacaucucuccuggcuaccgggcuggccgcuaucgaacaaauugaggaacggaauacaaaccacauccucaacagacccggaaccggcguguacauggccagcccuacccugacacagacggagugcucccuuggguauggaaaggaguguaaaagcugggaacugcaggucucuccccuccacuacccuuucuuuaccuccaauguggacaaguauagcauccuggagucuauuacacaggaacccacccuucugaucaaaaacaauaacagcugcgagcucacaaccuccccgggcucucaaaagcagugucagaaagagagcuccacgauuaagaaguacugcacagaugacgcccgcgcuuacuucuuuaucgaucugggaggaaaucugagcauuguucauuguucuaacaauuucgugcucuccgaagacugcaacuucugcaucagcaaaucuggcggcgucgggcagaagaucuuuaugccuauucaagaugcguucugucagcggggaggcuccgagagcccucccgugguuagauauuccaaagaccugugcucuaucgggcuuuuuaagauuaaaagcugucacaaguccaccucucgcuacgaacggaugggauucaucguggccggccagaagaaacuguaucucgaggaacugaagaugagauaccgccaagaguaugaugaggaccaguuuuucugcuacaaagucaagagcaauagcccccugcaguaugaaaaagugagccccucuaaguguaagggggucggaucccaggaccaaaaaugcaacggcgaugaguacuuuuguaaucgguacccuugcgacaccaacaauccggaugcucauuguagccuuagacgccacgccgccgugguugaagugaacgucggcgggguguggauuaagcccaaaugcguuggauaugagaaggugcucgucaaacggggcgggcugaagacagaagaccugucugugagagaguguaccuccugccucugggagugcgaacgcaauaaagugguugucaagacacacggaccuaagaucgugagcgcuacggccuguucucauggcagcugcaaauccgugaugcagaagcccagcaccuuccuggagaucccuuaccccgggaacucugaaauuaucggcggagauauuggcauccacauguccgagcgggggagcccguccaacauucaugucgugguucacuguaaaccuaaggacucuugcgauaucagcgacuguauuuucugcaaacauggaauccuuaauuaucagugucacuccguggcgucugcuguccugcucagcacaaugaucgccgccugccuggcucuggugggcguuauuguguccagaucuaagcacgccgucaaguuccuugcuagcgugguugccauccccuuuaaaugggugucccuccugaccgucuggguggugaagaacuggaaacugcggauuacacgcgucaucagagcgaccaaugaugccauugggugggaaaacaaucucgagcagguucggguggagaacgcugccagacgcccucaacccgcugugcgguacgccuucuauggaacgaccauccugagcauccuuucuacaggccuguguugcuccgaaagccucauugcggagucuuccaucaugcaguguaccacagaagacagcucuaccgucugcaaggccacggggacagugguucugaaacugggcccuauuggauccgagagcugccuuauccucaagggccugagagauaaugagaagcaguuuauuuccaucaaaaccaucagcucugaacugacaugucgcgagggggaauccuucuggaccucccucuacacccccgugugccugucuagcagacggugucaucuuaugggagagugcacaggcgacauuugucugaaguggaaaacgaacaagaccuccgcugaauuuacagggaaaacccacucugaggucauccaugagaauaagugcuuugaacagagcggaggcaugggguauggcuguuucaacgugaauccguccugccucaugguucacucuuaccugaagccuauuuacaaaaacgccuuuaagguguuccgcugugucgcuuggaaucacagagugcggcugggaaucacaacccauaaacgcaacuuugagauuacgcuuauggccaugagcacacaacagaccgauuggggcuccaucgggcucauccuggacagcgaaggaauuaccggcacaaauucuuauuccuucaugaagcacgggcuggggagcuuugccaucauugacgagcccuacguuaccgaacccagaaaaggcuaucucggggaggugcggugcccuacagaggaaacggcugucaaggcgucuccguccuguaaaguggcccccggccugaucgaguaccagccugaaauggauguggucgagugcaccacaaacaugauggaccccauggcuauuuucaaccgcggaagccuuccucagguuagagauggcaagaccuuuacacaauccaucgaaaagucuagcgugcaggcccugaccacgggggagauucaugccuccgugcggcucguccuggacgaguaugaaguggaguacaaaguugugaauaacgauugcgacagcaccuucgucaauaucacaggauguuauucuugcgaugaaggcgcucgccugugugugaagguuaaagccuccagcgacgugaucuaccacuuuaccgauucugacaacagcaugaauguccuuuucaagguguccucuaacauucaggauuacugcaucguccugcauuuuagcaaacccgugguuaauguggaggggaaguaugacuguggaagauccaagaaaccuaugcucauuaagggcacacugaucgcgauggcuccccacgaugaccgggucaccaacggcgggucuagcauuaucaucaauccgaaaggaggcgggguggacuuccucggauggcuguccggccuuagcucuugguucgggggaccucugaagacauuucucauuaucgccggcuuccugauuguuggcaucauuaucgugaucauuaucauuauccuggccagacuugggauucaacaggcucuggccaaaaagcucaaguga

SEQ ID NO: 14696 - RNA, 4020 nt, Artificial Sequence
  derived and/or modified CDS sequence (opt5) from TOSV(9028)__KU904264.1__GP
auguucaucgccaagcugcuccugauuagcugccuugugcagcaggcuuaccugaaauauaccaucauuuccgagaucggcaacgggacaagaacgucuuuuuguuacagcucccggaccucucucggaagccugcuugaggccugggacaaugucacagaguccauuggccugaccucugggacaugcaagguuggaagccucgaaaaccgcgauuguagaaaagacaucauguccaauuauguggcggaggugcacagcgaucugcauggccugggggcuaugaugcacaacuacggagacgauaagcgggucgaaauccucaaugacgugauucccgaugagcugaacccuggccaucacaauugcucugaccuugaucgcaaaccguucuggaccgaguuuaucaacguugccaagccccuguccgaaauugugccuaugagcgucauucccccucccgugguuaagcuccaaccuccggccgagcccucuuccaaaaagcaugugccuuucgacguccugcuuagcgaagcugagaaagagcugaaucagacaaagaucagacucgaagaugagcggaaaucuaacgccgaagagaccgcuaaggaacgcgccagaaugaaggagaucgaggacgaacugcggcgcgagugggaacuggagagaaaacggaaggaugcgauggccgacgaccucgcuaaagaaacggcccgcagacgggagauugagcgcaaggcucacgaacuggauaaaaugcuuaagaaaaaggagagagaaucccugaucgccaaggagaaagcggacgaagauaugcggagccacgugcauaagcccaauaccacaagagccccugcucccaccaucauuacaacccuccugauggccuccgcugcccuugccggcccgcuggagaaccgcgagacgaaucaccuccugaaccggccugggaauggagcuuauacacugucugacuuugcggaaagcaccuguacacucgccuacggcuccgagugcaaaagcugggaacaucugcuuaacgaggagcuguuccccuuuuuccacucuaaccucgauaaguauuccaugcuggaagcugccaccgagaccgugccuauccuuaauaaaagcucugccgucuguacaauuagccccuccacgcacucuagcaacgcuugcgggagagaagccuccguuauccgcaagaaguguuacagcaauaugucugcguuuuucuacauuaaccuggcuggacagaucaccgugaucaaaugcgagacaaaucaugugcucuccagcgacuguggcaacugcauuucuaagucccugagcgggcaaaaagucuauacccccgugcaggauguguuuugccagaagggauggacacaguccaucccuucuacccgguacagcaaagacauuuguuccaucggccugcacacggugaaggaaugcaagauuggcacaaccucuuucgagagagucggguuuaucgugguuaaaggacgcaagauguauaucgagcaaaugaaaaugcggagcagacaggaauacuccgaggaucaguuccucuguuauaagagcgaaucuggcuccgggagcucugugaaacugaagaaguucaaagucgaguccugcaagggagugaccacaagcucugccagcaaauguuccggcgacgaauacuuuugcagccgcuauccgugugagaccgccaaugucgaggcucauugcauucuucggagacacucugccaucguggaaguuaacgugaauggggucugggugguuccccgcuguauuggauacgaggaagugcuggucaagcggacaucccucaaaguggaggauacgaccggcagagaaugcgacagcugucugugggagugcggcaagaacaaacugaucgugaagacacaugggccuaagguugucuacgcuaccgccugcucccacggaucuuguaaaagcgugaugcagaagcccgcgacauucguguaucuuccuuaccccggcaauuccgagauugucgggggagacaucggcauucacaugaccgaagagucuagcccguccaacauccaucucguggcccacugcccugcucgggauucuugugacguuagcgauugccuguuuugugugcaugggcugcucaauuaucaaugccacacgcuguucuccgcccuucugaucagcaccacagucaugucuauucucacccugcugcuucuccuggugaaaggcgcuaaggaccugguuaaaaagcucuuucacuggcugaucacaccccuuuguuggcuguccguguucugcuguugggucguuaagagcuggaaacgcagaguuggaucugccauuucccggaccaacgauacgaucggcuggagagaaaaucgccggcaugcgcaggacauugagagagcccaguacacagggggagcuccuggcgccaaguauagcuuuuacggggugaugauccucggacugcugucuuccgcucaaagcugcuccgagagcgucaucgccgauucuaaaauuaugcaguguaccacaagcggcuccucuacccuuugcaaggccagcgggaccgugaucaugcgccucggccccauuggauccgaaucuugccugauccugaaaggccucaaggacagcgagaagcaguucauuuccaucaaaacaaucucuagcgaacugacguguagagagggggaauccuuuuggaccacacuuuauaccccuauuugccugagcucucggcgcugucaccucaugggagagugcguguccgauagaugucugaaguggaaaacaaaccagaccagcgcugagcugacgggcaaggcgcauggggacgucaugcacgaaaaccggugcuucgagcaaucuggaggcaucggguacggcuguuuuaauguuaaccccuccugccuuuacgugcauagcuaucucaaauccguguaccgcaauggauucaaggucuuuagauguguggccuggaaccaccggauucgccuggaaguuacaacccacucuagaaaguucccgauggugcugauggcuaugagcacccagccuacagauuggggcuccaucgggcucauucuggacagcgagggaaucaccggcacaaauucuuauuccuucaugaaacaugggagcggaucuuuugccaucauugaugaccccuacagccccgaaccucggaagggcuuccuuggggagguccgcugcccgacggaggaaaccgccaugagagcuucccccucuuguaaaauggccccuaaccugaucgaguaucagcccgaaauggacacagcggagugcaccacaaauaugauugauccuauggcuaucuuuaaccggggcagccucccccaggugagagacggaaugaccuucacgcaauccauugaaaagaauaccguucaggcccugacaaccggcgaggugaaagccucuauccgccugauucuugaugacuacgaugucguguaucagaacagccaguccgacugcagcgcuacauuuaagaaucugaccggguguuacucuugcgaugagggaucccggcucuguuaccaaguuaaagccgaaggcgagacaaucuuccacuuuaucaacgaagaggagagcauuaaugugaucaacaaggucuccccuggggugucugacuauugcaccgugcugcauuucagcagacccgucauuuccaucgaaggaacguacgauuguggccucucuaagcgcccgaugguuauuaaaggcacacugaucgcgaccgcuccucacgacgaucggaagcaugaagggggaagcucccuuguggugaaucccaaaggcgggagcgucgacuuuuucggauggcugucuggccucaccuccuggcuugggggaccucugaagacauuucugaccauccugggcuuccucgccgugggccugcuccugguugugauuaucauuaucauuaucagaacggggaugcagcaggcccuuaaaaagaagaucaaauga

SEQ ID NO: 14697 - RNA, 4020 nt, Artificial Sequence
  derived and/or modified CDS sequence (opt5) from TOSV(A189)__KP694241.1__GP
auguucaucgccaagcugcuccugauuagcugccuugugcagcaggcuuaccugaaauauaccaucauuuccgagaucggcaacgggacaagaacgucuagcuguuacuccucucggaccagccucggaucccugcuugaagccugggauaauauuacagagucuaucggccugaccagcgggacaugcaaggucggaucccucgaaaaccgcgauuguaaaagagacaucaugagcaauuauguugcggaggugcacucuaaccugcauggccugggggcuaugaugcacaauuacggagaugacaagcggguggaaguccucaacgaugugauucccgacgagcugaauccuggccgccauaacugcuccgaucuugacagaaaaccguuuuggaccgaguucaucaauguugcccggcccacaaacaagauggccccuaugagcgugauucccccucccaucgucaagccuauuccgguggcugaacccaccaucgagaaaacgauuccuuuugauaagcugcucucugaagccgagaaagagcugaaucagaccaagauccgccuugaagcugagagacgguccaacgccgaagaggcggccaaagaacgcgcuagaaugcgggagaucgaggacaagcugcgcaaggauugggaacucgagagagaacggaaagacgccguugcugaugaccuggccaaggagauugcgcgcagacgggaaaucgagagaaaagcccacgagcuggacaagaugcucaaaaagaaagaacgcgaggaucugguggcucgggaaagagucagcgaggacaugcgcaaucaugugcggagacccaacacaaccauugccccugcucccacaaucauuaccacgcuucugauggccucugccgugauggcuggcccgcucgaaaaucgcgagacaaaccaucugcuuaaccggccugggaauggagcguauacccuguccgauuucgccgagagcacauguacccucgcuuacggcuccgaaugcaagucuugggagcaccagcuggacgaacugagcuuucccuucuuucacuccaaccucgauaaguauagcaugcuggaggccgccaccgagacagucccuauccuuaauaaaucuuccgcuguuuguacgaucuaccacccccgcauucauagaauggccugcgggcgggaagcgagccugaucaagaaaaaguguggaucuaacaugagcgcuuucuuuuacgugaaucucgccggccagauuaccguggucaaaugcgacacaaaccacgugcuguccaaugauugugggaacugcaucucuaagacccuuagcggacaaaagauuuauacacccguucaggacauguucugccagaaaggcuggaccgaguccaucccuaauacgagauacagcaaggaucuguguucuaucggccuccacacagugaaagaaugcaagaccgggaccacaaacuuugagcgcgucggauucauugugguuaaaggccggaagauguauaucgaacagaugaagaugagaucccggcaagaguuuagcgaggaccaguuccuguguuacaaaucugaauccagcuccgggucuagcgugaagcugaaaaaggucaaaguggaguccugcaagggagucaccacaucuagcgccuccaaguguagcggcgaugaauauuucugcucucgcuacccgugugagacggcuaauguggaagcccauugcauucucagacggcacuccgcuguuaucgaggugaacgucaaugggguguggguugugcccagauguauuggauaugaggaaguccuggugcgccggaccagccuuaaaguggaggacacaucuuccagagaaugcgacaccugucugugggagugcggcaagaacaaacucaucguuaagacacauggcccuaaaauugucuacgccaccgcgugcagccacgggucuuguaagagcgugaugcagaaacccgccacguuuguguaccugccuuaucccggaaauuccgaaaucgucggcggggauaucggagugcauaugaccgaggagagcucuccguccaacauucacaugguugcucacugcccugccaaggacagcugugaaguguccucuugccuguucuguguccauggccuucucaacuaccagugccacacacuguuuagcgcucugcucaucuccaccacagugaugucuauucugacccuucugcuccugcugaugcgcggggccaaggaucuuguuaaaagacucuucuauuggcugaucacgccccuguguuggcucagcguguuuugcuccuggaugauuaagucuuggaaaaagcgggucggcagcgcgaucucccgcacaaaugacaccaucggauggagagauaaccggcgcuacggccaagacguggagagagcccaguauacagggggagcuccuggcgccaaauacagcuucuaugggguuaugauucugggacuucugggcaaugugcauucuuguuccgaaagcguccucgcugauucuaagaucaugcagugcaccaccuccgggagcucuacacuguguaaggccuccggcacggugauuaugaaacugggacccaucggcagcgaguccugccuuauucucaaggggcugaaagacagcgagaagcaauuuaucucuaucaaaaccauuagcuccgaacugacaugccgggagggagaaucuuucuggaccacacucuacaccccugugugucugagcucccgcagaugccaccuuaugggcgagugugucucugaucggugccugaaguggaagacgaacgaaacaagcgccgaguuuaccgggaaagcucacggagagguuaugcaugaaaaucgcuguuucgagcaguccggcgggaucggcuacggaugcuuuaacgugaaucccucuugucucuaugugcacagcuaccugaaguccgucuauaaaaacggcuucaagauuuuuagaugcguggcguggaaucaucggaucagacuggaaguuaccacacacagccgcaaauucccgauggugcuuauggccaugucuacccagccuacagacuggggguccauuggacucauccuggauagcgagggcaucacggggaccaacgcuuacucuuucaugaagcauggauccggcagcuuugccauuaucgacgaucccuauucccccgaaccucggaagggguuccugggcgaggucagauguccgacagaggaaaccgccauucgcgcuucucccagcugcaaaauggccccuaaucucaucgaguaccagcccgaaauggacacagcggaguguaccacgaacaugauugacccuauggcuaucuuuaaucggggaucccugccccaagugagagauggcaugaccuucacacagagcauugaaaagaacaccguucaggcccuuacaaccggggaggugcgcgccucuauccggcugacacucgacgauuaugacgucguguaccaaaauucccaaagcgauugcucugcuaccuuuaaaaaccugacgggaugcuacagcugugacgagggcuccagaaugugcuaucagguuaaggccgaaggggagacaaucuuccacuuugugaacgaagaugagucuauuaaugucaucaacaaagugagcccugacguguccgauuacuguaccguccugcacuucucucgccccguuauuagcaucgagggacgguaugacugcggccuuuccaagagaccgauggugauuaaaggcacccugaucgcgacagcuccucaugaugaccggaagcacgaagggggaagcucucucguggucaaucccaagggcgggaccguggacuuuuucggauggguuuccggccugacgagcuggcucgggggaccucugaaaacauuucuuaccauccugggcuuccucgcccugggccugcuucugguggucauuaucauuaucauugcccgcacaggggugcagcaggcucucaagaaaaagaacaaauga

SEQ ID NO: 14698 - RNA, 4020 nt, Artificial Sequence
  derived and/or modified CDS sequence (opt5) from TOSV(AR)__EF656362.1__GP
auguucaucgccaagcugcuccugauuagcugccuugugcagcaggcuuaccugaaauauaccaucauuuccgagaucggcaacgggacaagaacgucuuuuuguuacagcucccggaccucucucggaagccugcuugaggccugggacaaugucacagaguccauuggccugaccucugggacaugcaagguuggaagccucgaaaaccgcgauuguagaaaagacaucauguccaauuauguggcggaggugcacagcaaccugcauggccugggggcuaugaugcacaauuacggagaugacaagcgggucgaaauccucaacgaugugauucccgacgagcugaauccuggccaucacaacugcucugaucuugaccgcaaaccguucuggaccgaguuuaucaauguugccaagcccuccagcgaaauugugccuaugucugucauucccccucccgugguuaagcugcaaccuccggccgagcccuccagcaaaaagcaugugccuuucgauguccuccugucugaagcugagaaagagcuuaaccagacaaagaucagacuggaagacgagcggaaauccaaugccgaagagaccgcuaaggaacgcgccagaaugaaggagaucgaggaugaacuccggcgcgagugggaacuggagagaaaacggaaggacgcgauggccgaugaccuggcuaaagaaacggcccgcagacgggagauugagcgcaaggcucacgaacucgacagaaugcugaaaaagaaagagcgggaaagccuuaucgccaaggagaaggcggaugaagacaugagaucccacgugcauaaacccaacaccacacgcgccccugcucccaccaucauuacaacccugcucauggccucugcugcccuggccggcccgcuugagaaucgggagacgaaccaccuccucaauagaccugggaacggagcuuauacacugagcgauuuugcggaauccaccuguacacuggccuacggcagcgagugcaagucuugggaacaucuccugaacgaggagcuuuuccccuuuuuccacuccaaucuggacaaauauagcaugcucgaagcugccaccgagaccgugccuauccugaacaagucuagcgccgucuguacaauuucccccucuacgcacagcuccaaugcuugcgggcgcgaagccagcguuauccggaaaaaguguuacucuaacauguccgcguuuuucuacauuaaucuugcuggacagaucaccguggugaagugcgagacaaaccauguccugagcucugauuguggcaauugcaucuccaaaagccucuccgggcaaaagguguauacccccguucaggacguguuuugccagaaaggauggacacagucuauuccuagcaccagauacuccaaggauaucuguucuauuggccugcacacggucaaagaaugcaagaucggcacaaccagcuucgagcgcgugggguuuauuguugugaagggacggaaaauguauaucgagcaaaugaagaugagaucccgccaggaauacagcgaggaccaguuccuguguuauaaaucugaauccggcagcgggucuuccgucaagcucaaaaaguucaagguggagagcugcaaaggagucaccacaucuagcgccuccaaguguagcggcgaugaauacuuuugcaaccgguauccgugugagaccgccaauguggaggcucauugcauccugagacgccacucugccauuguugaagugaacgucaaugggguguggguugugccccgguguaucggauacgaggaaguccuugugaaaagaacaucccugaagguggaggacacgaccggccgggaaugcgauagcugucucugggagugcggcaaagacaagcugauuguuaaaacacaugggccuaaggucguguacgcuaccgccugcucccacggaucuuguaagagcgugaugcagaaacccgcgacauucgucuaucugccuuaccccggcaacuccgagaucguugggggagacauuggcauccacaugaccgaagagucuagcccguccaauauucaucuuguggcccacugcccugcuaaggauucuugugacgugagcgauugccucuuuuguguccaugggcugcugaacuaucaaugccacacgcuguucuccgcccugcuuaucagcaccacagugaugucuauccugacccuccugcugcuucucguuaaaggcgcuaaggaccuggugaaaaagcuguuuuacuggcucauuacaccccuguguuggcuuuccgucuucugcuguugggugguuaagagcuggaaacgcagagugggaucugccaucucccggaccaaugauacgauuggcuggagagaaaaccgccggcacgcgcaggacaucgagagagcccaguauacagggggagcuccuggcgccaaguacagcuuuuauggggucaugauucugggacuccugucuuccgcucaaagcugcuccgagagcgugaucgccgauucuaaaaucaugcaguguaccacaagcggcuccucuacccugugcaaggccagcgggaccgugauuaugcgccuuggccccaucggauccgaaucuugccucauucugaaaggccugaaggacagcgagaagcaguucaucuccauuaaaacaaucucuagcgaacucacguguagagagggggaauccuuuuggaccacacuguacaccccuaucugccuuagcucucggcgcugucaucugaugggagagugcgucuccgauagaugucucaaguggaaaacaaaccagaccagcgcugaguucacgggcaaggcgcacggggacguuaugcaugaaaaucggugcuuugagcaaucuggaggcauuggguacggcuguuucaacgugaaucccuccugccuguaugugcacagcuaccugaaauccgucuaucgcaacggauuuaagguguucagauguguugccuggauccaucggauucgccuugaagugacaacccacucuagaaaguucccgaugguccucauggcuaugagcacccagccuacagauuggggcuccaucgggcugauucuggacagcgagggaaucaccggcacaaauucuuacuccuuuaugaaacacgggagcggaucuuucgccaucauugaugaccccuauagccccgaaccucggaagggcuuucucggggaggugcgcugcccgacggaggaaaccgccaugagagcuucccccucuuguaaaauggccccuaaccugaucgaguaccagcccgaaauggacacagcggagugcaccacaaauaugauugauccuauggcuaucuucaaccggggcagccuuccccagguuagagacggaaugaccuuuacgcaauccauugaaaagaauaccgugcaggcccugacaaccggcgaggucaaagccucuauccgccucacacuggaugacuaugaugugguuuaccagaacagccaguccgacugcagcgcuaccuucaagaaucugacaggguguuacucuugcgaugagggaucccggcuuuguuaucaagugaaagccgaaggcgagaccgucuuucauuucauuaacgaagaggagagcaucaaugugaucaacaagguguccccuggggucucugacuacugcacgguucugcacuuuagcagacccgugauuuccaucgaaggaacauaugauuguggccucucuaagcgcccgauggugauuaaaggcacccugaucgcgaccgcuccucaugacgaucggaagcacgaagggggaagcucccucgucgugaaucccaaaggcgggagcguugacuucuuuggaugggugucuggccugacauccuggcuugggggaccucugaagaccuuccucacgauucugggcuuucuggccgucggccuucugcucgugguuaucaucauuaucauuaucagaacagggaugcagcaggcccugaaaaagaagauuaaauga

SEQ ID NO: 14699 - RNA, 4020 nt, Artificial Sequence
  derived and/or modified CDS sequence (opt5) from TOSV(EsPhGR40)__FJ153283.1__GP
auguucaucgccaagcugcuccugauuagcugccuugugcagcaggcuuaccugaaauauaccaucauuuccgagaucggcaacgggacaagaacgucuuuuuguuacagcucccggaccucucucggaagccugcuugaagccugggauaaugucacagaguccauuggccugaccucugggacaugcaagguuggaagccucgaaaaccgcgauuguggcaaagacaucauguccaauuauguggcggaggugcacagcaaccugcaugggcugggagcuaugaugcacaauuacggcgaugacaagagagucgaaauccucaacgaugugauucccgacgagcugaauccuggccaucacaacugcucugaucuugaccggaaaccguucuggaccgaguuuaucaauguugccaagccccuguccgaaauugccccuaugagcgugauucccccucccgucgugaagcuccagccuccggcugagcccucuuccaaaaagcauguuccuuucgaugugcugcuuagcgaagccgagaaagagcugaaccagacaaagauccgccucgaagacgagagaaaaucuaaugcugaagagaccgcccgggaacgcgcgagaaugcgggauaucgaggaggaacugcgcaaggagugggaacuggagagaaagcggaaagacgccauggcugaugaccucgccaaggaaacggcuaaacgcagagagauugagcggaaggcccacgaacuggaccgcaugcuuaaaaagaaagagagagaaucccugaucgcgaaggagaaggaagaugagaacaugcggagcagaguccacaaacccuccaccacacgcgccccugcucccaccaucauuacaacccuccugauggccucuacggcucuugccgggccgcuggagaaucgggaaacaaaccaucuccugaauagaccuggaaacggcgccuauacccugagcgacuuugcugaguccacauguacccucgcguacgggagcgaaugcaagucuugggagcaucugcuuaacgaggaacuguuccccuuuuuccacuccaaucucgauaaauauagcaugcuggaggccgcuaccgaaacagugccuauccuuaacaagucuagcgccguguguacgauuucccccucuacccacagcuccaaugccugcggacgcgaggcuagcgucauccggaaaaaguguuacucuaacauguccgcccuguuuuacauuaaucucgcgggccagaucacaguugugaagugcgaaaccaaccacgugcugagcucugacugugggaauugcaucuccaaaagccuguccggacaaaaggucuauacacccgugcaggauguuuucugccagaaaggcuggaccgagucuauuccuagcacgagauacuccaaggacaucuguucuauuggccuccauacagugaaagagugcaagaucgggaccaccagcuuugaacgcgucggauucauugugguuaagggccggaaaauguauaucgagcagaugaagaugagaucccgccaagaauacagcgaggaucaguuucuguguuauaaaucugaauccgggagcggaucuuccgugaaacuuaaaaaguucaaggucgagagcugcaaaggcgugacaaccucuagcgcuuccaaguguagcggggacgaguacuucugcucucgguauccgugugaaacagccaacgucgaggcccacugcauccugagacgccauuccgcuauuguggaaguuaaugugaacggagucugggugguuccccgguguaucggcuacgaggaagugcucgucaaaagaacgagccugaagguggaggauaccacagagcgggaaugcgacuccugucugugggagugcggcaaaaauaaacuuauugugaagacccacgggccuaagguugucuacgccacagcuugcucucauggaagcuguaaguccgugaugcagaaacccaccacguuuguguaucucccuuaccccggcaacucugaaaucgucgggggagauauuggcauccacaugaccgaggagagcuccccgucuaauauucaccugguggcccauugcccugcgcgcgacagcugugacguuuccgauugccuguucugugugcacgggcuccugaacuaucagugccauacacuuuuuagcgcccugcucaucucuaccacagucauguccauccugacccugcuucuccugcuggugaagggcgcuaaagaccucguuaagaaacuguucuacuggcuuauuacgccccuguguuggcucagcguguuuugcuguugggucgugaagucuuggaagagacggguuggauccgccaucagcagaacaaaugauaccauuggcuggcgcgaaaaccggagauaugcucaagacaucgagcgcgcccaguacacagggggagcgccuggcgccaaauauucuuucuacggggugaugauucugggacugcuuuccagcgcucaguccugcagcgaaucugucaucgccgauagcaagaucaugcaauguaccaccuccggcucuagcacacucugcaaggcuuccgggacggugauuaugagacugggccccaucggaucugagagcugccugauucucaagggccugaaagacuccgaaaagcaguuuaucucuauuaagaccaucagcuccgagcuuacaugucgggagggggagagcuucuggaccacacuguacaccccuaucugccucucuucccgcagaugucaccugaugggagaaugcgugagcgaucggugucugaaauggaagacgaacgaaacaucugccgaguuuaccggcaaagcccacggggacgucaugcaugaaaauaagugcuucgagcaguccggaggcauuggguauggcuguuuuaacguuaaucccagcugccuuuacgugcacuccuaucucaaaucuguguaccgcaacggauucaagaucuuuagaugugucgcuuggaaucaucggauucgccuggaggugaccacacagagcagaaaguucccgaugguucugauggcgauguccacccaaccuacagauuggggcagcaucgggcucauucuggacucugaaggaaucacgggcaccaacuccuauagcuucaugaaacacgggucuggcagcuuugccaucauugaugaccccuacucccccgagccucggaagggauuccuuggggaagugcgcugcccgacagaggaaaccgcuaugagagccucucccagcuguaaaauggccccuaaucugaucgaguaucagcccgagauggauacagcugaaugcaccacgaacaugauugacccuauggccaucuuuaaucggggcucccucccccaggucagagacggaaugaccuucacacagucuauugagaagaacaccgugcaagcgcugacaaccggcgaaguuaaagcuagcauccgccugacacuugaugacuacgauguggucuaccaaaauucccagagcgacugcucugccaccuuuaagaaccugacgggguguuauuccugcgaugagggaagccggcucuguuaccaggugaaagccgagggcgaaacaguuuuccauuuuauuaaugaggaagaguccaucaacgugaucaauaaggucucuccugacgugagcgauuauugcaccgugcugcacuucuccagacccauuaucucuauugaagggaccuacgacuguggacucagcaagcgcccgauggucaucaaaggcacacugauugcuaccgccccucacgaugaccggaagcaugagggcggguccagccuuguugugaaccccaaaggaggcucuguggacuuuuucggguggcuguccggacucacgagcuggcugggcgggccucugaagacauuucuuaccauccugggauuccucgcggucggccugcuccuggugguuaucauuaucauuaucauuagaacaggcaugcaacaggcucuuaaaaagaagaucaaauga

SEQ ID NO: 14700 - RNA, 4014 nt, Artificial Sequence
  derived and/or modified CDS sequence (opt5) from TOSV(SI-121283)__JF330279.1__GP
auguucaucgccaagcugcuccugauuagcugccuugugcagcaagccuaccugaaauauaccaucauuuccgagaucggcaacgggacaagaacgucuuuuuguuacagcucccggaccucucucggaagccugcuugaagccugggacaauauuacagaguccaucggccugaccucugggacaugcaaggucggaagccucgaaaaccgcgaguguaaaagagauaucauguccaauuauguugcggaagugcacagcaaccugcauggccugggggcuaugaugcacaauuacggagacgauaagcggauugaggugcucaacgacgucauccccgaugagcugaauccuggccgccauaacugcucugaccuugauagaaaaccguucuggaccgaauuuauuaauguggccaagcccgccaacgagauggcuccuauguccguuaucccuccucccauugugaagccuaucccggucgccgaaagcacaaccaaaaagacgauucccuucgacaaacugcucucugaggcugagaaggaacugaaucagaccaaaauccggcuugagacagaacgcagauccaacgccgaggaagcggccaaggagcgggcucgcaugagagagaucgaagauaagcugcggaaagacugggagcucgaacgcgagagaaaggaugccguggcugaagaccuggccaaagagauugcgcggcgcagagagaucgaacggaaggcccacgagcuggauaaaaugcucaagaaaaaggaaagagaggaccugguugcucgcgaacggguggacgaggauaugagaaaucauguccgccggccuaacaccacaauugcccccaccaucauuacgacacuucugaugggcagcgcugugauggccgggccucucgagaauagagaacccacccaucugcuuaaccgcccgggaaacggcgccuauccucugucugacuuugcugagcccacauguacccucgcguacggguccgaaugcaagagcugggagcaccagcuggaugagcuguccuuccccuuuuuccacucuaaucucgacaaauauagcaugcuggaagccgcuaccgagacaauccccauccuuaacaaguccagcgccguguguacgauuucucccuccacccacagcucuaaugccugcggacgggaagcuagccugaucaaaaagaaauguggcuccgauaugucugccuuuuucuacgucaaccucgcggggcagauuacaguugugaagugcgacaccaaucaugugcugagcaacgauuguggaaauugcaucuccaagacacuuagcggccagaaaauuuacaccccuguccaggacauguuuugccagaagggcuggucugaguccaucccgagcacgagauauucuaaagaucuguguuccaucgggcuccacacagugaaggaaugcaaaauuggaaccaccaacuucgagcgcguuggcuuuaucguggucaaggggcggaagauguacauugagcagaugaaaaugagaagccgccaagaauuuuccgaggaccaguuccuguguuauaagucugaaggaagcuccggcucuagcgugaaacugaagaaaguuaagguggaguccugcaagggggucacaaccagcucugcuuccaaauguagcggagaugaauacuuuugcucucgguaucccugugagacagccaauguggaggcccacugcauccucagacggcauuccgcugucauugaagugaacguuaauggcgugugggucgugccucgcuguaucggcuacgaggaaguucuggugagacggacgagccuuaaggucgaggacaccucuagcagagaaugcgacacaugucugugggagugcgggaaaaacaagcucauugugaaaacccacggacccaagaucguguaugccacagcuugcucccauggcagcuguaaaucuguuaugcagaagccugccaccuucgucuaccugcccuacccggggaacuccgagaucgugggaggcgauauuggggugcacaugacggaagagagcuccccuucuaauauccauauggucgcgcacugccccgccaaggacagcugugaaguguccucuugccuguuuuguguucacggccuucucaauuaucagugccauacccuguucagcgcucugcucauuuccacaaccgugaugucuauccugacacuucugcuccugcuggucaaaggagccaaggaucuugugaaacgccucuuuuacuggcugauuaccccucuguguuggcucagcguuuucugcggcuggaugauccgguccuggaagaaaagaguggggagcgcuaucucucgcacgaacgacacaauuggauggagagauaacucccggcgcggccaagacaucgagagagcccaguauaccgggggagcgcccggcgccaaguacagcuuuuauggggucaugauucugggccuucugggaaaugugcacucuuguuccgagagcaucauugcugauucuaagaucaugcagugcacaaccuccggcagcuccacccucuguaaagccagcgggacaguuaucaugaagcugggaccuauuggcucugaaagcugccugauccuuaaagggcucaaggacuccgagaaacaauucauuucuaucaagacgauuagcuccgaacugaccugccgggagggagaaucuuuuuggacaacccuguacacacccgugugucucagcucccgcagaugccaucugaugggcgagugugucucugaucggugccuucgcuggaagaccaacgagacgagcgcugaguucacagggaaagcccacggcgaagugaugcacgaaaauagauguuuugagcaguccggaggcaucggguauggaugcuucaacgugaauccgagcugucuguacguccauucuuaccucaaguccguuuauaaaaacggcuuuaagaucuuccggugcguggccuggaaucaccgcauuagacuggaagugaccacccauagccggaaauucccuaugguccugauggcuaugucuacacagcccaccgacuggggguccaucggacuuauucucgauagcgagggcaucacagggacgaacgcguacuccuuuaugaagcacggccugggaucuuucgccauuaucgacgaucccuauagcccugagccgagaaagggcuuucugggggaagugcgcugucccaccgaggaaacagcuauucgggccuccccuagcugcaaaauggcccccaaucucaucgaguaccagccugaaauggacaccgcugaguguacaaccaacaugaucgaccccauggccauuuucaauagaggaucucugccucaaguucgcgauggcaugacguuuacccaguccaucgagaagaacacagugcaggcgcuuaccacaggggaaguccgggcuagcauuagacugacccucgacgauuaugacgugguuuaccaaaauucucaauucgauugcagcgccacauuuaaaaaccugaccggaugcuauuccugugacgagggcucucgcaugugcuaccaggugaaggccgaaggcgagacgaucuuccauuuugucaaugaggaugaaagcauuaacgugaucaacaaaguuucccccgacgugucugauuacuguacaguccugcacuucagccggccggugaucuccauugaggggagauaugacugcggacuuagcaagcgcccuauggugaucaaaggcacccugauugcuaccgcuccccacgaugaccggaagcaugaagggggaucuucccucgucguuaauccuaagggcgggacaguggauuucuucggaugggugagcggccugaccuccuggcucggcgggccccugaaaacguuucuuacaauccugggauuccucgcgcugggccugcuucuggucgugauuaucaucauuaucgcuagaaccgggguugagcaggcccucaagaaaaagaacaaauga

SEQ ID NO: 14701 - RNA, 4014 nt, Artificial Sequence
  derived and/or modified CDS sequence (opt5) from TOSV(SI-121487)__JF330280.1__GP
auguucaucgccaagcugcuccugauuagcugccuugugcagcaggcuuaccugaaauauaccaucauuuccgagaucggcaacgggacaagaacgucuuuuuguuacagcucccggaccucucucggaagccugcuugaagccugggacaauauuacagaguccaucggccugaccucugggacaugcaaggucggaagccucgaaaaccgcgaguguaaaagagauaucauguccaauuauguugcggaagugcacagcaaccugcauggccugggggcuaugaugcacaauuacggagacgauaagcggauugaggugcucaacgacgucauccccgaugagcugaauccuggccgccauaacugcucugaccuugauagaaaaccguucuggaccgaauuuauuaauguggccaagcccgccaacgagauggcuccuauguccguuauucccccucccaucgugaagccuaucccggucgccgaaagcacaaccaaaaagacgauucccuucgacaaacugcucucugaggcugagaaggaacugaaucaaaccaaaaucaugcuugagacagaacggcgcuccaacgccgaggaagcggccaaggagagagcucggaugcgcgagaucgaagauaagcugagaaaagacugggagcucgaacgggagcgcaaggaugccguggcugaagaccuggccaaagagauugcgagacggcgcgagaucgaaagaaaggcccacgagcuggauaaaaugcucaagaaaaaggaacgggaggaccugguugcuagagaacgcguggacgaggauaugcggaaucaugucagacgcccuaacaccacaauugcccccaccaucauuacgacacuucugauggcuagcgccgugauggccggcccucucgagaaucgggaaaucaaccaucugcuuaacuggcccgggaauggagcuuauacccugucugacuuugcggaguccacauguacccucgccuacggcagcgaaugcaaguccugggagcaccagcuggaugagcugucuuucccguuuuuccacagcaaccucgacaaauauuccaugcuggaagcugccaccgagacaaucccuauucuuaauaagagcucugccguguguacgaucucccccagcacccacucuagcaacgcuugcgggagagaagccucccugauuaaaaagaaauguggaucugauaugagcgcguuuuucuacgucaaucucgcuggccagaucacaguugugaagugcgacaccaaccaugugcuguccaaugauugugggaacugcauuagcaagacacuuucuggacaaaagaucuacaccccuguccaggacauguuuugccagaagggcugguccgagagcauccccucuacgcgcuauuccaaagaucuguguagcauuggccuccacacagugaaggaaugcaaaaucgggaccaccaauuucgagcggguuggauuuauuguggucaagggcagaaagauguacaucgagcagaugaaaaugcgcucccggcaagaauuuucugaggaccaguuccuguguuauaagagcgaaggguccucuggaagcuccgugaaacugaagaaaguuaagguggagagcugcaagggcgucacaaccucuuccgccagcaaauguucuggggaugaauacuuuugcuccagauaucccugugagacagccaacguggaggcucacugcauucuccgccggcauagcgccgucaucgaagugaauguuaacggagugugggucgugccuagauguauuggcuacgaggaaguucuggugcggcgcacgucucuuaaggucgaggacaccagcuccagagaaugcgacacaugucugugggagugcggcaaaaauaagcucaucgugaaaacccacgggccgaagaucguguaugcuacagccugcagccauggaucuuguaaauccguuaugcagaagcccgcgaccuucgucuaccugccuuaccccggcaacagcgagauugucgggggagauaucggcgugcacaugacggaagaguccucuccuagcaauauucauaugguggcccacugccccgcuaaggacuccugugaagugucuagcugccuguuuuguguucacgggcuucucaacuaucagugccauacccuguucuccgcccugcucaucucuacaaccgugaugagcauucugacacuucugcuccugcuggucaaaggcgcuaaggaucuugugaaacggcucuuuuacuggcugaucaccccgcuguguuggcucuccguuuucugcggauggaugaucagaagcuggaagaaacgcgugggcucugccauuucccggacgaacgacacaaucggguggagagauaauagccgcagaggacaagacauugagcgggcgcaguauaccggcggggccccuggagcuaaguacucuuuuuauggcgucaugauccuggggcuucugggcaacgugcacuccuguagcgagucuauuaucgccgauuccaagaucaugcagugcacaaccagcggauccagcacccucuguaaagcuagcggcacaguuauuaugaagcuggggcccaucggaagcgaauccugccugauucuuaaaggccucaaggacucugagaaacaauucaucagcauuaagacgaucuccucugaacugaccugccgcgagggggaaucuuuuuggacaacccuguacacaccugugugucucuccucuagacggugccaucugaugggagagugugucagcgaucgcugccuuagauggaagaccaaugagacguccgccgaguucacaggcaaagcccacggggaagugaugcacgaaaaccgguguuuugagcagagcggcggaaucggcuaugggugcuucaaugugaaccccucuugucuguacguccauuccuaccucaagagcguuuauaaaaauggauuuaagauuuuccgcugcguggcuuggaaccacagaauccggcuggaagugaccacccauucucgcaaauucccuaugguccugauggcgauguccacacagcccaccgacuggggcagcauugggcuuauccucgauuccgagggaauuacaggcacgaaugccuacucuuuuaugaagcacgggagcggcuccuucgcuaucauugacgauccguauagcccugagcccagaaagggauuucugggcgaagugcggugucccaccgaggaaacagccaucagagccucuccuuccugcaaaauggcuccgaaccugaucgaguaccagcccgaaauggacaccgccgaguguacaaccaauaugauugacccuauggcgaucuucaaccgcgggagccucccccaaguucgggauggaaugacguuuacccagucuauugagaagaauacagugcaggcucugaccacaggcgaagucagagccagcauccgccuuacccuggacgauuaugacgugguuuaccagaacucccaauucgauugcucugccacauuuaaaaaucucaccgggugcuauagcugugacgagggaucccggaugugcuaccaggugaaggcugaaggcgagacgauuuuccauuuugucaacgaggaugaaucuaucaacgugaucaauaaaguuagcccugacguguccgauuacuguacaguccugcacuucagcagacccgugauuucuaucgagggccgcuaugacugcgggcuguccaagcggccuauggugauuaaaagcacccuuaucgccaccgcgccccacgaugacagaaagcaugaaggaggcuccucucuggucguuaacccgaaagggggaacaguggauuucuucggcugggugagcgggcucaccuccuggcugggaggcccucucaaaacguuucugacaauucuuggcuuccuggcucucgggcugcugcuugucgugaucaucauuaucauugcccgcaccggaguucagcaggcccugaagaaaaagaauaaauga

SEQ ID NO: 14702 - RNA, 4014 nt, Artificial Sequence
  derived and/or modified CDS sequence (opt5) from TOSV(SI-21137)__EU003173.1__GP
auguucaucgccaagcugcuccugauuagcugccuugugcagcaggcuuaccugaaauauaccaucauuuccgagaucggcaacgggacaagaacgucuuuuuguuacagcucccggaccucucucggaagccugcuugaagccugggacaauauuacagaguccaucggccugaccucugggacaugcaaggucggaagccucgaaaaccgcgaguguaaaagagauaucauguccaauuauguugcggaagugcacagcaaccugcauggccugggggcuaugaugcacaauuacggagacgauaagcggauugaggugcucaacgacgucauccccgaugagcugaauccucgcagacauaacugcucugaccuugaucggaaaccguucuggaccgaauuuauuaauguggccaagcccgccaacgagaucgcuccuauguccguuauucccccucccaucgugaagccuauuccggucgccgaaagcacaaccaaaaagacgauccccuucgacaaacugcucucugaggcugagaaggaacugaaucaaaccaaaauccgccuugagacagaaagacgguccaacgccgaggaagcggccaaggagcgcgcuagaaugcgggagauugaagauaagcugcgcaaagacugggagcucgaaagagagcggaaggaugccguggcugaagaccuggccaaagagaucgcgcgcagacgggagauugaaagaaaggcccacgagcuggauaaaaugcucaagaaaaaggaacgcgaggaccugguugcucgggaaagaguggacgaggauaugcgcaaucauguccggagaccuaacaccacaaucgcccccaccauuaucacgacacuucugauggcuagcgccgugauggccggcccucucgagaaucgcgaaaccaaccaucugcuuaaccggcccggcaauggggcuuauacacugucugacuuugcggaguccaccuguacccucgccuacggaagcgaaugcaaguccugggagcaccagcuggaugagcugucuuucccguuuuuccacagcaaccucgacaaauauuccaugcuggaagcugccacagagacgaucccuauucuuaauaagagcucugccguguguaccaucucccccagcacacacucuagcaacgcuugcggcagagaagccucccugauuaaaaagaaaugugggucuaauaugagcgcguuuuucuacgucaaccucgcuggacagaucaccguugugaagugcgauacaaaucaugugcuguccaacgacuguggcaauugcauuagcaagacccuuucugggcagaaaaucuacacgccuguccaagauauguuuugccagaagggaugguccgagacaaaccccagcacccgcuauucuaaagaccuguguuccaucggccuccacaccgugaaggaaugcaaaauuggcacaaccaauuucgagcgggagggguuuaucguugugaagggaagaaagauguacauugaacagaugaaaaugcgcagccggcaagaguucuccgaagaucaguuccuguguuauaagucugagggcagcuccgggucuagcgucaaacugaagaaagugaagguugaauccugcaagggagugacaacgagcucugccuccaaauguagcggcgacgaguacuuuugcucuagauaucccugugagaccgccaacgucgaagcucacugcauccuccggcgccauuccgccgugauugaggucaaugugaacgggguuuggguggucccuagauguaucggauacgaagaggugcugguucggagaacaagccuuaagguggaagauaccucuagccgcgagugcgacacaugucugugggagugcggcaaaaauaagcucauugucaaaacccacggcccgaagaucguguaugcuacggccugcucccaugggagcuguaaaucugugaugcagaagcccgcgaccuucguuuaccugccuuaccccggaaacuccgaaaucgucggcggggacauuggagugcacaugacagaggaaagcuccccuucuaacauccauaugguggcccacugccccgcuaaggauagcugugaggucuccucuugccuguuuugugugcacggccuucucaauuaucagugccauacccuguucagcgcccugcucauuuccacaaccguuaugucuauccugacgcuucugcuccugcuggugaaaggggcuaaggaccuugucaaacggcucuuuuacuggcugauuacaccgcuguguuggcucagcguguucugcggcuggaugaucagauccuggaagaaacgcguuggaagcgccaucucuagaaccaacgauacaauuggcuggcgggacaauucccgcagagggcaagauaucgagcgggcgcaguauaccggaggcgccccuggggcuaaguacagcuuuuauggagugaugauucugggccuucuggggaacguccacucuuguuccgaaagcaucauugccgacucuaagaucaugcagugcaccacauccggcagcuccacgcucuguaaagcuagcggaaccgugaucaugaagcugggccccauugggucugagagcugccugauccuuaaaggacucaaggauuccgaaaaacaauucauuucuaucaagacaauuagcuccgagcugaccugccgcgaaggcgagucuuuuuggacaacccuguacacgccuguuugucucagcuccagacggugccaucugaugggggagugugugucugaccgcugccuuagauggaagacaaaugaaaccagcgccgaguucaccggaaaagcccacggcgaagucaugcacgagaaccgguguuuugaacaguccgggggcaucggauauggcugcuucaaugugaaccccagcugucuguacgugcauucuuaccucaaguccgucuauaaaaauggguuuaagaucuuccgcugcguugcuuggaaccaccggauuagacuggaggugacaacccauagcagaaaauucccuauggugcugauggcgaugucuacacagcccacggauuggggauccaucggccuuauucucgacagcgggggaaucaccggcacaaaugccuacuccuuuaugaagcacgggcugggcucuuucgcuauuaucgaugacccguauagcccugagccccgcaagggauuucugggcgaaguccggugucccaccgaggaaacagccauuagagccuccccuagcugcaaaauggcuccgaaccucaucgaguaccagcccgaaauggauaccgccgaguguacgaccaauaugaucgacccuauggcgauuuucaaccgcgggucucugccccaagugcgggacggaaugacauuuacccaguccaucgagaagaauacaguucaggcucuuaccacaggcgaagugagagccagcauucgccugacccucgaugacuaugaugucguguaccagaacucucaauucgacugcagcgccacguuuaaaaaccugacagggugcuauuccugugaugagggaucucggaugugcuaccagguuaaggcugaaggcgagaccaucuuccauuuugugaaugaggacgaaagcauuaacgucaucaauaaaguguccccugauguuucugacuacuguaccgugcugcacuucagcagacccgucaucuccauugagggccgcuaugauugcgggcuuagcaagcggccuauggugaucaaaggaacacugauugccaccgcgccccacgacgauagaaagcaugaaggcgggucuucccucguggucaacccgaagggaggcacgguugacuuuuucgggugggugagcggacugacauccuggcucggcggcccucugaaaaccuuucuuacaauccugggguuccucgcucugggacugcuucugguggucauuaucaucauuaucgcccggaccggcguggagcaggcccucaagaaaaagaauaaauga

SEQ ID NO: 14703 - RNA, 4014 nt, Artificial Sequence
  derived and/or modified CDS sequence (opt5) from TOSV(SI-31051)__EU003174.1__GP
auguucaucgccaagcugcuccugauuagcugccuugugcagcaggcuuaccugaaauauaccaucauuuccgagaucggcaacgggacaagaacgucuuuuuguuacagcucccggaccucucucggaagccugcuugaagccugggacaauauuacagaguccaucggccugaccucugggacaugcaaggucggaagccucgaaaaccgcgaguguaaaagagauaucauguccaauuauguugcggaagugcacagcaaccugcauggccugggggcuaugaugcacaauuacggagacgauaagcggauugaggugcucaacgacgucauccccgaugagcugaauccuggccgccauaacugcucugaccuugauagaaaaccguucuguaccgaauuuauuaauguggccaagcccgccaacgagauggcuccuauguccguuaucccuccucccauugugaagccuaucccggucgccgaacccacaaccaaaaagacgauuccuuucgacaaacugcucagcgaggcugagaaggaacugaaucaaaccaaaauccggcuugagacagaacgcagaucuaacgccgaggaagcggccaaggagcgggcucgcaugagagagaucgaagauaagcugcggaaagacugggagcucgaacgcgagagaaaggaugccguggcugaagaccuggccaaagagauugcgcggcgcagagagaucgaacggaaggcccacgagcuggauaaaaugcucaagaaaaaggaaagagaggaccugguugcucgcgaacggguggacgaggauaugagaaaucauguccgccggcccaacaccacaauugccccuaccaucauuacgacacuucugauggcuuccgccgugauggccggcccccucgagaauagagaaaccaaccaucugcuuaaccgcccggggaauggagcuuauacacugagcgacuuugcggagucuaccugcacccucgccuacggcuccgaauguaagagcugggagcaccagcuggaugagcuguccuuccccuuuuuccacucuaaccucgacaaauauagcaugcuggaagcugccacagagacgauccccauccuuaauaaguccagcgccgugugcaccauuucuccuuccacacacagcucuaacgcuugugggcgggaagccagccugaucaaaaagaaaugcggauccgauaugucugcguuuuucuacgucaaucucgcuggccagauuaccguugugaagugugacacaaaccaugugcugagcaaugauugcgggaacugcaucuccaagacccuuagcggacagaaaauuuacacgcccguccaagacauguuuugucagaagggcuggucugaguccauccccagcacaagauauucuaaagaucugugcuccaucggccuccacaccgugaaggaauguaaaauugggaccacaaauuucgagcgcguuggauuuaucguggucaagggccggaagauguacauugagcagaugaaaaugagaagccgccaagaguucuccgaggaccaguuccugugcuauaagucugaagggagcuccggaucuagcgugaaacugaagaaaguuaagguggaguccuguaagggcgucaccacaagcucugccuccaaaugcagcggggaugaauacuuuuguucucgguauccuugcgagacggccaacguggaggcucacuguauccucagacggcauuccgccgucauugaagugaauguuaacggagugugggucgugccgcgcugcaucggcuacgaggaaguucuggugagacggaccagccuuaaggucgaggacacaucuagcagagaaugugauaccugccugugggagugcggcaaaaauaagcucauugugaaaacacacgggcccaagaucguguaugcuaccgccuguucccauggaagcugcaaaucuguuaugcagaagccugcgacguucgucuaccugcccuacccuggcaacuccgagaucgucgggggagauauuggcgugcacaugaccgaagagagcucccccucuaauauccauaugguggcccacuguccggcuaaggacagcugcgaaguguccucuugucuguuuugcguucacgggcuucucaacuaucagugucauacacuguucagcgcccugcucauuuccaccacagugaugucuauccugacccuucugcuccugcuggucaaaggcgcuaaggaucuugugaaacgccucuuuuacuggcugauuacgccucugugcuggcucagcguuuucuguggauggaugauccgguccuggaagaaaagagugggcagcgccaucucucgcacaaacgacaccauuggguggagagauaauucccggcgcggacaagacaucgagagagcgcaguauacaggcggggcccccggagcuaaguacagcuuuuauggcgucaugauucuggggcuucugggcaacgugcacucuugcuccgagagcaucauugccgauucuaagaucaugcaguguaccaccuccggaagcuccacacucugcaaagcuagcggcacgguuaucaugaagcuggggccuauuggaucugaaagcugccugauccuuaaaggccucaaggacuccgagaaacaauucauuucuaucaagaccauuagcuccgaacugacaugucgggagggggaaucuuuuuggaccacacuguacacccccgugugccucagcucccgcagaugucaucugaugggagagugcgucucugaucggugucuucgcuggaagacgaaugagacaagcgccgaguucaccggcaaagcccacggggaagugaugcacgaaaacagaugcuuugagcaguccggcggaaucggcuauggguguuucaaugugaacccuagcugccuguacguccauucuuaccucaaguccguuuauaaaaauggauuuaagaucuuccgguguguggcuuggaaccaccgcauuagacuggaagugaccacacauagccggaaauuccccaugguccugauggcgaugucuacccagccgacagacuggggcuccaucgggcuuauucucgauagcggaggcaucacggggaccaaugccuacuccuuuaugaagcacggccugggaucuuucgcuauuaucgacgauccuuauagccccgagcccagaaagggcuuucugggggaggugcgcugcccuacagaagagaccgccauucgggccuccccgagcuguaaaauggcucccaaccucaucgaauaccagccugagauggacacagccgaaugcaccacgaauaugaucgaccccauggcgauuuucaacagaggaucucugccucaaguucgcgauggcaugaccuuuacacaguccaucgagaagaauaccgugcaggcucuuacaaccggggagguccgggccagcauuagacugacacucgacgauuaugacgugguuuaccagaacucucaauucgauugcagcgccaccuuuaaaaaucugacgggauguuauuccugcgacgaaggcucucgcauguguuaccaggugaaggcugagggcgaaacaaucuuccauuuugucaacgaggaugagagcauuaacgugaucaauaaaguuucccccgacgugucugauuacugcaccguccugcacuucagccggccugugaucuccauugaagggagauaugacuguggacuuagcaagcgccccauggugaucaaaggcacccugauugccacagcgccgcacgaugaccggaagcaugaagggggaucuucccucgucguuaacccuaagggcgggaccguggacuuuuucggaugggugagcggccugacguccuggcucggcgggccccugaaaacauuucuuaccauccugggauuccucgcucugggccugcuucuggucgugauuaucaucauuaucgccagaacagggguugaacaggcccucaagaaaaagaauaaauga

SEQ ID NO: 14704 - RNA, 4014 nt, Artificial Sequence
  derived and/or modified CDS sequence (opt5) from TOSV(SI-39538)__EU003175.1__GP
auguucaucgccaagcugcuccugauuagcugccuugugcagcaggcuuaccugaaauauaccaucauuuccgagaucggcaacgggacaagaacgucuuuuuguuacagcucccggaccucucucggaagccugcuugaagccugggauaauauuacagaguccaucggccugaccucugggacaugcaaggucggaagccucgaaaaccgcgaguguaaaagagauaucauguccaauuauguugcggaagugcacagcaaccugcauggccugggggcuaugaugcacaauuacggagacgauaagcggauugaggugcucaacgacgucauccccgaugagcugaauccuggccgccauaacugcucugaccuugauagaaaaccguucuggaccgaauuuauuaauguggccaagcccgccaacgagauggcuccuauguccguuauucccccucccaucgugaagccuaucccggucgccgaaagcacaaccaaaaagacgauucccuucgacaaacugcucucugaggcugagaaggaacugaaucaaaccaaaauccggcuugagacagaacgcagauccaacgccgaggaagcggccaaggagcgggcucgcaugagagagaucgaagauaagcugcggaaagacugggagcucgaacgcgagagaaaggaugccguggcugaagaccuggccaaagagauugcgcggcgcagagagaucgaacggaaggcccacgagcuggauaaaaugcucaagaaaaaggaaagagaggaccugguugcucgcgaacggguggacgaggauaugagaaaucauguccgccggccuaacaccacaauugcccccaccaucauuacgacacuucugauggcuagcgccgugauggccggcccucucgagaauagagaaaccaaccaucugcuuaaccgccccgggaauggagcuuauacacugucugacuuugcggaguccaccuguacccucgccuacggcagcgaaugcaaguccugggagcaccagcuggaugagcugucuuucccguuuuuccacagcaaccucgacaaauauuccaugcuggaagcugccacagagacgaucccuauccuuaauaagagcucugccguguguaccauuucccccagcacacacucuagcaacgcuugcgggcgggaagccucccugaucaaaaagaaauguggaucugauaugagcgcguuuuucuacgucaaucucgcuggccagauuaccguugugaagugcgacacaaaccaugugcuguccaaugauugugggaacugcaucagcaagacccuuucuggacagaaaauuuacacgccuguccaagacauguuuugccagaagggcugguccgagagcauccccucuacaagauauuccaaagaucuguguagcaucggccuccacaccgugaaggaaugcaaaauugggaccacaaauuucgagcgcguuggauuuaucguggucaagggccggaagauguacauugagcagaugaaaaugagaucccgccaagaguucucugaggaccaguuccuguguuauaagagcgaaggguccucuggaagcuccgugaaacugaagaaaguuaagguggagagcugcaagggcgucaccacaucuuccgccagcaaauguucuggggaugaauacuuuugcucccgguaucccugugagacggccaacguggaggcucacugcauccucagacggcauagcgccgucauugaagugaauguuaacggagugugggucgugccucgcuguaucggcuacgaggaaguucuggugagacggaccucucuuaaggucgaggacacaagcuccagagaaugcgacaccugucugugggagugcggcaaaaauaagcucauugugaaaacacacgggccgaagaucguguaugcuaccgccugcagccauggaucuuguaaauccguuaugcagaagcccgcgacguucgucuaccugccuuaccccggcaacagcgagaucgugggaggagauauuggcgugcacaugaccgaagaguccucuccuagcaauauccauauggucgcccacugccccgcuaaggacuccugugaagugucuagcugccuguuuuguguucacgggcuucucaacuaucagugccauacacuguucuccgcccugcucauuucuaccacagugaugagcauccugacccuucugcuccugcuggucaaaggcgcuaaggaucuugugaaacgccucuuuuacuggcugauuacgccgcuguguuggcucuccguuuucugcggauggaugauccggagcuggaagaaaagagugggcucugccaucucccgcacaaacgacaccauuggguggagagauaauagccggcgcggacaagacaucgagagagcgcaguauacaggcggggccccuggagcuaaguacucuuuuuauggcgucaugauucuggggcuucugggcaacgugcacuccuguagcgagucuaucauugccgauuccaagaucaugcagugcaccaccagcggauccagcacacucuguaaagcuagcggcacgguuaucaugaagcuggggcccauuggaagcgaauccugccugauccuuaaaggccucaaggacucugagaaacaauucauuagcaucaagaccauuuccucugaacugacaugccgggagggggaaucuuuuuggaccacacuguacaccccugugugucucuccucucgcagaugccaucugaugggagagugugucagcgaucggugccuucgcuggaagacgaaugagacauccgccgaguucaccggcaaagcccacggggaagugaugcacgaaaacagauguuuugagcagagcggcggaaucggcuaugggugcuucaaugugaaccccucuugucuguacguccauuccuaccucaagagcguuuauaaaaauggauuuaagaucuuccggugcguggcuuggaaccaccgcauuagacaugaagugaccacacacucucggaaauucccuaugguccugauggcgauguccacccagcccacagacuggggcagcaucgggcugauucuugauuccggaggcaucacggggaccaaugccuacucuuuuaugaagcauggccucgggagcuucgcuauuaucgacgauccguauuccccugagcccagaaagggcuuucugggggaggugcgcugucccacagaagagaccgccauucgggccagcccuucuugcaaaauggcuccgaaccugaucgaauaccagcccgagauggacacagccgaauguaccacgaauaugaucgacccuauggcgauuuucaacagaggaucccucccccaaguucgcgauggcaugaccuuuacacagagcaucgagaagaauaccgugcaggcucugacaaccggggagguccgggccucuauuagacuuacacuggacgauuaugacgugguuuaccagaacagccaauucgauugcuccgccaccuuuaaaaaucucacgggaugcuauucuugugacgaaggcagccgcaugugcuaccaggugaaggcugagggcgaaacaaucuuccacuuugucaacgaggaugaguccauuaacgugaucaauaaaguuucuccugacgugagcgauuacuguaccguccugcacuucucccggcccgugaucagcauugaagggagauaugacugcggacugucuaagcgcccuauggugaucaaaggcacccuuauugccacagcgccccaugaugaccggaagcacgaagggggauccagccuggucguuaacccgaagggcgggaccguggacuuuuucggauggguguccggccucacgucuuggcugggcgggccucucaaaacauuucugaccauccuuggauuccuggcucucggccugcugcuugucgugauuaucaucauuaucgccagaacagggguugaacaggcccugaagaaaaagaauaaauga

SEQ ID NO: 14705 - RNA, 4014 nt, Artificial Sequence
  derived and/or modified CDS sequence (opt5) from TOSV(SI-40463)__EU003176.1__GP
auguucaucgccaagcugcuccugauuagcugccuugugcagcaagccuaccugaaauauaccaucauuuccgagaucggcaacgggacaagaacgucuuuuuguuacagcucccggaccucucucggaagccugcuugaagccugggauaauauuacagaguccaucggccugaccucugggacaugcaaggucggaagccucgaaaaccgcgaguguaaaagagauaucauguccaauuauguugcggaagugcacagcaaccugcauggccugggggcuaugaugcacaauuacggagacgauaagcggguggagguccucaacgacgugauucccgaugagcugaauccuggccgccauaacugcucugaccuugauagaaaaccguucuggaccgaauuuaucaauguugccaagcccgugaacgagauggccccuauguccgucauucccccucccaucgugaagccuauuccgguugcugaaagcacaaccaaaaagacgauccccuucgacaaacugcucucugaggccgagaaggaacugaaucagaccaaaauucggcuugagacagaacgcagauccaacgcugaggaagccgcgaaggagcgggcccgcaugagagagaucgaagauaagcugcggaaagacugggagcucgaacgcgagagaaaggaugcuguggccgaagaccuggcuaaagagaucgcccggcgcagagagauugaacggaaggcgcacgagcuggauaaaaugcucaagaaaaaggaaagagaggaccuggucgcccgcgaacggguggacgaggauaugagaaaucaugugcgccggccuaacaccacaaucgcucccaccauuaucacgacacuucugauggccagcgcugucauggccggcccucucgagaauagagaaaccaaccaucugcuuaaccgccccgggaauggagccuauacacugucugacuuugcugaguccaccuguacccucgcguacggcagcgaaugcaaguccugggagcaccagcuggaugagcugucuuucccguuuuuccacagcaaccucgacaaauauuccaugcuggaagccgcuacagagacgauuccuauccuuaauaagagcucugccguuuguaccaucucccccagcacacacucuagcaacgccugcgggcgggaagcuagccugauuaaaaagaaauguggaucugauaugagcgccuuuuucuacgugaaucucgcgggccagaucaccguggucaagugcgacacaaaccaugugcuguccaaugauugugggaacugcauuagcaagacccuuucuggacagaaaaucuacacgccuguucaagacauguuuugccagaagggcugguccgagagcauucccucuacaagauauuccaaagaucuguguagcaucggccuccacaccgugaaggaaugcaaaaucgggaccacaaauuucgagcgcgucggauuuauugugguuaagggccggaagauguacaucgagcagaugaaaaugagaucccgccaagaguucucugaggaccaguuccuguguuauaagagcgaaggguccucuggaagcuccgugaaacugaagaaagucaagguggagagcugcaagggcgucaccacaucuuccgcuagcaaauguucuggggaugaauacuuuugcucccgguaucccugugagacggccaacguggaggcccacugcauucucagacggcauagcgcuguuaucgaagugaaugucaacggaguguggguugugccucgcuguauuggcuacgaggaaguccuggugagacggaccucucuuaagguggaggacacaagcuccagagaaugcgacaccugucugugggagugcggcaaaaauaagcucaucguuaaaacacacgggccgaagauugucuaugccaccgcuugcagccauggaucuuguaaauccgugaugcagaagcccgccacguucguguaccugccuuaccccggcaacagcgagaucgucgggggagauaucggcgugcacaugaccgaagaguccucuccuagcaauauucauaugguugcgcacugccccgccaaggacuccugugaagugucuagcugccuguuuuguguccacgggcuucucaacuaucagugccauacacuguucuccgcucugcucaucucuaccacagugaugagcauucugacccuucugcuccugcugguuaaaggcgccaaggaucuugugaaacgccucuuuuacuggcugaucacgccgcuguguuggcucuccgucuucugcggauggaugauucggagcuggaagaaaagagugggcucugcuaucucccgcacaaacgacaccaucggguggagagauaauagccggcgcggacaagacauugagagagcccaguauacaggcggggcgccuggagccaaguacucuuuuuauggcguuaugauccuggggcuucugggcaacgugcacuccuguagcgagucuauuaucgcugauuccaagauuaugcagugcaccaccagcggauccagcacacucuguaaagccucuggcacggucaucaugaagcuggggcccaucggaagcgaauccugccugauucuuaaaggccucaaggacucugagaaacaauucaucagcauuaagaccaucuccucugaacugacaugccgggagggggaauccuuuuggaccacacuguacaccccugugugucucuccucucgcagaugccaucugaugggagagugugugagcgaucggugccuucgcuggaagacgaaugagacauccgcugaguucaccggcaaagcccacggggaagucaugcacgaaaacagauguuuugagcagagcggcggaauuggcuaugggugcuucaauguuaaccccucuugucuguacgugcauuccuaccucaagagcguguauaaaaauggauuuaagaucuuccggugcgucgccuggaaccaccgcaucagacuggaagugaccacacauucucggaaauucccuaugguucugauggcuauguccacccagcccacagacuggggcagcauugggcuuauccucgauuccggaggcauuacggggaccaaugcguacucuuuuaugaagcacggccugggcagcuucgccaucauugacgauccguauuccccugagcccagaaagggauuucugggggaggugcgcugucccacagaagagaccgcuauccgggccagcccuucuugcaaaauggccccgaaccucauugaauaccagcccgagauggacacagcugaauguaccacgaauaugaucgacccuauggccaucuucaacagaggaucccugccccaaguccgcgauggcaugaccuuuacacagagcauugagaagaauaccgugcaggcgcuuacaaccggggagguucgggcuucuaucagacugacacucgacgauuaugacguggucuaccagaacagccaauucgauugcuccgccaccuuuaaaaaucugacgggaugcuauucuugugacgaaggcagccgcaugugcuaccaggugaaggccgagggcgaaacaauuuuccauuuuguuaacgaggaugaguccaucaacgugauuaauaaagucucuccugacgugagcgauuacuguaccgugcugcacuucucccggcccgucaucagcaucgaagggagauaugacugcggacuuucuaagcgcccuaugguuauuaaaggcacccugaucgcuacagcuccccacgaugaccggaagcaugaagggggauccagccucguggugaacccgaagggcgggaccgucgacuuuuucggauggguguccggccugacgucuuggcucggcgggccucugaaaacauuucuuaccauucugggauuccucgcgcugggccugcuucugguugugaucauuaucaucauugcuagaacaggggucgaacaggcccucaagaaaaagaauaaauga

SEQ ID NO: 14706 - RNA, 4020 nt, Artificial Sequence
  derived and/or modified CDS sequence (opt5) from TOSV(SI-40614)__EU003177.1__GP
auguucaucgccaagcugcuccugauuagcugccuugugcagcaggcuuaccugaaauauaccaucauuuccgagaucggcaacgggacaagaacgucuuuuuguuacagcucccggaccucucucggaagccugcuugaagccugggacaauauuacagaguccaucggccugaccucugggacaugcaaggucggaagccucgaaaaccgcgauuguaaaagagacaucauguccaauuauguugcggaggugcacagcaaccugcauggccugggggcuaugaugcacaauuacggagaugacaagcggguggaaguccucaacgaugugauucccgacgagcugaauccuggccgccauaacugcucugaucuugacagaaaaccguucuggaccgaguuuaucaauguugccaagcccgccaacaagauugcuccuaucuccgugauucccccucccaucgucaaaccuauuccgaucgccgaaagcacaaucaagaaaaccauucccuucgauaagcugcucucugaggcugaaaaagagcugaaucaaacgaagauccggcuugagaccgaacgcagauccaacgccggcgaggcggcccgggaacgcgcuagaaugcgggagauugaagacaagcugcgcaaaaauugggagcucgagagagaacggaaggaugccguggcugacgaucuggccaaagagaucgcgcgcagacgggaaauugagagaaaggcccacgaacuggacaaaaugcucaagaaaaaggagcgcgaggaccagguugcuaucgaacgggugagcgaggauaugagaaaccauguccgccggccuaauacaaccaucgcccccgcuccuacaauuaucaccacgcugcuuauggccucugccgugauggcugggccccuggaaaacagagagacaaaccaccuccugaaucgcccgggaaacggcgcguauacccuuuccgacuuugccgaaagcacauguacccuggcuuacggguccgagugcaagucuugggagcaccagcucgaugaacugagcuuccccuuuuuccauuccaaucuggacaaauauagcaugcucgaggccgccaccgaaacaauuccuauccugaacaagucuuccgcuguguguacgauuagcccuucuacccacagcuccaaugccugcggacgggaggcgucucuuaucaaaaagaaauguggcaacaauaugagcgccuuuuucuacgucaaccuggcugggcaaaucacaguugugaagugcgauaccaaucaugugcucuccaacgacuguggaaauugcauuagcaagacacugucuggccagaaaaucuacacccccguccaggauauguuuugccagagaggcuggacggaguccauucccagcacacgcuauucuaaggaccuuuguuccaucgggcugcacaccgugaaagaaugcaagaccggagccacaaacuucgagcggguuggcuuuauuguggucaaaagcagaaagauguacaucgaacaaaugaagaugcgcucccggcaggaguucucugaagaucaguuccucuguuauaaaagcgaguccucuagcggguccagcgugaagcugaaaaagguuaaaguggagucuugcaagggagucaccacauccagcgcuucuaaguguuccggcgacgaauacuuuugcagcagauauccuugugagacggccaauguggaagcucacugcauucugcggcgccauucugccgucaucgaggugaacguuaauggggugugggucgugccgagauguaucggauacgaagagguucucgugcggagaaccagccugaaaauggaggauacauccagccgcgaaugcgacaccugucuuugggagugcggcaagaacaaacugauugucaagacacacggccccaaaaucguguaugcgaccgccugcucucauggguccuguaagagcgugaugcagaaaccugcuacguucguuuaccuccccuacccuggaaacuccgaaauugucggcggggacaucggagugcacaugaccgaggaaucuagccccuccaauauucauaugguggcccacugcccggcuaaggauucuugugaggucagcuccugccuguuuugugugcacggccugcuuaacuaucaaugccauacacucuucucugcccugcugaucagcaccacaguuauguccauccucacccugcuucugcuccuggugaagggggcgaaagaccuggucaagaaacucuuuuacuggcuuauuacgccucuguguuggcugagcguguucugcggcuggaugaucaagucuuggaaaaagcggguuggauccgccauuagcagaacaaaugauaccaucggcuggcgcgacaacagacgguaugggcgcgauguggagagagcucaguacacaggaggcguccccggggccauuuauucuuuuuacggagugaugauccucggccugcuugggaauguucacuccuguagcgaaucugugaucgcugacuccaaggucaugcagugcaccaccagcggcuccagcacacuguguaaagccucuggaacggugauuaugaagcucggcccuaucgggagcgaguccugccugauucugaaaggacuuaaggauaacgaaaaacaauucaucucuauuaagaccaucagcuccgagcucacaugccgggagggcgaaucuuuuuggaccacacuguauacccccgugugucugagcucccgcagaugccaucucaugggggagugugucucugaccggugccugaaguggaaaacgaaugaaacaagcccugaguucaccggaaaggcccacggcgaaguuaugcacgagaaccgcuguuuugagcaguccgggggcaucggauacggcugcuucaaugugaaccccagcugucuuuacgugcauucuauucugaaauccgucuauaagaauggguuuaaaaucuucagaugcguggcuuggaaccaccggauucgccucgaaguuaccacacauagcagaaaguucccgauggugcugauggcgaugucuacccagccuacagauuggggauccaucggccugauucuugacagcgaggggaucacgggaaccaaugccuacuccuuuaugaagcacggcucugggagcuucgcuauuaucgaugaccccuauucccccgaaccucggaaaggcuuucucggagaggucagauguccgacagaagagaccgccauccgcgccagccccucuugcaagauggcuccuaaccugauugaguaccagcccgaaauggauacagccgaguguaccacgaauaugaucgacccuauggcgauuuucaaccggggcucccugccccaagugagagacgggaugaccuuuacacagagcaucgagaaaaacaccguucaggcucucacaaccggagaagugcgcgccucuauucggcugacacuugaugacuaugaugucguguaccagaauagccaauccgacugcucugccaccuucaagaaccugacgggcugcuauagcugugaugaaggguccagaaugugcuaccagguuaaagcugagggagagacaaucuuucauuucgugaaugaagacgagucuaucaacgucauuaauaaggugagcccugauguguccgacuacuguaccguccuccacuuuagccgccccguuaucucuauugaaggccgguaugauugcggccuguccaaaagaccgauggugaucaaggggacccugauugccacagcgccucacgacgaucgcaagcaugagggaggcagcucccuuguggucaaccccaaagggggaaccguggacuucuuuggcuggguuucugggcugacgagcuggcucggaggcccucugaagacauuccucaccauccugggcuuucuugcucuggggcuccugcugguggucaucauuaucauuaucgcccggacaggaguggagcaggcccuuaaaaagaaaaauaaguga

SEQ ID NO: 14707 - RNA, 4014 nt, Artificial Sequence
  derived and/or modified CDS sequence (opt5) from TOSV(SI-51903)__EU003178.1__GP
auguucaucgccaagcugcuccugauuagcugccuugugcagcaggcuuaccugaaauauaccaucauuuccgagaucggcaacgggacaagaacgucuuuuuguuacagcucccggaccucucucggaagccugcuugaagccugggacaauauuacagaguccaucggccugaccucugggacaugcaaggucggaagccucgaaaaccgcgaguguaaaagagauaucauguccaauuauguugcggaagugcacagcaaccugcauggccugggggcuaugaugcacaauuacggagacgauaagcggauugaggugcucaacgacgucauccccgaugagcugaauccuggccgccauaacugcucugaccuugauagaaaaccguucuggaccgaauuuauuaauguggccaagcccgccaacgagaucgcuccuauguccguuauucccccucccaucgugaagccuauuccggucgccgaaagcacaaccaaaaagacgauccccuucgacaaacugcucucugaggcugagaaggaacugaaucaaaccaaaauccggcuugagacagaacgcagauccaacgccgaggaagcggccaaggagcgggcucgcaugagagagauugaagauaagcugcggaaagacugggagcucgaacgcgagaagaaagaugccguggcugaagaccuggccaaggagaucgcgagacggcgcgagauugaaagaaaagcccacgagcuggauaagaugcucaaaaagaaggaacgggaggaccugguugcuagagaacgcguggacgaggauaugcggaaucaugucagacgcccuaacgccaccaucgcucccacaauuaucaccacgcuucugauggccagcgccgugauggcuggcccucucgagaaucgggaaacaaaccaucugcuuaacagacccgggaauggagcguauacccugucugacuuugccgaguccacauguacccucgcuuacggcagcgaaugcaaauccugggagcaccagcuggaugagcugucuuucccguuuuuccacagcaaccucgacaaguauuccaugcuggaagccgccaccgagacaaucccuauucuuaauaaaagcucugcuguguguacgaucucccccagcacccacucuagcaacgccugcgggcgcgaagcgucccugauuaagaaaaaguguggaucugauaugagcgcuuucuucuacgucaaucucgccggccagaucacaguugugaagugcgacaccaaccaugugcuguccaaugauugugggaacugcauuagcaaaacacuuucuggacaaaagaucuacaccccuguccaggacauguuuugccagaaaggcugguccgagagcauccccucuacgcgguauuccaaggaucuguguagcauuggccuccacacagugaaagaaugcaagaucgggaccaccaauuucgagagaguuggauuuauuguggucaagggccgcaaaauguacaucgagcagaugaagaugcgguccagacaagaauuuucugaggacgaauuucuguguuauaaaagcgagggguccucuggaagcuccgugaagcugaaaaagguuaagguggaaagcugcaaaggcgucacaaccucuuccgccagcaaguguucuggggaugaguacuuuugcucccgcuaucccugugagacagcuaacguggaagcccacugcauucuccggagacauagcgcugucaucgaggugaauguuaacggagugugggucgugccucgguguauuggcuacgaagagguucuggugcgcagaacgucucuuaaagucgaagacaccagcucccgggagugcgacacaugucugugggagugcggcaagaauaaacucaucgugaagacccacgggccgaaaaucguguaugccacagcgugcagccauggaucuuguaaguccguuaugcagaagcccgccaccuucgucuaccugccuuaccccggcaacagcgaaauugugggaggagauaucggcgugcacaugacggaggaauccucuccuagcaauauucauauggucgcucacugccccgccaaagacuccugugaggugucuagcugccuguuuuguguucacgggcuucucaacuaucagugccauacccuguucuccgcucugcucaucucuacaaccgugaugagcauucugacacuucugcuccugcuggucaagggcgccaaagaucuugugaagagacucuuuuacuggcugaucaccccgcuguguuggcucuccguuuucugcggauggaugauccgcagcuggaaaaagcgggugggcucugcgauuuccagaacgaacgacacaaucggguggcgcgauaauagcagacggggacaggacgucgagcgcgcccaauauaccggcggggcuccuggagccaaguacucuuuuuauggcgugaugauucuggggcuucugggcaacguucacuccuguagcgaaucuaucauugcugauuccaaaaucaugcagugcacaaccagcggauccagcacccucuguaaggccucuggcacagugaucaugaaacuggggcccauuggaagcgaguccugccugauccuuaagggccucaaagacucugaaaagcaguucauuagcaucaagacgauuuccucugagcugaccugcagagaaggggagagcuuuuggacaacccuguacacaccugucugucucuccucucggcgcugccaucugaugggagagugugugagcgauagaugccuucgguggaaaaccaaugaaacguccgccgaguucacaggcaaggcucacggggaagugaugcacgagaaccgcuguuuugaacaaagcggcggaaucggcuaugggugcuucaaugucaaccccucuugucuguacguucauuccuaccucaaaagcguguauaagaauggauuuaaaaucuucagaugcguggcguggaaccaccggauucgccuggaggucaccacccauucuagaaaguucccuauggugcugauggccauguccacacagcccaccgacuggggcagcaucgggcuuauucucgauuccggaggcaucacagggacgaaugcuuacucuuuuaugaagcacggccuggggagcuucgccauuaucgacgauccguauuccccugagccccggaaaggcuuucugggggaaguuagaugucccaccgaggaaacagccauucgcgcuagcccuucuugcaagauggccccgaaccucaucgaguaccagcccgaaauggacaccgcggaguguacaaccaauaugaucgacccuauggcuauuuucaaccggggaucccugccccaggugagagauggcaugacguuuacccaaagcaucgagaaaaauacaguccaggcccuuaccacaggggaagugcgcgccucuauucggcugacccucgacgauuaugacguuguguaccagaacagccaguucgauugcuccgcuacauuuaagaaucugaccggaugcuauucuugugacgagggcccuagaaugugcuaccaagucaaagccgaaggcgagacgaucuuccauuuugugaacgaggaugaaagcauuaacguuaucaauaaggugucccccgacgucucugauuacuguacagugcugcacuucagccgcccugugaucuccauugaggggcgguaugacugcggacuuagcaaaagacccauggucaucaagggcacccugauugcgaccgcuccgcacgaugaccgcaagcaugaagggggaucuucccucguugugaacccuaaaggcgggacaguggauuucuucggaugggucagcggccugaccuccuggcucggcgggccccugaagacguuucuuacaauccugggauuccucgcccugggccugcuucuggugguuauuaucaucauuaucgcccggaccgggguggagcaggcucucaaaaagaaaaauaaguga

SEQ ID NO: 14708 - RNA, 4014 nt, Artificial Sequence
  derived and/or modified CDS sequence (opt5) from TOSV(SI-68809)__EU003179.1__GP
auguucaucgccaagcugcuccugauuagcugccuugugcagcaggcuuaccugaaauauaccaucauuuccgagaucggcaacgggacaagaacgucuuuuuguuacagcucccggaccucucucggaagccugcuugaagccugggacaauauuacagaguccaucggccugaccucugggacaugcaaggucggaagccucgaaaaccgcgaguguaaaagagauaucauguccaauuauguugcggaagugcacagcaaccugcauggccugggggcuaugaugcacaauuacggagacgauaagcggauugaggugcucaacgacgucauccccgaugagcugaauccuggccgccauaacugcucugaccuugauagaaaaccguucuggaccgaauuuauugacguggccaagcccgccaaugagaucgcuccuauguccguuauucccccucccaucgugaagccuauuccggucgccgaaagcacaaucaaaaagaccauccccuucgauaaacugcucucugaggcugaggaagaacugaaccaaacgaagauucggcuugaaaccgagcgcagauccaaugccgaagaggcggccaaagagcgggcucgcaugagagaaaucgaggacaagcugcggaaggauugggaacucgagcgcgaaagaaaagacgccguggcugaggaucuggccaaggagauugcgcggcgcagagaaaucgagcggaaagcccacgaacuggacaagaugcucaaaaagaaagagagagaagaccugguugcucgcgagcgggugaacgaggauaugagaaaucauguccgccggccuaacacaaccauugcccccacaaucaucaccacgcuucugauggcuagcgccgugauggccggcccucucgaaaauagagagacaaaccaucugcuuaaccgccccgggaauggagcuuauacccugucugacuuugcggaauccacauguacccucgccuacggcagcgagugcaaguccugggagcaccagcuggaugaacugucuuucccguuuuuccacagcaaccucgacaaguauuccaugcuggaggcugccaccgaaacaauuccuauccuuaauaaaagcucugccguguguacgauuucccccagcacccacucuagcaacgcuugcgggcgggaggccucccugaucaagaaaaaguguggaucuaauaugagcgcguuuuucuacgucaaccucgcuggccagauuacaguugugaaaugcgauaccaaucaugugcuguccaacgacugugggaauugcaucagcaagacacuuucuggacaaaagaucuacaccccuguccaggauauguuuugccagaaaggcugguccgaaagcauucccucuacgagauauuccaaggaccuguguagcaucggccuccacacagugaaagagugcaagaccgggaccacaaacuucgagcgcguuggauuuauuguggucaaaggccggaagauguacaucgaacagaugaagaugagaucccgccaagaguucucugaagaucaguuccuguguuauaaaagcgagggguccucuggaagcuccgugaagcugaaaaagguuaaaguggaaagcugcaagggcgucaccacaucuuccgccagcaaguguucuggggacgaguacuuuugcucccgguaucccugugagacggccaauguggaagcucacugcauucucagacggcauagcgccgucaucgaggugaacguuaauggagugugggucgugccucgcuguauuggcuacgaagagguucuggugagacggaccucucuuaaagucgaagauacaagcuccagagagugcgacaccugucugugggagugcggcaagaacaaacucaucgugaagacacacgggccgaaaaucguguaugcuaccgccugcagccauggaucuuguaaguccguuaugcagaaacccgcgacguucgucuaccugccuuaccccggcaauagcgaaauugugggaggagacaucggcgugcacaugaccgaggaauccucuccuagcaacauucauauggucgcccacugccccgcuaaggauuccugugaggugucuagcugccuguuuuguguucacgggcuucucaacuaucagugccauacacuguucuccgcccugcucaucucuaccacagugaugagcauucugacccuucugcuccugcuggucaagggcgcuaaagaccuugugaagcgccucuuuuacuggcugaucacgccgcuguguuggcucuccguuuucugcggauggaugauccggagcuggaaaagacgcgugggcucugccauuuccagaacaaaugauaccaucggguggcgggacaacagccgcagaggacaagaugucgagcgggcgcaguauacaggcggggccccuggagcuaaguacucuuuuuauggcgugaugauucuggggcuucugggcgaaguucacuccuguagcgagucuaucauugccgacuccaaaaucaugcagugcaccaccagcggauccagcacacucuguaaggcuucuggcacggugaucaugaagcuggggcccauuggaagcgaauccugccugauccuuaaaggccucaaggauucugagaaacaauucauuagcaucaagaccauuuccucugaacugacaugccgcgagggggagagcuuuuggaccacacuguacaccccugucugucucuccucuagacggugccaucugaugggagaaugugugagcgaccgcugccuuaaauggaagacgaaugagacauccgccgaguucaccggcaaggcccacggggaggugaugcacgaaaacagauguuuugagcagagcggcggaaucggcuaugggugcuucaaugucaaccccucuugucuguacguucauuccuaccucaaaagcguguauaagaauggauuuaaaaucuuccggugcguggcuuggaaccaccgcauuagacuggaggucaccacacauucucggaaguucccuauggugcugauggcgauguccacccagcccacagauuggggcagcaucgggcuuauucucgacuccggaggcaucacggggaccaaugccuacucuuuuaugaaacacggccuggggagcuucgcuauuaucgaugacccguauuccccugaacccagaaagggcuuucugggggagguucgcugucccacagaagagaccgccauucgggccagcccuucuugcaagauggcuccgaaccucaucgaauaccagcccgagauggauacagccgaguguaccacgaauaugaucgacccuauggcgauuuucaacagaggaucccugccccaagugcgcgacggcaugaccuuuacacagagcaucgagaaaaauaccguccaggcucuuacaaccggggaggugcgggccucuauuagacugacacucgaugacuaugauguuguguaccagaacagccaauucgacugcuccgccaccuuuaagaaucugacgggaugcuauucuugugaugaaggcagccgcaugugcuaccaggucaaagcugagggcgagacaaucuuccauuuugugaacgaagacgaguccauuaacguuaucaauaaggugucuccugaugucagcgacuacuguaccgugcugcacuucucccggcccgugaucagcauugaagggagauaugauugcggacuuucuaaacgcccuauggucaucaagggcacccugauugccacagcgccccacgacgaucggaaacaugaagggggauccagccucguugugaacccgaagggcgggaccguggacuuuuucggaugggucuccggccugacgucuuggcucggcgggccucugaagacauuucuuaccauccugggauuccucgcucugggccugcuucuggugguuauuaucaucauuaucgccagaacagggguggaacaggcccucaaaaagaaaaauaaguga

SEQ ID NO: 14709 - RNA, 4014 nt, Artificial Sequence
  derived and/or modified CDS sequence (opt5) from TOSV(SI-76082)__EU003180.1__GP
auguucaucgccaagcugcuccugauuagcugccuugugcagcaggcuuaccugaaauauaccaucauuuccgagaucggcaacgggacaagaacgucuuuuuguuacagcucccggaccucucucggaagccugcuugaagccugggauaauauuacagaguccaucggccugaccucugggacaugcaaggucggaagccucgaaaaccgcgaguguaaaagagauaucauguccaauuauguugcggaagugcacagcaaccugcauggccugggggcuaugaugcacaauuacggagacgauaagcggauugaggugcucaacgacgucauccccgaugagcugaauccuggccgccauaacugcucugaccuugauagaaaaccguucuggaccgaauuuauuaauguggccaagcccgccaacgagauggcuccuauguccguuauucccccucccaucgugaagccuaucccggucgccgaaagcacaaccaaaaagacgauucccuucgacgagcugcucucugaggcugaaaaagagcugaaucaaaccaagauccggcuugaaacagagcgcagauccaacgccgaagaggcggccaaagagcgggcucgcaugagagaaaucgaggauaagcugcggaaggacugggaacucgagcgcgaaagaaaagaugccguggcugaggaccuggccaaggagauugcgcggcgcagagaaaucgagcggaaagcccacgaacuggauaagaugcucaaaaagaaagagagagaagaccugguugcucgcgagcggguggacgaggauaugagaaaucauguccgccggccuaacaccacaauugcccccaccaucauuacgacacuucugauggcuagcgccgugauggccggcccucucgaaaauagagagaccaaccaucugcuuaaccgccccgggaauggagcuuauacacugucugacuuugcggaauccaccuguacccucgccuacggcagcgagugcaaguccugggagcaccagcuggaugaacugucuuucccguuuuuccacagcaaccucgacaaguauuccaugcuggaggcugccacagaaacgaucccuauccuuaauaaaagcucugccguguguaccauuucccccagcacacacucuagcaacgcuugcgggcgggaggccucccugaucaagaaaaaguguggaucugauaugagcgcguuuuucuacgucaaucucgcuggccagauuaccguugugaaaugcgacacaaaccaugugcuguccaaugauugugggaacugcaucagcaagacccuuucuggacaaaagauuuacacgccuguccaggacauguuuugccagaaaggcugguccgaaagcauccccucuacaagauauuccaaggaucuguguagcaucggccuccacaccgugaaagagugcaagauugggaccacaaauuucgagcgcguuggauuuaucguggucaaaggccggaagauguacauugaacagaugaagaugagaucccgccaagaguucucugaagaccaguuccuguguuauaaaagcgagggguccucuggaagcuccgugaagcugaaaaagguuaaaguggaaagcugcaagggcgucaccacaucuuccgccagcaaguguucuggggaugaguacuuuugcucccgguaucccugugagacggccaacguggaagcucacugcauccucagacggcauagcgccgucauugaggugaauguuaacggagugugggucgugccucgcuguaucggcuacgaagagguucuggugagacggaccucucuuaaagucgaagacacaagcuccagagagugcgacaccugucugugggagugcggcaagaauaaacucauugugaagacacacgggccgaaaaucguguaugcuaccgccugcagccauggaucuuguaaguccguuaugcagaaacccgcgacguucgucuaccugccuuaccccggcaacagcgaaaucgugggaggagauauuggcgugcacaugaccgaggaauccucuccuagcaauauccauauggucgcccacugccccgcuaaggacuccugugaggugucuagcugccuguuuuguguucacgggcuucucaacuaucagugccauacacuguucuccgcccugcucauuucuaccacagugaugagcauccugacccuucugcuccugcuggucaagggcgcuaaagaucuugugaagcgccucuuuuacuggcugaugacgccgcuguguuggcucuccguuuucugcggauggaugauucggagcuggaaaaagagagugggcucugccaucucccgcacaaacgacaccaucggguggagagauaauagccggcgcggacaagacgucgagagagcgcaguauacaggcggggccccuggagcuaaauacucuuuuuauggcgugaugauucuggggcuucugggcaacguucacuccuguagcgaaucuaucauugccgauuccaagaucaugcagugcaccaccagcggauccagcacacucuguaaggcuucuggcacggugauuaugaaacuggggcccaucggaagcgaguccugccugauccuuaagggccucaaagacucugaaaagcaauucauuagcaucaaaaccauuuccucugagcugacaugccgggaaggggagagcuuuuggaccacacuguacaccccugucugucucuccucucgcagaugccaucugaugggagagugugugagcgaucggugccuucgcuggaagacgaaugaaacauccgccgaguucaccggcaaggcccacggggaagugaugcacgagaacagauguuuugaacagagcggcggaaucggcuaugggugcuucaaugucaaccccucuugucuguacguucauuccuaccucaaaagcguguauaagaauggauuuaaaauuuuccggugcguggcuuggaaccaccgcaucagacuggaggucaccacacauucucggaaguucccuauggugcugauggcgauguccacccagcccacagacuggggcagcaucgggcuuauucucgauuccggaggcaucacggggaccaaugccuacucuuuuaugaaacacggccuggggagcuucgcuauuaucgacgauccguauuccccugagcccagaaagggcuuucugggggaaguucgcugucccacagaggaaaccgccauucgggccagcccuucuugcaagauggcuccgaaccucaucgaguaccagcccgaaauggacacagccgaguguaccacgaauaugauugacccuauggcgaucuucaacagaggaucccugccccaagugcgcgauggcaugaccuuuacacagagcaucgagaaaaauaccguccaggcucuuacaaccggggaagugcgggccucuauuagacugacacucgacgauuaugacguuguguaccagaacagccaauucgauugcuccgccaccuuuaagaaucugacgggaugcuauucuugugacgagggcagccgcaugugcuaccaggucaaagcugaaggcgagacaaucuuccauuuugugaacgaggaugaauccauuaacguuaucaauaaggugucuccugacgucagcgauuacuguaccgugcugcacuucucccggcccgugauuagcaucgaggggagauaugacugcggacuuucuaaacgcccuauggucaucaagggcacccugauugccacagcgccccacgaugaccggaaacaugaagggggauccagccucguugugaacccgaagggcgggaccguggacuuuuucggaugggucuccggccugacgucuuggcucggcgggccucugaagacauuucuuaccauccugggauuccucgcucugggccugcuucuggugguuauuaucauuaucaucgccagaacagggguggagcaggcccucaaaaagaaaaauaaguga

SEQ ID NO: 14710 - RNA, 4020 nt, Artificial Sequence
  derived and/or modified CDS sequence (opt5) from TOSV(TOSV/Mantova.ITA/2013)__KM507329.1__GP
auguucaucgccaagcugcuccugauuagcugccuugugcagcaggcuuaccugaaauauaccaucauuuccgagaucggcaacgggacaagaacgucuuuuuguuacagcucccggaccucucucggaagccugcuugaggccugggauaauauuacagaguccaucggccugaccucugggacaugcaaggucggaagccucgaaaaccgcgauuguaaaagagacaucauguccaauuauguugcggaggugcacagcaaccugcauggccugggggcuaugaugcacaauuacggagaugacaagcggguggaaguccucaacgaugugauucccgacgagcugaauccuggccgccauaacugcucugaucuugacagaaaaccguucuggaccgaguuuaucaauguugccaagcccgccaacaagauugcuccuaucuccgugauucccccucccaucgucaaaccuauuccgaucgccgaaagcacaaucaaggagaccauucccuucgaaaaacugcucucugaggcugagaaggaacugaaucaaacgaaaauccggcuugagaccgaacgcagauccaacgccgaggaagcggcccgggagcgcgcuagagugcgggagauugaagauaagcugcgcaagaauugggagcucgaaagagagcggaaagacgccguugcugaugaccuggccaaggaaaucgcgcgcagacgggagauugagagaaaagcccacgaacuggauaagaugcucaaaaagaaagagcgcgaagaccagguggcuaucgagcgggucagcgaagacaugagaaaccaugugcgccggccuaauacaaccaucgcccccgcuccuacaauuaucaccacgcugcuuauggccucugccgugauggcuggcccccuggagaacagagagacaaaccaccuccugaaucgcccggggaacggagcguauacccuuuccgauuuugccgaaagcacauguacccuggcuuacggcuccgagugcaagucuugggaacaccagcucgacgagcugagcuuccccuuuuuccauuccaaucuggauaaguauagcaugcucgaggccgccaccgaaacaauuccuauccugaacaaaucuuccgcugucuguacgauuagcccuucuacccacagcuccaaugccugcgggcgggaggcgucucuuaucaagaaaaaguguggaaacaauaugagcgccuuuuucuacguuaaccuggcuggccaaaucacaguggugaaaugcgacaccaaucauguccucuccaacgauugugggaauugcuuuagcaagacacugucuggacagaagauuuacacccccgugcaggacauguucugccagagaggcuggacggaauccauccccagcacacgcuauucuaaagaucuuuguuccauuggccugcacaccguuaaggagugcaaaaccgggacaaccaacuuugaacgggugggauucaucgucguuaagagcagaaaaauguacauugagcaaaugaagaugcgcucccggcaggaguucucugaagaccaguuucucuguuauaagagcgaguccucuagcggcuccagcguuaaacugaagaaagugaaggucgaaucuugcaaaggggugacaacguccagcgccucuaaguguuccggagaugaguacuucugcagcagauauccuugugaaaccgcuaaugucgaggcccacugcauccugcggcgccauucugcugugauugagguuaacgugaauggcgucugggugguuccgagauguaucggguacgaagaggugcucguccggagaacaagccugaagauggaagacaccuccagccgcgagugcgauacaugucuuugggaaugcggcaaaaacaagcugaucgugaaaacccacggacccaagauuguguaugccacggcgugcucucauggcuccuguaaaagcguuaugcagaagccugccaccuuugucuaccuccccuacccugggaacuccgagaucgugggaggcgacauuggggugcacaugacagaggaaucuagccccuccaauauccauauggucgcucacugcccggccaaagacucuugugaggugagcuccugccuguucuguguucacggacugcuuaacuaucaaugccauacccucuuuucugcucugcugauuagcacaaccgugauguccauccucacgcugcuucugcuccuggucaagggcgccaaggaucuggugaagaaacuuuucuacuggcucaucacaccucuguguuggcugagcguguuuugcggguggaugauuaaaucuuggaagaaacgggugggcuccgcgaucagcagaaccaaugacacaauuggauggcgcgauaacagacgguauggccgcgacgucgaaagagcccaguacaccgggggagcucccggcgccaaguauucuuucuacggggugaugauccucggacugcuuggcaauguucacuccuguagcgagucugugauugcugauuccaaggucaugcagugcaccacaagcggguccagcacgcuguguaaagccucuggcaccgugaucaugaagcucggaccuaucggcagcgaguccugccugauucugaaagggcuuaaggacaacgaaaaacaauuuaucucuauuaagacaaucagcuccgagcugaccugccgggaaggagagucuuucuggacaacccucuauacgcccgugugucugagcucccgcagaugccaucucaugggcgaaugugucucugaucggugccugaaguggaaaacaaaugagaccagcgccgaguuuaccgggaaggcucacggagaaguuaugcacgagaaccgcuguuucgaacaguccggcgggauuggcuacggaugcuuuaaugugaacccuagcugucuuuacgugcauucuuaucugaaauccgucuacaagaauggcuucaaaaucuucagaugcguggcguggaaccaccggauccgccucgagguuacaacccauagcagaaaguuucccauggugcugauggccaugucuacacagccgacggacuggggguccauuggacugauccuugauagcgaaggcauuaccgggacaaaugcuuauuccuucaugaagcacggaucuggcagcuuugccaucauugacgauccuuacucccccgagccccggaaaggguuccucggcgaggucagauguccuaccgaagagacagccauccgcgcuagcccgucuugcaagauggcccccaaccugauugaauaucagccugagauggacaccgcggaauguacgaccaauaugaucgaucccauggcuaucuuuaaccggggaucccugccucaagugagagacggcaugacauucacccagagcauugagaaaaacacaguucaggcccucaccacaggggaggugcgcgccucuauccggcugacccuugacgauuacgacgucguguaucagaauagccaauccgauugcucugcuacguuuaagaaccugacaggaugcuacagcugugacgaaggcuccagaaugugcuaccagguuaaagccgagggggaaaccauuuuccauuuugugaaugaggaugagucuaucaacgucauuaauaaggugagccccgacguguccgauuauuguaccguccuccacuucagccgcccuguuaucucuaucgaaggacgguacgacugcggccuguccaaaagacccauggugauuaagggcacacugaucgcgaccgcuccgcacgaugaccgcaagcaugaagggggaagcucccuuguggucaacccuaaaggcgggacgguggacuuuuucggauggguuucuggccugacaagcuggcucgggggaccccugaagaccuuucucacaauucugggcuuccuugcccugggccuccugcugguggucaucauuaucaucauugcccggaccggggugcagcaggcucuuaaaaagaaaaauaaguga

SEQ ID NO: 14711 - RNA, 4020 nt, Artificial Sequence
  derived and/or modified CDS sequence (opt5) from TOSV(TOSV/Phl.233/FR/2009)__HQ184337.1__GP
auguucaucgccaagcugcuccugauuagcugccuugugcagcaggcuuaccugaaauauaccaucauuuccgagacaggcaacgggacgagaaccucuuuuuguuacagcucccggacaucucucggaagccugcuugaagccugggacaaugucaccgaguccaucggccugacaucugggaccugcaagguuggaagccucgaaaaccgcgauuguagaaaagacauuauguccaauuauguggcggaggugcacagcaaccugcauggccugggggcuaugaugcacaauuacggagaugacaagcgggucgaaauccucaacgaugugauccccgacgagcugaauccuggccaucacaacugcucugaucuugaccgcaaaccguucuggacagaguuuauuaauguugccaagccccuguccgaaaucgugccuaugagcgucauucccccucccgugguuaagccucaaccgcccgccgagccuucuuccaaaaagcaugugcccuucgauguccuccugagcgaagcugagaaagagcuuaaccagaccaagaucagacuggaagacgagcggaaaucuaaugccgaagagacggcuaaggaacgcgccagaaugaaggagauugaggaugaacuccggcgcgagugggaacuggagagaaaacggaaggacgcgauggccgaugaccuggcuaaagaaaccgcccgcagacgggagaucgagcgcaaggcucacgaacucgacaaaaugcugaagaaaaaggagagagaaucccuuauugccaaggagaaagcggaugaagacaugcggagccacgugcauaagccuaacacaaccagagcccccgcuccgacaaucaucaccacgcugcucauggccuccgcugcccuggccggcccucuugagaaucgcgagacaaaccaucugcucaaucggcccgggaacggagcuuauacccugucugauuuugcggaaagcacauguacccuggccuacggcuccgagugcaaaagcugggaacaccuccugaacgaggagcuuuuccccuuuuuccacucuaaucuggacaaguauuccaugcucgaagcugccaccgagacagugccuauucugaacaaaagcucugccgucuguacgaucagccccuccacccacucuagcaaugcuugcgggagagaagccuccguuauucgcaagaaguguuacagcaacaugucugcguuuuucuacaucaaucuugcuggacagauuacagugaucaaaugcgagaccaaccaugugcuguccagcgauuguggcaauugcaucucuaagucccucagcgggcaaaaagucuauacaccugugcaggacguguuuugccagaagggauggacccaguccauuccgucuacgcgguacagcaaagauaucuguuccauuggccugcacacagugaaggaaugcaagaucggcaccaccucuuucgagagagucggguuuauugugguuaaaggacgcaagauguauaucgagcaaaugaaaaugcggagcagacaggaauacuccgaggaccaguuccuguguuauaagagcgaaucuggcuccgggagcucugugaaacucaagaaguucaaaguccaguccugcaagggagugacaaccagcucugccagcaaauguuccggcgaugaguacuuuugcagccgcuaucccugugaaacagccaacgucgaggcucauugcauccugcggagacacucugccauuguggagguuaaugugaacggggucugggugguuccucgcuguaucggauacgaagaggugcuugucaagcggacgucccugaaaguggaagacaccacaggcagagagugcgauagcugucucugggaaugcggcaagaauaaacugauugugaagacccaugggcccaagguugucuacgcuacagccugcucccacggaucuuguaaaagcgugaugcaaaagccugcgaccuucguguaucugcccuacccgggcaacuccgagaucgucgggggagacauuggcauccacaugacggaggaaucuagcccuuccaauauucaucuuguggcccacugccccgcucgggacucuugugauguuagcgacugccucuuuugugugcaugggcugcugaacuaucagugccacacccucuucuccgcccugcuuaucagcacaaccgucaugucuauccugacacuccugcugcuucucgugaaaggcgcuaaggaucugguuaaaaagcuguuucacuggcucauuaccccucuguguuggcuuuccguguucugcuguugggucguuaagagcuggaaacgcagaguuggaucugccaucucccggacgaaugacacaauuggcuggagagagaaccgccggcaugcgcaggauaucgaaagagcccaauacaccgggggagcucccggcgccaaguauagcuuuuacggggugaugauucugggacuccugucuuccgcucagagcugcuccgagagcgucaucgccgacucuaaaaucaugcaguguacaaccagcggcuccucuacccugugcaaggccagcgggacagugauuaugcgccuuggcccuaucggauccgagucuugccucauucugaaaggccugaaggauagcgaaaagcaguucaucuccauuaaaacgaucucuagcgagcucaccuguagagaaggggaguccuuuuggacaacccuguauacacccaucugccuuagcucucggcgcugucaccugaugggagaaugcguguccgacagaugucucaaguggaaaaccaaccaaacgagcgcugaguucacaggcaaggcgcauggggaugucaugcacgagaaucggugcuuugaacagucuggaggcauuggguacggcuguuucaacguuaauccguccugccuguacgugcauagcuaucugaaauccguguaccgcaacggauuuaaggucuucagauguguggccuggaaucaccggauccgccuugagguuaccacccacucuagaaaguucccuauggugcucauggcuaugagcacacagcccaccgacuggggcuccauugggcugauccuggauagcgaaggaauuacaggcacgaacucuuauuccuuuaugaaacaugggagcggaucuuucgccaucaucgacgaucccuacagcccugagccgcggaagggcuuucucggggaaguccgcugccccaccgaggagacagccaugagagcuuccccuucuuguaaaauggcccccaaucugauugaauaucagccugagauggacaccgcggaaugcacaaccaacaugaucgaccccauggcuauuuucaaucggggcagccuuccucaagugagagauggaaugacguuuacccaguccaucgagaagaacacaguucaggcccugaccacaggcgaagugaaagccucuauucgccucacccuggacgauuacgacgucguguaucagaauagccaauccgauugcagcgcuacauucaagaaccugaccggguguuacucuugcgacgagggaucccggcuuuguuaccagguuaaagccgagggcgaaacgaucuuucacuucauuaaugaggaagagagcaucaacgugaucaauaaggucucccccggggugucugauuauugcacagugcugcauuuuagcagaccggucauuuccaucgagggaaccuacgacuguggccucucuaagcgcccuaugguuauuaaaggcacccugaucgcgacagcuccccacgaugaccggaagcaugaagggggaagcucccucguggugaacccuaaaggcgggagcgucgauuucuuuggauggcugucuggccuuaccuccuggcucgggggaccccugaagacguuccugacaauucugggcuuucuugccgugggccugcuccugguugugaucaucauuaucauuaucagaaccgggaugcagcaggcccucaaaaagaagauuaaauga

SEQ ID NO: 14712 - RNA, 4020 nt, Artificial Sequence
  derived and/or modified CDS sequence (opt5) from TOSV(TOSV/Phl.51/FR/2009)__HQ184336.1__GP
auguucaucgccaagcugcuccugauuagcugccuugugcagcaggcuuaccugaaauauaccaucauuuccgagaucggcaacgggacaagaacgucuuuuuguuacagcucccggaccucucucggaagccugcuugaagccugggacaaugucacagaguccauuggccugaccucugggacaugcaagguuggaagccucgaaaaccgcgauuguagaaaagacaucauguccaauuauguggcggaggugcacagcaaccugcauggccugggggcuaugaugcacaauuacggagaugacaagcgggucgaaauccucaacgaugugauucccgacgagcugaauccuggccaucacaacugcucugaucuugaccgcaaaccguucuggaccgaguuuaucaauguugccaagccccuguccgaaauugugccuaugagcgucauucccccucccgugguuaagcuccaaccuccggccgagcccucuuccaaaaagcaugugccuuucgauguccugcuuagcgaagcugagaaagagcugaaccagacaaagaucagacucgaagacgagcggaaaucuaaugccgaagagaccgcuaaggaacgcgccagaaugaaggagaucgaggaugaacugcggcgcgagugggaacuggagagaaaacggaaggacgcgauggccgaugaccucgcuaaagaaacggcccgcagacgggagauugaccgcaaggcucacgagcuggauagaaugcuuaaaaagaaagaacgggagucccugaucgccaaggaaaaggcggacgagaacaugagaagccacgugcaugaacccaauaccacacgcgccccugcucccaccaucauuacaacccuccugauggccuccgcugcccuugccggcccgcuggagaaccgggagacgaaucaccuccugaacagaccugggaacggagcuuauacacugucugauuuugcggaaagcaccuguacacucgccuacggcuccgagugcaaaagcugggaacaucugcuuaaugaggagcuguuccccuuuuuccacucuaaccucgacaaguauuccaugcuggaagcugccaccgagaccgugccuauccuuaauaaaagcucugccgucuguacaauuagccccuccacgcacucuagcaacgcuugcgggcgcgaagccuccguuauccggaagaaauguuacagcaauaugucugcguuuuucuacauuaaccuggcuggacagaucaccguggugaagugcgagacaaaucauguccucuccagcgauuguggcaacugcaucucuaagucccugagcgggcaaaaaguguauacccccguucaggacguguuuugccagaagggauggacacaguccauuccuucuaccagauacagcaaagauaucuguuccauuggccugcacacggucaaggaaugcaaaaucggcacaaccucuuucgagcgcgugggguuuauuguugugaagggacggaagauguauaucgagcaaaugaaaaugagaagccgccaggaauacuccgaggaccaguuccucuguuauaagagcgaaucuggcuccgggagcucugucaaacugaagaaauucaagguggaguccugcaagggagucaccacaagcucugccagcaaauguuccggcgaugaauacuuuugcagccgguucccgugugagaccgccaauguggaggcucauugcauccuuagacgccacucugccauuguugaagugaacgucaaugggguguggguugugccccgguguaucggauaugaggaaguccuggugaagagaacaucccucaaaguggaggacacgaccgaacgggagugcgauagcugucugugggagugcggcaagaacaaacugauuguuaagacacauggcccuaaagucguguacgcuaccgccugcucccacgggucuuguaagagcgugaugcagaagcccgcgacauuugucuaccuuccuuaucccggaaauuccgaaaucgugggcggggacauuggaauccacaugaccgaggaaucuagcccguccaacauucaucucguugcccacugcccugcucgcgacucuugugaugugagcgacugccuguucuguguccauggccugcucaauuaccaaugccacacgcuguuuuccgcccuucugaucagcaccacagugaugucuauccucacccugcugcuucuccugguuaaaggggcuaaggaucuggugaaaaagcuguuccacuggcucauuacaccccuuuguuggcuguccgucuuuugcuguugggugguuaaaagcuggaagagacgggugggcucugccaucuccagaaccaacgacacgauuggauggcgcgagaaccggagacaugcgcaggauaucgagcgcgcccaguauacaggcggggcuccuggagccaaguacagcuucuuuggcgucaugauucucgggcugcugucuuccgcucaaagcugcuccgaaagcgugaucgccgacucuaaaaucaugcaguguaccacaagcggauccucuacccuuugcaaggccagcggcaccgugauuaugagacucgggcccaucggcuccgagucuugccugauucugaaaggacucaaggauagcgaaaaacaguucaucuccauuaagacaaucucuagcgagcugacgugucgggaaggcgaguccuuuuggaccacacuuuauaccccuaucugccugagcucucgcagaugucaccucaugggggagugcgucuccgaccggugucugaaguggaaaacaaaucagaccagcgcugaguucacgggaaaggcgcauggcgauguuaugcacgaaaaccgcugcuuugaacaaucugggggaauuggcuacggguguuucaaugugaaccccuccugccuguaugugcauagcuaccuuaaauccgucuacagaaauggcuucaagguguuucgguguguugccuggaaccaccgcaucagacucgaggugacaacccacucucggaaauucccgaugguccugauggcuaugagcacccagccuacagacuggggauccauuggccugauccucgauagcgaagggauuaccggaacaaauucuuauuccuuuaugaagcauggcagcgggucuuucgccaucaucgacgaucccuacagccccgagccucgcaagggauuucugggcgaggugagaugcccgacggaagagaccgccaugcgggcuucccccucuuguaaaauggccccuaaccuuguugaauaucagcccgagauggacacagcggaaugcaccacaaauaugauugacccuauggcuaucuucaacagagggagccugccccaggugcgcgauggcaugaccuuuacgcaauccauugagaagaauaccguccaggcccucacaaccggagaggugaaagccucuauccggcugacacuggacgauuacgacguuguguaucagaacagccaguccgauugcagcgcuaccuucaagaaucuuacaggcuguuacucuugcgacgaaggguccagacuguguuaucaagucaaagccgagggagaaaccauuuuucacuucaucaacgaggaggaaagcauuaaugugaucaacaagguguccccucgcgucucugauuacugcacgguucuccauuuuagccggcccgugaucuccauugagggcacauacgacugugggcugucuaaaagaccgauggugaucaagggaacccucauugcgaccgcuccucacgaugaccgcaagcaugaaggcggcagcucccuggucgugaaccccaaagggggaagcguugauuucuuuggcuggcuuucugggcugacauccuggcucggaggcccucugaagaccuuccugacgauccuuggguuccuggccgugggacuccugcucgucgugauuaucaucauuaucauucggacaggcaugcagcaggcccugaaaaagaaaaucaaguga

SEQ ID NO: 14713 - RNA, 4020 nt, Artificial Sequence
  derived and/or modified CDS sequence (opt5) from TOSV(11368)__KU925897.1__GP
auguucaucgccaagcugcuccugauuagcugccuugugcagcaggcuuaccugaaauauaccaucauuuccgagacaggcaacgggacgagaaccucuuuuuguuacagcucccggacaucucucggaagccugcuugaagccugggacaaugucaccgaguccaucggccugacaucugggaccugcaagguuggaagccucgaaaaccgcgauuguagaaaagacauuauguccaauuauguggcggaggugcacagcaaccugcauggccugggggcuaugaugcacaauuacggagaugacaagcgggucgaaauccucaacgaugugauccccgacgagcugaauccuggccaucacaacugcucugaucuugaccgcaaaccguucuggacagaguuuauuaauguugccaagccccuguccgaaauggugccuaugagcgucaucccuccucccgugguuaagcuccaaccuccggccgagcccucuuccaaaaagcaugugccuuucgauguccugcuuagcgaagcugagaaagagcugaaccagaccaagauuagacucgaagacgagcggaaaucuaauacggaagagaccgccaaggaacgcgcuagaaugaaggagaucgaggaugaacugcggcgcgagugggaacuggagagaaaacggaaggacgccauggcggaugaccucgccaaagaaacagcucgcagacgggagauugagcgcaaggcccacgaacuggacaaaaugcuuaagaaaaaggagagagaaucccugaucgcuaaggagaaagccgaugaagacaugcggagccacgugcauaagcccaacaccacaagagcgcucgccccuaccauuaucacgacacugcuuauggcuuccgccgcucuggccggcccccucgagaaucgcgagaccaaccaucugcugaaucggccggggaacggagccuauacacucucugauuuugcugaaagcaccuguacccuggcguacggcuccgagugcaaaagcugggaacaccuucugaacgaggaacucuuccccuuuuuccacucuaaucuggacaaguauuccaugcuugaagccgcuacagagacggugcccauccugaacaaaagcucugccgucuguaccauuagcccuuccacacacucuagcaaugccugcgggagagaggcuuccguuauccgcaagaaguguuacagcaacaugucugccuuuuucuacauuaaucucgcgggacagaucaccgugauuaaaugcgagacaaaccaugugcuguccagcgauuguggcaauugcaucucuaagucccugagcgggcaaaaagucuauacccccgugcaggacguguuuugccagaagggauggacgcaguccauccccucuacacgguacagcaaagauauuuguuccaucggccuccacaccgugaaggaaugcaagauuggcaccacaucuuucgagagagucggguuuaucgugguuaaaggacgcaagauguauauugagcaaaugaaaaugcggagcagacaggaauacuccgaggaccaguuccuguguuauaagagcgaaucuggcuccgggagcucugugaaacuuaagaaguucaaaguccaguccugcaagggagugaccacaagcucugcuagcaaauguuccggcgaugaguacuuuugcagccgcuauccuugugaaacggccaacgucgaggcccauugcauccugcggagacacucugcuaucguggagguuaaugugaacggggucugggugguuccgcgcuguauuggauacgaagaggugcucgucaagcggaccucccugaaaguggaagacacaaccggcagagagugcgauagcugucugugggaaugcggcaagaauaaacuuaucgugaagacacaugggcccaagguugucuacgccaccgcuugcucccacggaucuuguaaaagcgugaugcaaaagccugccacguucguguaucuccccuacccuggcaacuccgagauugucgggggagacaucggcauucacaugaccgaggaaucuagccccuccaauauccaucugguggcgcacugcccggcccgggacucuugugauguuagcgacugccuguuuugugugcaugggcuccugaacuaucagugccacacacuuuucuccgcucugcucauuagcaccacagucaugucuauccugacccugcuucuccugcuggugaaaggcgccaaggaucucguuaaaaagcuguuucacuggcuuaucacgccucuguguuggcucuccguguucugcuguugggucguuaagagcuggaaacgcagaguuggaucugcuauuucccggacaaaugacaccaucggcuggagagagaaccgccggcaugcccaggauauugaaagagcgcaauacacagggggagcccccggcgcuaaguauagcuuuuacggggugaugauccugggacugcuuucuuccgcccagagcugcuccgagagcgucauugcugacucuaaaaucaugcaguguaccaccagcggcuccucuacacucugcaaggccagcgggacggugaucaugcgccugggcccuauuggauccgagucuugccugauccucaaaggccugaaggauagcgaaaagcaguucauuuccaucaaaaccauuucuagcgagcuuacauguagagaaggggaguccuuuuggaccacacuguauacccccaucugccucagcucucggcgcugucaccugaugggagaaugcguguccgacagaugucugaaguggaaaacgaaccaaacaagcgccgaguucaccggcaaggcucauggggaugucaugcacgagaaucggugcuuugaacagucuggaggcaucggguacggcuguuucaacguuaauccuuccugccuuuacgugcauagcuaucucaaauccguguaccgcaacggauuuaaggucuucagauguguggcguggaaucaccggauucgccuggagguuaccacacacucuagaaaguuccccauggugcugauggccaugagcacccagccgacagacuggggcuccaucgggcucauucuggauagcgaaggaaucacgggcaccaacucuuauuccuuuaugaaacaugggagcggaucuuucgcuauuaucgacgauccuuacagccccgagccccggaagggcuuucuuggggaaguccgcugcccuacagaggagaccgccaugagagccuccccgucuuguaaaauggcucccaaucugaucgaauaucagccugagauggacacagccgaaugcaccacgaacaugauugaccccauggcgaucuucaaucggggcagccucccucaagugagagauggaaugaccuuuacacaguccauugagaagaacaccguucaggcucugacaaccggcgaagugaaagccucuauccgccugauucuugacgauuacgacgucguguaucagaauagccaauccgauugcagcgccacauucaagaaccugaccggguguuacucuugcgacgagggaucccggcucuguuaccagguuaaagcugagggcgaaacgaucuuucacuucauuaaugaggaagagagcaucaacgugaucaauaaggucucccccggggugucugauuauugcacagugcugcauuuuagcagaccugucauuuccaucgagggaaccuacgacuguggccucucuaagcgccccaugguuauuaaaggcacccugaucgccacagcgccgcacgaugaccggaagcaugaagggggaagcucccuuguggugaacccuaaaggcgggagcgucgauuucuuuggauggcugucuggccucaccuccuggcuugggggaccccugaagacguuccugacaauucugggcuuucucgcugugggccugcuccugguugugaucaucauuaucauuaucagaaccgggaugcagcaggcccuuaaaaagaagauuaaauga

SEQ ID NO: 14714 - RNA, 4020 nt, Artificial Sequence
  derived and/or modified CDS sequence (opt5) from TOSV(5904242804)__KU935737.1__GP
auguucaucgccaagcugcuccugauuagcugccuugugcagcaggcuuaccugaaauauaccaucauuuccgagaucggcaacgggacaagaacgucuuuuuguuacagcucccggaccucucucggaagccugcuugaagccugggacaauauuacagaguccaucggccugaccucugggacaugcaaggucggaagccucgaaaaccgcgauuguaaaagagacaucauguccaauuauguugcggaggugcacagcaaccugcauggccugggggcuaugaugcacaauuacggagaugacaagcggguggaaguccucaacgaugugauucccgacgagcugaauccuggccgccauaacugcucugaucuugacagaaaaccguucuggaccgaguuuaucgauguugccaagcccacaaauaagauugccccuauguccgugaucccuccucccauugucaaaccuaucccgguggcugaaagcaccauuaagaaaucuauccccuucgacaagcugcucuccgaggccgaaaaagagcugaaccagacgaagauccggcuugagaccgaacgcagaagcaaugcugaggaagccgcgaaggagcgggcccgcaugagagaaauugaggauaaacugcggaaggacugggagcucgaacgcgagagaaaagaugcuguugccgacgaccuggcuaaggaaaucgcccggcgcagagagauugaacggaaagcgcacgagcuggauaagaugcucaaaaagaaggagagagaagaccugguggcccgcgagcgggucucugaagauaugagaaaccaugugcgcaaaccuaauacaaccaucgcucccgccccuacaauuaucaccacgcuucugauggcuuccgccgugauggccggcccccucgagaaccgggaaacaaaucaucugcuuaacagaccggggaacggagcuuauacccugagcgacuuugcggaguccacauguacccucgccuacggcucugagugcaagagcugggaacaccagcuggaugagcuguccuuccccuuuuuccacagcaaucucgacaaauauucuaugcuggaagcugccaccgagacaauccccauucuuaacaaguccagcgccgucuguacgaucucuccuagcacccacuccucuaaugcuugcgggcgcgaggccagccugauuaaaaagaaguguggauccaacaugagcgcguuuuucuacguuaaucucgcuggccagaucacaguggugaaaugcgauaccaaccauguccugucuaaugacugugggaacugcauuuccaagacacuuagcggacagaaaaucuacacccccgugcaagauauguuuugccagaagggcuggacggaaucuauccccaauacacgguauuccaaagaccuguguagcauuggccuccacaccguuaaggagugcaagaccgggacaaccaacuucgaaagagugggauuuaucgucguggagggccgcaaaauguacauugaacagaugaagaugcgguccagacaagaguucucugaggaucaguuccuguguuauaaaagcgaauccucuagcggguccagcguuaagcugaaaaaggugaaggucgagucuugcaaaggagugacaacguccagcgccucuaaguguuccggcgacgaauacuuuugcagccgcuauccuugugagaccgccaaugucgaagcucacugcauccuccggagacauucugccgugauugagguuaacgugaauggggucuggaucgugccgcgguguauuggauacgaggaaguucuggugcgcagaacaagccuuaaagucgaggacaccuccagccgggaaugcgauacaugucugugggagugcggcaagaacaaacucaucgugaagacccacggccccaaaaucguguaugcuacggccugcucucauggguccuguaagagcguuaugcagaagccugcgaccuucgucuaccugcccuacccuggaaauuccgaaauugugggcggggacaucggagugcacaugacagaggagucuagccccuccaacauucauauggucgcccacugcccggcuaaagauucuugugaagugagcuccugccuguuuuguguucacggccuucucaacuaucagugccauacccuguucucugcccugcucaucagcacaaccgugauguccauucugacgcuucugcuccugcuggucaagggggcuaaagaccuugugaagagacucuuuuacuggcugaucacaccucuguguuggcucagcguuuucugcggcugggugaucaaaucuuggaagaagcgcgucggauccgccauuagccggaccaaugauacaaucggcuggagagacaaccgcagauaucggcaagauguggagcgcgcgcaguacaccgggggagcccccggcgcuaaauauucuuuuuacgggguuauggugcugggacuucugggcaauguccacuccuguagcgaaucuauuaucgccgacuccaagauuaugcagugcaccacaagcggguccagcacgcucuguaaggcuucuggcaccgugaucaugaaacugggaccuaucggcagcgaguccugccugauucuuaaagggcucaaggauucugagaagcaauucaucagcauuaaaacaaucuccucugaacugaccugcagagagggagagagcuuuuggacaacccuguauacgcccgugugucucuccucucggcgcugccaucugaugggcgaaugugucagcgacagaugccuuaaguggaaaacaaacgaaaccuccgccgaguucaccgggaaggcccacggagagguugugcacgaaaaucgguguuuugagcagagcggcgggauuggcuacggaugcuucaacgugaauccuucuugucuguacguccauuccuaucucaaaagcguguacaagaacggcuuuaagaucuuccgcugcguugcuuggaaucacagaauccggcuggaagugacaacccauucucgcaaauuccccaugguccugauggcgauguccacacagccgacggauugggggagcauuggacuuauccucgacuccgagggcauuaccgggacaaacgccuauucuuuuaugaagcacggaagcggcuccuucgcuaucauugaugacccuuacagccccgaacccagaaaaggguuucugggcgaggugcgguguccuaccgaggaaacagccaucagagccucuccguccugcaagauggcucccaaucugauugaguaucagccugaaauggacaccgccgaguguacgaccaacaugaucgaucccauggcgaucuucaaucgcggaagccucccucaaguucgggacggcaugacauuuacccagucuauugagaaaaacacagugcaggcucugaccacaggggaagucagagccagcauccgccuuacccuggaugacuacgaugugguuuaucaaaauucccaaucugacugcagcgccacguucaagaaccucacaggaugcuacuccugugaugagggcucucggaugugcuaccaggugaaagcugaaggggagaccauuuuucauuucaucaacgaagacgagagcauuaaugucaucaacaaggugaaucccgauguguccgacuauuguaccguccugcacuuuagcagaccuguuaucucuauugagggacgcuacgauugcggccuguccaagcggcccauggugaucaaaggcacacuuauugccaccgcgccgcacgacgauagaaagcaugaagggggaagcucccugaucgugaacccuaaaggcgggacggucgacuucuuuggaugggugucuggccucacaagcuggcucgggggaccccugaagaccuuccugacaauucuuggcuuucuggcucucggccugcugcuuguugugaucaucauuaucauugcccgcaccgggguccagcaggcccugaaaaagaagaauaaauga

SEQ ID NO: 14715 - RNA, 4020 nt, Artificial Sequence
  derived and/or modified CDS sequence (opt5) from TOSV(5963930705)__KU935734.1__GP
auguucaucgccaagcugcuccugauuagcugccuugugcagcaggcuuaccugaaauauaccaucauuuccgagaucggcaacgggacaagaacgucuuuuuguuacagcucccggaccucucucggaagccugcuugaagccugggacaaugucacagaguccauuggccugaccucugggacaugcaagguuggaagccucgaaaaccgcgauuguagaaaagacaucauguccaauuauguggcggaggugcacagcaaccugcauggccugggggcuaugaugcacaauuacggagaugacaagcgggucgaaauccucaacgaugugauucccgacgagcugaauccuggccaucacaacugcucugaucuugaccgcaaaccguucuggaccgaguuuaucaauguugccaagccccugggcgaaauugugccuauguccgucauucccccucccgugguuaagcuccagccuccggccgagcccagcucuaaaaagcaugugccuuucgauguccugcuuuccgaagcugagaaagagcugaaccagacaaagaucagacucgaagacgagcggaaaagcaaugccgaagagaccgcuaaggaacgcgccagaaugaaggagaucgaggaggagcugcggcgcgaaugggagcuggaaagaaaacggaaggaugcgauggccgacgaucucgcuaaagagacggcccgcagacgggagauugaacgcaaggcucacgagcuggacagaaugcuuaaaaagaaagaacgggagucucugaucgccaaggaaaaggcggacgaggauaugagaucccacgugcauaaacccaacaccacacgcgccccugcucccaccaucauuacaacccuccugauggccagcgcugcccuugccgggccgcuggagaaucgggaaacgaaccaccuccugaauagaccuggaaacggcgcuuauacacuguccgacuuugcggagucuaccuguacacucgccuacgggagcgaaugcaaguccugggagcaucugcuuaacgaggaacuguuccccuuuuuccacagcaaucucgauaaauauucuaugcuggaggcugccaccgaaaccgugccuauccuuaacaaguccagcgccgucuguacaauuucucccagcacgcacuccucuaaugcuugcggacgcgaggccagcguuauccggaaaaaguguuacuccaacaugagcgcguuuuucuacauuaaucuggcuggccagaucaccguggugaagugcgaaacaaaccauguccucucuuccgacugugggaauugcaucagcaaaucucuguccggacaaaagguguauacccccguucaggauguguuuugccagaaaggcuggacacagagcauuccuuccaccagauacucuaaggacaucuguagcauuggccugcacacggucaaagagugcaagaucgggacaaccuccuucgagcgcgugggauuuauuguugugaagggccggaaaauguauaucgaacaaaugaagaugagaucucgccaggaguacagcgaagaucaguuccucuguuauaaauccgagagcgggucuggauccagcgucaagcugaaaaaguucaagguggaaucuugcaaaggcgucaccacauccagcgccucuaaguguagcggggacgaguacuuuugcucccgguauccgugugaggccgcuaacguggaagcccauugcauccuuagacgccacagcgcuauuguugaggugaaugucaacggaguguggguugugccccgguguaucggcuacgaagagguccuggugaaaagaaccucucucaagguggaagauacaacggagcgggagugcgacuccugucugugggaaugcggcaaaaauaagcugauuguuaaaacccaugggccuaaggucguguacgccacagcgugcagccacggauccuguaagucugugaugcagaaacccgccaccuucgucuaucuuccuuaccccggcaacagcgagaucgugggaggagauauuggcauccacaugacagaagaguccucuccgagcaauauucaucucguugcucacugcccugcccgcgacuccugugacgugucugauugccuguuuuguguccaugggcugcucaacuaucaaugccacacccuguucagcgcccuucugaucuccacgaccgugaugagcauccucacacugcugcuucuccugguuaagggcgcuaaagaccuggugaagaaacucuuucacuggcugauuacgccccuuuguuggcugucugucuucugcuguuggauggugaaguccuggaagagacggguuggaagcgcgaucucuagaacaaaugauaccauuggcuggcgcgagaaccggagacaugcccaggacaucgaacgcgcucagcacaccgggggagccccuggcgcuaaauacuccuuuuauggggugaugauucucggacugcugagcucugcccaauccugcagcgaguccgucaucgccgauagcaagaucaugcaguguacaaccucuggcagcuccacacuuugcaaggcuucugggaccgugauuaugagacucggccccaucggaagcgaauccugccugauucugaaaggccucaaagacucugagaagcaguucaucagcauuaagaccaucuccucugaacugacaugucgggagggggagagcuuuuggacgacccuuuacacaccuaucugccuguccagccgcagaugucaucucaugggagaaugcgugucugaucggugucugaaauggaagaccaaccagacauccgcggaguucaccggcaaagcccacggggacgucaugcaugaaaaucgcugcuuugagcaaagcggaggcauuggguauggcuguuucaacguuaaucccucuugccuguacgugcacuccuaccuuaagagcguguauagaaacggauuuaaagucuuccgguguguggcuuggaaucaccgcaucagacucgaaguuacgacacauucccggaaguucccgauggugcugauggccaugucuacccagccuaccgauuggggcagcauugggcugauccucgacuccgagggaauuacaggcaccaacagcuacucuuuuaugaagcacggguccgggagcuucgccaucaucgaugaccccuauucucccgagccucgcaaaggcuuucugggggaagucagaugcccgacagaggaaacggcuaugcgggccagccccuccuguaagauggcgccuaaucuuauugaguaccagcccgaaauggauaccgcugagugcacaaccaacaugaucgacccuauggccauuuucaauagaggcucucugccccaggugcgcgacggaaugacauuuacccaaagcaucgagaaaaacacgguucaggcccucaccacaggcgaagugaaggcuuccauucggcugacccuggaugacuaugaugucguguaccaaaauucucagagcgacugcuccgccacauucaaaaaccuuaccggguguuauagcugcgaugagggaucuagacuguguuaccaaguuaaggcggaaggcgagacaaucuuucauuucauuaaugaggaagaguccaucaacgugaucaauaaagucagcccugggguguccgacuacugcaccgugcuccacuuuucuagccccgucauuuccaucgaaggaacguaugauuguggccugucuaagcgcccgaugguuauuaagggcacacucaucgcuaccgccccucaugacgaucggaaacacgaagggggaagcucccugguggugaaccccaagggcgggagcgucgacuucuuuggauggcuuucuggccugaccuccuggcucgggggaccucugaaaacauuccugaccauucuuggcuuucuggccgugggccuccugcucguugugaucaucauuaucauuaucagaacggggaugcagcaggcucugaagaaaaagauuaaguga

SEQ ID NO: 14716 - RNA, 4020 nt, Artificial Sequence
  derived and/or modified CDS sequence (opt5) from TOSV(H4906)__KU922125.1__GP
auguucaucgccaagcugcuccugauuagcugccuugugcagcaggcuuaccugaaauauaccaucauuuccgagaucggcaacgggacaagaacgucuuuuuguuacagcucccggaccucucucggaagccugcuugaagccugggauaaugucacagaguccauuggccugaccucugggacaugcaagguuggaagccucgaaaaccgcgauuguagaaaagacaucauguccaauuauguggcggaggugcacagcaaccugcauggccugggggcuaugaugcacaauuacggagaugacaagcgggucgaaauccucaacgaugugauucccgacgagcugaauccuggccaucacaacugcucugaucuugaccgcaaaccguucuggaccgaguuuaucaauguugccaagccccuguccgaaauugugccuaugagcgucaucccuccucccgugguuaagccucaaccgcccgccgagccuucuuccaaaaagcaugugcccuucgauguccuccugagcgaagcugagaaagagcuuaaccagacaaagauuagacuggaagacgagcggaaaucuaaugccgaagagaccgcuaaggaacgcgccagaaugaaggagaucgaggaugaacuccggcgcgagugggaacuggagagaaaacggaaggacgcgauggccgaugaccuggcuaaagaaacggcccgcagacgggagauugagcgcaaggcucacgaacucgacagaaugcugaaaaagaaagagcgggaaucccuuaucgccaaggagaaggcggaugaagacaugagaagccacgugcauaaaccuaacaccacacgcgcccccgcuccgaccaucauuacaacccugcucauggccuccgcugcccuggccggcccucuugagaaucgggagacgaaccaucugcucaauagacccgggaacggagcuuauacacugucugauuuugcggaaagcaccuguacacuggccuacggcuccgagugcaagagcugggaacaccuccugaacgaggagcuuuuccccuuuuuccacucuaaucuggacaaauauuccaugcucgaagcugccaccgagaccgugcccauccugaacaagagcucugccgucuguacaauuagccccuccacgcacucuagcaaugcuugcgggcgcgaagccuccguuauccggaaaaaguguuacagcaacaugucugcguuuuucuacauuaaucuugcuggacagaucaccguggugaagugcgagacaaaccauguccuguccagcgauuguggcaauugcaucucuaaaucccucagcgggcaaaagguguauaccccuguucaggacguguuuugccagaaaggauggacacaguccauuccgucuaccagauacagcaaggauaucuguuccauuggccugcacacggucaaagaaugcaagaucggcacaaccucuuucgagcgcgugggguuuauuguugugaagggacggaaaauguauaucgagcaaaugaagaugagaagccgccaggaauacuccgaggaccaguuccuguguuauaaaagcgaaucuggcuccgggagcucugucaagcucaaaaaguucaagguggaguccugcaaaggagucaccacaagcucugccagcaaguguuccggcgaugaauacuuuugcagccgguuccccugugagaccgccaacguggaggcucauugcauccugagacgccacucugccauuguugaagugaaugucaacgggguguggguugugccucgguguaucggauaugaggaaguccuugugaaaagaacaucccugaagguggaggacacgaccgaacgggagugcgauagcugucucugggagugcggcaaaaauaagcugauuguuaaaacacauggccccaaggucguguacgcuaccgccugcucccacgggucuuguaagagcgugaugcagaaaccugcgacauuugucuaccugcccuauccgggaaacuccgaaaucgugggcggggacauuggaauccacaugaccgaggaaucuagcccuuccaauauucaucuuguugcccacugccccgcucgcgacucuugugaugugagcgacugccucuucuguguccauggccugcugaacuaccaaugccacacgcucuuuuccgcccugcuuaucagcaccacagugaugucuauccugacccuccugcugcuucucguuaagggggcuaaagaucuggugaagaaacuguuccacuggcucauuacaccucuguguuggcuuuccgucuuuugcuguugggugguuaagagcuggaagagacgggugggcucugccaucuccagaaccaaugacacgauuggauggcgcgagaaccggagacaugcgcaggauaucgagcgcgcccaguauacaggcggggcucccggagccaaauacagcuucuauggcgucaugauucuggggcuccugucuuccgcucaaagcugcuccgaaagcgugaucgccgacucuaagaucaugcaguguaccacaagcggauccucuacccugugcaaagccagcggcaccgugauuaugagacuugggccuaucggcuccgagucuugccucauucugaagggacugaaagauagcgaaaagcaguuuaucuccauuaagacaaucucuagcgagcucacgugucgggaaggcgaguccuucuggaccacacuguacacccccaucugccuuagcucucgcagaugucaccugaugggggagugcgucuccgaccggugucucaaauggaagacaaaccagaccagcgcugaauuuacgggaaaagcgcauggcgauguuaugcacgagaaucgcugcuucgaacaaucugggggaauuggcuauggguguuuuaacgugaauccguccugccuguacgugcauagcuaccugaaguccgucuauagaaacggcuucaaaguguuccgguguguugccuggaaucaccgcaucagacuugagaugacaacccacucucggaaguuuccuauggugcucauggcuaugagcacccagcccacagacuggggauccauuggccugauccuggauagcgaagggauuaccggaacaaacucuuacuccuucaugaagcauggcagcgggucuuuugccaucaucgacgaucccuauagcccugagccgcgcaaaggauuccucggcgaggucagaugccccacggaagagaccgccaugcgggcuuccccuucuuguaagauggcccccaaucugauugaauaccagccugagauggacacagcggaaugcaccacaaacaugaucgaccccauggcuauuuuuaauagagggagccuuccucaggugcgcgauggcaugaccuucacgcaauccaucgagaaaaacaccguucaggcccugacaaccggagaggugaaggccucuauucggcucacacuggacgauuaugacgucguguaccagaauagccaguccgauugcagcgcuaccuuuaaaaaccugacaggcuguuauucuugcgacgaaggguccagacuuuguuaccaaguuaaggccgagggagaaaccaucuuccacuuuauuaaugaggaggaaagcaucaacgugaucaauaaagucaaccccggcguguccgauuacugcacggugcugcauuucucucgcccggucauuagcaucgaggggacauaugacuguggacucuccaagcggccuaugguuauuaagggcacccugaucgcgaccgcuccccacgaugacagaaaacaugaaggcgggucuagccucguggugaacccuaagggaggcuccgucgacuuuuucggguggcugagcggacuuacaucuuggcugggcgggccccucaaaaccuuucugacgauucugggauuccuugccgugggccugcuccugguugugaucaucauuaucauuauccgcacaggcaugcagcaggcccucaagaaaaagauuaaguga

SEQ ID NO: 14717 - RNA, 4020 nt, Artificial Sequence
  derived and/or modified CDS sequence (opt5) from TOSV(MRS2010-4319501)__KC776215.1__GP
auguucaucgccaagcugcuccugauuagcugccuugugcagcaggcuuaccugaaauauaccaucauuuccgagaucggcaacgggacaagaacgucuuuuuguuacagcucccggaccucucucggaagccugcuugaagccugggacaaugucacagaguccauuggccugaucucugggaccugcaagguuggaagccucgaaaaccgcgauuguagaaaagacaucauguccaauuauguggcggaggugcacagcaaccugcauggccugggggcuaugaugcacaauuacgccgaugacaagcgggucgaaauucucaacgaugugauccccgacgagcugaauccuggacaucacaacugcucugaucuugaccgcaaaccguucuggacagaguuuauuaauguugccaagccccuguccgaaaucgugccuaugagcgucauucccccucccgugguuaagcuccagccuccggcugagcccucuuccaaaaagcaugugccuuucgauguccugcuuagcgaagccgagaaagagcugaaccagaccaagaucagacucgaagacgagcggaaaucuaaugcugaagagacagccaaggaacgcgcgagaaugaaggagauugaggaugaacugcggcgcgagugggaacuggagagaaaacggaaggacgccauggcugaugaccucgccaaagaaaccgcucgcagacgggagaucgagcgcaaggcccacgaacuggacagaaugcuuaaaaagaaagagcgggaaucccugaucgcgaaggagaaggccgaugaagacaugagaagccacguguauaaacccaacacgacccgcgcuccugcccccacaauuaucaccacacuccugauggcuuccgccgcccuugcuggcccgcuggagaaucgggagaccaaccaucuccugaauagaccuggcaacggggcguacacgcugucugauuuugccgaaagcacauguacccucgcuuauggauccgagugcaagagcugggaacaccuucuuaacgaggagcuguuccccuuuuuccauucuaaucucgacaaauacuccaugcuggaagccgccacagagaccgugccuauucuuaacaagagcucugcugucuguaccaucagccccuccacacacucuagcaaugccugcggccgcgaagcguccguuauucggaaaaaguguuacagcaacaugucugccuuuuucuauaucaaucuggcugggcagaucacgguggugaagugcgagaccaaccacguccucuccagcgauuguggaaauugcauuucuaaaucccugagcggccaaaagguguacacacccguucaggacguguuuugccagaaaggguggacccaguccaucccuucuacaaaguauagcaaagauauuuguuccaucggacugcauaccgucaaggaaugcaagauuggcaucacgucuuucgagagagugggcuuuaucguugugaaagggcgcaagauguacauugagcaaaugaaaaugcggagcagacaggaauauuccgaggaccaguuccucuguuacaagagcgaaucuuccagcggaucuuccgucaaacugaagaaguucaaaguggagagcugcaagggcgucacaaccucuagcgccuccaaauguagcggggaugaauauuuuugcucucgcuacccgugugagaccgcuaacguggaggcccacugcauccuucggagacauuccgcuauuguugaagugaaugucaacggaguguggguugugccccgcuguaucggcuacgaggaaguccuggugaagcggacaagccucaaaguggaggacaccacagggagagaaugcgauuccugucugugggagugcggaaagaauaaacugauuguuaagacgcacggcccuaaggucguguaugccaccgcgugcucucauggcagcuguaaauccgugaugcagaagcccgccacauucgucuaccuuccuuaucccgggaacucugagaucgugggaggcgacauugggauccacaugaccgaagagagcuccccgucuaauauccaccucguugcucauugcccugcccgggacagcugugauguguccgacugccuguuuuguguccacggacugcucaacuaccaaugccauacacuguucagcgcucugcugauuucuaccacggugauguccauccucacccugcugcuucuccugguuaaaggcgccaaggaucuggugaaaaagcucuuucacuggcugauuacaccccuuuguuggcugagcgucuucugcuguugggugguuaagucuuggaaacgcagagugggguccgcgaucagccggaccaaugacacaauuggcuggagagaaaaccgccggcacgcccaggauaucgagagagcucaguauaccggaggcgccccuggggcuaaguacucuuuuuauggagucaugauccucggccugcuguccagcgcccaauccugcagcgagucugugauugccgacagcaaaaucaugcaguguacgacauccgggucuagcacccuuugcaaggcuuccggaacagugauuaugcgcgucggccccaucgggucugaaagcugccucauucugaaaggccugaaggauuccgagaagcaguucaucucuaucaaaaccauuagcuccgaacucaccuguagagagggagagagcuuuuggacaacgcuguacaccccuaucugccuuucuucccggcgcugucaucugaugggcgaaugcguuagcgacagaugucucaaguggaaaacaaaccagaccucugcggaguucacagggaaggcccacggagaugugaugcaugaaaaucggugcuuugagcaauccggcgggauuggauacggcuguuucaacgugaaucccagcugccuguauguccacuccuaccugaaaucuguguaucgcaacggguuuaagguuuucagauguguggcuuggaaucaucggauccgccuugaagucaccacgcacagcagaaaguucccgauggugcucauggccauguccacacagccuaccgacuggggcagcauuggacugauccuggauucugagggcguuaccgggacaaacuccuacagcuuuaugaaacacggaucuggcagcuucgccaucauugacgaucccuauucccccgaaccucggaagggguuucucggagaggugcgcugcccgaccgaggaaacagcuaugagagccucucccagcuguaaaauggcgccuaaucugaucgaguaccagcccgaaauggacacggcugagugcaccacaaacaugauugacccuauggccaucuucaaucggggcucccuuccccaggucagagaugggaugaccuuuacacaaucuauugaaaagaacaccgugcaggcccugacgaccggcgagguuaaagcuagcauccgccucacacuggacgauuaugacguggucuaccaaaauucccagagcgauugcucugccaccuucaagaaccugacaggauguuacuccugcgacgagggcagccggcuuuguuaucaagugaaagcggaaggggagaccauuuuucauuucaucaaugaagaggaguccaucaacgugauuaauaaggucucuccuggaguuagcgauuacugcacagugcugcacuuuuccagacccgugaucucuauugaaggcaccuaugacugugggcucagcaagcgcccgauggucaucaaaggaacgcugauugcuacagccccucaugaugaccggaagcacgagggcggcuccagccucgugguuaaccccaaagggggaucuguggauuucuuuggcuggcuguccgggcuuaccagcuggcugggaggcccucucaagaccuuccugacaauccugggguuucuugccgucggacugcuccuggugguuaucauuaucauuaucauuagaaccggcaugcagcaggcucucaaaaagaagaucaaauga

SEQ ID NO: 14718 - RNA, 4020 nt, Artificial Sequence
  derived and/or modified CDS sequence (opt5) from TOSV(Nice/113)__KU204982.1__GP
auguucaucgccaagcugcuccugauuagcugccuugugcagcaggcuuaccugaaauauaccaucauuuccgagaucggcaacgggacaagaacgucuuuuuguuacagcucccggaccucucucggaagccugcuugaagccugggacaaugucacagaguccauuggccugaccucugggacaugcaagguuggaagccucgaaaaccgcgauuguggcaaagacaucauguccaauuauguggcggaggugcacagcaaccugcaugggcugggagcuaugaugcacaauuacggcgaugacaagagagucgaaauccucaacgaugugauucccgacgagcugaauccuggccaucacaacugcucugaucuugaccggaaaccguucuggaccgaguuuaucaauguugcccgcccccuguccgaaauugccccuaugagcgugauucccccucccgucgugaagcuccaaccuccggcugagcccucuuccaagaaacauguuccuuucgaugugcugcuuagcgaagccgagaaggagcugaaccagacaaaaaucagacucgaagacgagcggaagucuaaugcugaagagaccgccaaagaacgcgcgagaaugaaggagaucgaggaugaacugcggcgcgagugggaacuggagagaaagcggaaagacgccauggcugaugaccucgccaaggaaacggcucgcagacgggagauugagcgcaaagcccacgaacuggacagaaugcuuaagaaaaaggagcgggaaucccugaucgcgaaagagaaggccgaugaagacaugagaagccacguccauaagcccaacaccacacgcgcuccugcccccaccaucauuacaacccuccugauggcuuccgccgcccuugcugggccgcuggagaaucgggagacgaaccaccuccugaauagaccuggaaacggcgcguauacacugucugauuuugccgaaagcaccuguacacucgcuuacggguccgagugcaaaagcugggaacaucugcuuaacgaggagcuguuccccuuuuuccacucuaaucucgacaaguauuccaugcuggaagccgccaccgagaccgugccuauccuuaacaaaagcucugcuguguguacaauuagccccuccacgcacucuagcaaugccugcggacgcgaagcguccgucauccggaagaaauguuacagcaacaugucugccuuuuucuacauuaaucuggcuggccagaucaccguugugaagugcgagacaaaccaugugcucuccagcgauugugggaauugcaucucuaagucccugagcggacaaaaagucuauacccccgugcaggacguguuuugccagaagggcuggacacaguccauuccuucuaccagauacagcaaagauaucuguuccauuggccugcacacgguuaaggaaugcaaaaucgggacaaccucuuucgagcgcgucggauuuauugugguuggcgggcggaagauguauaucgagcaaaugaagaugagaagccgccaggaauacuccgaggaccaguuccucuguuauaaaagcgaaucuggauccggcagcucugugaagcugaaaaaguucaaagucgaguccugcaagggggugaccacaagcucugccagcaaguguuccggagaugaauacuuuugcagccgguauccgugugagaccgcuaacgucgaggcccauugcauccuuagacgccacucugcuauuguggaaguuaaugugaacggcgucugggugguuccccgguguaucggcuacgaggaagugcuggucaaaagaacaucccucaagguggaggacacgaccgaacgggagugcgauagcugucugugggagugcgggaaaaauaagcugauugugaaaacacauggaccuaagguugucuacgccaccgcgugcucccacggcucuuguaaaagcgugaugcagaagcccgccacauucguguaucuuccuuaccccgggaacuccgaaaucgucggaggcgacauugggauccacaugaccgaggaaucuagcccguccaauauucaucucguggcucacugcccugcccgcgacucuugugauguuagcgacugccuguuuugugugcauggccugcucaacuaucaaugccacacgcuguucuccgcccuucugaucagcaccacagucaugucuauccucacccugcugcuucuccuggugaagggagcuaaagaucugguuaagaaacucuuuuacuggcugauuacaccccuuuguuggcuguccguguucugcuguugggucaucaagagcuggaaaagacgggugggcucugcgauuuccagaaccaaugacacgaucggguggcgcgagaaccggagacacgcccaggauauugagcgcgcucaguauacaggaggcgccccuggggcuaaguacagcuuuuauggaguuaugauccucggccugcugucuuccgcccaaagcugcuccgaaagcgugaucgccgacucuaagauuaugcaguguaccacaagcggguccucuacccuuugcaaagcuagcggcaccgucaucaugagacucggacccauuggcuccgagucuugccugauccugaaggggcucaaagauagcgaaaagcaguucauuuccaucaaaacaaucucuagcgagcugacgugucgggaaggagaguccuuuuggaccacacuuuacaccccuauuugccugagcucucgcagaugucaucucaugggcgagugcguguccgaccggugucugaaguggaagacaaaccagaccagcgcggaguucacggggaaagcccacggagaugugaugcaugagaaucgcugcuuugaacaaucuggcgggaucggcuacggauguuucaacgucaaucccuccugccuguauguucacagcuaccuuaaguccguguauagaaacggcuuuaaaguguuccggugugucgcuuggaaucaucgcauuagacucgaggugacaacccacucucggaaguucccgaugguucugauggccaugagcacccagccuacagacuggggguccaucggacugauucucgauagcgaaggcaucaccgggacaaacucuuacuccuuuaugaaacacggaagcggcucuuucgccaucauugacgaucccuauagccccgagccucgcaagggguuucugggcgaggugagaugcccgacggaagagaccgcuaugcgggccucccccucuuguaagauggcgccuaaucuuaucgaauaccagcccgagauggacacagcugaaugcaccacaaacaugauugacccuauggccaucuucaauagaggaagccugccccagguccgcgauggcaugaccuuuacgcaauccauugagaaaaacaccgugcaggcccucacaaccggggagguuaaggcuucuauccggcugacacuggacgauuaugacguggucuaccagaauagccaguccgauugcagcgccaccuucaaaaaccuuacaggauguuacucuugcgacgaaggcuccagacuguguuaucaagugaaggcggagggggaaaccauuuuucauuucaucaaugaggaggaaagcaucaacguuauuaauaaaguguccccugaggucucuaacuacugcacggugcuccacuuuagccgccccgugaucuccauugaaggaacauaugauuguggccugucuaagcggccgauggucaucaaaggcacccucauugcuaccgccccucaugacgauagaaagcacgaagggggaagcucccugguugugaaccccaagggcgggagcguggacuucuuuggauggcuuucuggccugacauccuggcucgggggaccucugaaaaccuuccugacgauccuuggcuuucuggccgucggccuccugcucgugguuaucauuaucauuaucauucgcacagggaugcagcaggcucugaagaaaaagaucaaauga

SEQ ID NO: 14719 - RNA, 4020 nt, Artificial Sequence
  derived and/or modified CDS sequence (opt5) from TOSV(P233)__KU204976.1__GP
auguucaucgccaagcugcuccugauuagcugccuugugcagcaggcuuaccugaaauauaccaucauuuccgagaucggcaacgggacaagaacgucuuuuuguuacagcucccggaccucucucggaagccugcuugaagccugggacaaugucacagaguccauuggccugaccucugggacaugcaagguuggaagccucgaaaaccgcgauuguagaaaagacaucauguccaauuauguggcggaggugcacagcaaccugcauggccugggggcuaugaugcacaauuacggagaugacaagcgggucgaaauccucaacgaugugauucccgacgagcugaauccuggccaucacaacugcucugaucuugaccgcaaaccguucuggaccgaguuuaucaauguugccaagccccuguccgaaauugugccuaugagcgucaucccuccucccgugguuaagccucaaccgcccgccgagccuucuuccaaaaagcaugugcccuucgauguccuccugagcgaagcugagaaagagcuuaaccagacaaagauuagacuggaagacgagcggaaaucuaaugccgaagagaccgcuaaggaacgcgccagaaugaaggagaucgaggaugaacuccggcgcgagugggaacuggagagaaaacggaaggacgcgauggccgaugaccuggcuaaagaaacggcccgcagacgggagauugagcgcaaggcucacgaacucgacaaaaugcugaagaaaaaggagagagaaucccuuaucgccaaggagaaagcggaugaagacaugcggagccacgugcauaagccuaacaccacaagagcccccgcuccgaccaucauuacaacccugcucauggccuccgcugcccuggccggcccucuugagaaucgcgagacgaaccaucugcucaaucggcccgggaacggagcuuauacacugucugauuuugcggaaagcaccuguacacuggccuacggcuccgagugcaaaagcugggaacaccuccugaacgaggagcuuuuccccuuuuuccacucuaaucuggacaaguauuccaugcucgaagcugccaccgagaccgugcccauccugaacaaaagcucugccgucuguacaauuagccccuccacgcacucuagcaaugcuugcgggagagaagccuccguuauccgcaagaaguguuacagcaacaugucugcguuuuucuacauuaaucuugcuggacagaucaccgugaucaaaugcgagacaaaccaugugcuguccagcgauuguggcaauugcauuucuaagucccucagcgggcaaaaagucuauaccccugugcaggacguguuuugccagaagggauggacacaguccaucccgucuacccgguacagcaaagauauuuguuccaucggccugcacacgguuaaggaaugcaagauuggcacaaccucuuucgagagagucggguuuaucgugguuaaaggacgcaagauguauaucgagcaaaugaaaaugcggagcagacaggaauacuccgaggaccaguuccuguguuauaagagcgaaucuggcuccgggagcucugugaaacucaagaaguucaaagucaaguccugcaaaggagugaccacaagcucugccagcaaguguuccggcgaugaguacuuuugcagccgcuaucccugugaaaccgccaacgucgaggcucauugcauucugcggagacacucugccaucguggagguuaaugugaacggggucugggugguuccucgcuguauuggauacgaagaggugcuugucaaacggacaucccugaagguggaagacacgaccggcagagagugcgauagcugucucugggaaugcggcaaaaauaagcugaucgugaagacacaugggcccaaaguugucuacgcuaccgccugcucccacggaucuuguaagagcgugaugcagaaaccugcgacauucguguaucugcccuacccgggcaacuccgagauugucgggggagacaucggcauucacaugaccgaggaaucuagcccuuccaauauccaucuuguggcccacugccccgcucgggacucuugugauguuagcgacugccucuuuugugugcaugggcugcugaacuaucaaugccacacgcuguucuccgcccugcuuaucagcaccacagucaugucuauucugacccuccugcugcuucucgugaagggcgcuaaagaucugguuaagaagcuguuucacuggcucaucacaccucuguguuggcuuuccguguucugcuguugggucgugaaaagcuggaagcgcagaguuggaucugccauuucccggaccaaugacacgaucggcuggagagagaaccgccggcaugcgcaggauauugaaagagcccaguacacagggggagcucccggcgccaaauauagcuuuuacggggugaugauccugggacuccugucuuccgcucaaagcugcuccgagagcgucaucgccgacucuaagauuaugcaguguaccacaagcggcuccucuacccugugcaaagccagcgggaccgugaucaugcgccuuggcccuauuggauccgagucuugccucauccugaagggccugaaggauagcgaaaaacaguucauuuccaucaagacaaucucuagcgagcucacguguagagaaggggaguccuuuuggaccacacuguauacccccauuugccuuagcucucggcgcugucaccugaugggagaaugcguguccgacagaugucucaaauggaagacaaaccagaccagcgcugaguucacgggcaaagcgcauggggaugucaugcacgagaaucggugcuuugaacaaucuggaggcaucggguacggcuguuucaacguuaauccguccugccuguacgugcauagcuaucugaaguccguguaccgcaacggauuuaaggucuucagauguguggccuggaaucaccggauucgccuugagguuacaacccacucuagaaaauucccuauggugcucauggcuaugagcacccagcccacagacuggggcuccaucgggcugauucuggauagcgaaggaaucaccggcacaaacucuuauuccuuuaugaagcaugggagcggaucuuucgccaucauugacgaucccuacagcccugagccgcggaaaggcuuucucggggaaguccgcugccccacggaggagaccgccaugagagcuuccccuucuuguaagauggcccccaaucugaucgaauaucagccugagauggacacagcggaaugcaccacaaacaugauugaccccauggcuaucuucaaucggggcagccuuccucaggugagagauggaaugaccuuuacgcaauccauugagaaaaacaccguucaggcccugacaaccggcgaagugaaggccucuauccgccucacacuggacgauuacgacgucguguaucagaauagccaguccgauugcagcgcuaccuucaaaaaccugacaggguguuacucuugcgacgagggaucccggcuuuguuaccaaguuaaggccgagggcgaaaccauuuuucacuucaucaaugaggaagagagcaucaacgugauuaauaaggucucccccggggugucugauuauugcacggugcugcauuuuagcagaccggucaucuccauugagggaacauacgacuguggccucucuaaacgcccuaugguuaucaagggcacccugauugcgaccgcuccccacgaugaccggaaacaugaagggggaagcucccucguggugaacccuaagggcgggagcgucgauuucuuuggauggcugucuggccuuacauccuggcucgggggaccccucaaaaccuuccugacgauccugggcuuucuugccgugggccugcuccugguugugaucauuaucauuaucauuagaacagggaugcagcaggcccucaagaagaaaaucaaguga

SEQ ID NO: 14720 - RNA, 4020 nt, Artificial Sequence
  derived and/or modified CDS sequence (opt5) from TOSV(T152)__JX867535.1__GP
auguucaucgccaagcugcuccugauuagcugccuugugcagcaggcuuaccugaaauauaccaucauuuccgagaucggcaacgggacaagaacgucuagcuguuacuccucucggaccagccucggaucccugcuugaagccugggacaauauuacagagucuaucggccugaccagcgggacaugcaaggucggaucccucgaaaaccgcgauuguaaaagagacaucaugagcaauuauguugcggaggugcacucuaaccugcauggccugggggcuaugaugcacaauuacggagaugacaagcggguggaaguccucaacgaugugauucccgacgagcugaauccuggccgccauaacugcuccgaucuugacagaaaaccguuuuggaccgaguucaucaauguugccaagcccacaaacaagauugccccuaucagcgugauucccccucccaucgucaaaccuauuccgaucgcugaacccaccacgaagaaaaauaucccuuuugauaagcugcucucugaggccgaaaaagagcugaaccaaaccaagauucggcuugagacagaacgcagauccaaugcugaggaagccgcgaaggagcgggcccgcaugagagaaaucgaggacaaacugcggaaggauugggagcucgaacgcgagagaaaagacgcuguggccgaugaccuggcuaaggaaauugcccggcgcagagagaucgaacggaaagcgcacgagcuggacaagaugcucaaaaagaaggagagagaagaucugguugccauugagaaagugagcgaagacaugcgcaaccauguccggagacccaauaccacaaucgcuccugcccccaccaucauuacgacacuucugcucgcuucugccgugauggccggcccgcuggagaaccgcgaaaccaaccaccuucugaaucggccugggaacggagcuuauacacucuccgauuucgcggagagcaccuguacccuggccuacggcuccgagugcaagucuugggaacaccagcuggacgagcucagcuuucccuucuuucauuccaaucuggauaaauauagcaugcuugaagcugccacagagacgaucccuauucugaacaagucuuccgccguguguaccaucagccccucuacacacagcuccaaugcuugcgggagagaggccucucucauuaaaaagaaguguggaagcaacauguccgcguucuuuuacgucaaucuggcuggccagaucaccguugugaaaugcgacacaaaccaugugcuuagcaaugauugugggaacugcaucucuaagacccuguccggacagaaaauuuacacgcccguccaagacauguucugccagaagggcuggacagaaagcaucccuucuacccgcuauuccaaagaucucuguagcauuggccugcacaccgugaaggagugcaagacagggaccacaaauuuugaacggguuggauucaucguggucgaguccagaaaaauguacauugaacagaugaagaugcgcucucggcaagaguuuagcgaggaccaguuccuguguuauaaauccgaaucuagcuccggcagcucugugaagcucaaaaagguuaagguggaguccugcaaaggggucacgaccagcucugccuccaaguguagcggagaugaauacuucugcucuagauauccgugugagacagccaacguggaagcucacugcauccugcgccggcauagcgccgucauugaggugaauguuaacggcgugugggucgugcccagauguaucggguacgaggaaguucuugugcggcgcaccucccugaaagucgaggacacaagcucuagagaaugcgacaccugucucugggagugcggaaagaauaaacugaucgugaagacgcacggcccuaaaauuguguaugcuaccgccugcucccauggcagcuguaaguccguuaugcagaagcccgcgacauuugucuuccugccuuaccccgggaacucugaaaucgugggaggcgauauuggggugcacaugaccgaggagagcuccccgucuaacauccauauggucgcccacugcccugcuaaagacagcugugaaguguccucuugccucuuuuguguucacggacuucugaauuaccagugccauacacuguucagcgcccuccugauuuccaccacggugaugagcauccuuacacugcuccugcugcuugucaagggcgcuaaagaucucgugaagcggcuguuuuauuggcugaucacaccccucuguuggcugucuguuuucugcuccuggaugauuaaaagcuggagaaagcgcguggggucugccaucucccggaccaacgacaccauuggcuggagagauaaucgcagauacggacaagacgucgagcgggcgcaguauaccggcggggccccuggaacaaaguacagcuuuuauggcgugaugauccuugggcugcucggaaacguucacucuuguuccgaaagcgugauugcugauuccaaagucaugcagugcacgaccagcggcucuagcacacuguguaaggccuccgggaccgugaucaugaaacugggccccaucggaucugagagcugccuuauucucaagggccugaaagacuccgagaagcaauucaucucuauuaagacaaucagcuccgaacugaccugccgcgagggggaaucuuuuuggacgacacucuacaccccugugugucugagcuccagacggugccaucuuaugggagagugugucagcgaucgcugccugaaauggaagaccaaugaaacaucugcugaguucaccggcaaagcccacggggagguuaugcacgaaaacaaguguuuugagcaguccggaggcauuggguauggcugcuucaaugugaaccccagcugucucuacgugcauucuuaccugaaauccgucuauaagaauggauuuaagaucuucagaugcguggccuggaaccaccggauccgccuggaaguuacaacgcauagcagaaaauucccgauggugcuuauggcuauguccacccagccuacagacuggggcucuauugggcucauccuggauagcgagggaauuaccggcacaaaugcguacuccuuuaugaagcacgggagcggaucuuucgccaucauugacgaucccuauucccccgaaccucggaaaggcuuucugggggagguccgcuguccgaccgaggaaacggcuaucagagccagccccucuugcaagauggccccuaaccucauugaguaccagcccgaaauggacaccgcugaguguacaaccaauaugaucgacccuauggccaucuucaaccggggcagccugccccaagugagagauggaaugacauuuacccaguccauugagaaaaauacaguucaggcgcuuaccacgggcgaagugcgcgcuucuauccggcugacacucgacgauuaugacgucguguaccagaacagccaauccgauugcucugccaccuucaagaaccugaccgggugcuauagcugugacgagggauccagaaugugcuaccagguuaaagccgaaggcgagacaauuuuucauuucgugaaugaagaugagagcaucaacgucauuaauaaggugucuccugacguguccgauuacuguaccguccugcacuuuagccgccccguuaucuccaucgaggggcgguaugacugcggacuuucuaagagaccgauggugauuaaaggcacgcugaucgcuacagccccucacgaugaccgcaagcaugaaggcgggagcucccucguggucaaccccaaaggaggcaccguggauuucuuuggguggguuucuggacugacaagcuggcucggcgggccucugaagaccuuccuuacaauucugggauuucucgcgcugggccugcuucugguggucgugaucauuaucaucgcucggaccggcguucagcaggcccucaaaaagaagaauaaauga

SEQ ID NO: 14721 - RNA, 4020 nt, Artificial Sequence
  derived and/or modified CDS sequence (opt5) from TOSV(TOSV/P51)__KU204979.1__GP
auguucaucgccaagcugcuccugauuagcugccuugugcagcaggcuuaccugaaauauaccaucauuuccgagaucggcaacgggacaagaacgucuuuuuguuacagcucccggaccucucucggaagccugcuugaagccugggacaaugucacagaguccauuggccugaccucugggacaugcaagguuggaagccucgaaaaccgcgauuguagaaaagacaucauguccaauuauguggcggaggugcacagcaaccugcauggccugggggcuaugaugcacaauuacggagaugacaagcgggucgaaauccucaacgaugugauucccgacgagcugaauccuggccaucacaacugcucugaucuugaccgcaaaccguucuggaccgaguuuaucaauguugccaagccccuguccgaaauugugccuaugagcgucauucccccucccgugguuaagcuccaaccuccggccgagcccucuuccaaaaagcaugugccuuucgauguccugcuuagcgaagcugagaaagagcugaaccagacaaagaucagacucgaagacgagcggaaaucuaaugccgaagagaccgcuaaggaacgcgccagaaugaaggagaucgaggaugaacugcggcgcgagugggaacuggagagaaaacggaaggacgcgauggccgaugaccucgcuaaagaaacggcccgcagacgggagauugaccgcaaggcucacgagcuggauagaaugcuuaaaaagaaagaacgggagucccugaucgccaaggaaaaggcggacgagaacaugagaagccacgugcaugaacccaauaccacacgcgccccugcucccaccaucauuacaacccuccugauggccuccgcugcccuugccggcccgcuggagaaccgggagacgaaucaccuccugaacagaccugggaacggagcuuauacacugucugauuuugcggaaagcaccuguacacucgccuacggcuccgagugcaaaagcugggaacaucugcuuaaugaggagcuguuccccuuuuuccacucuaaccucgacaaguauuccaugcuggaagcugccaccgagaccgugccuauccuuaauaaaagcucugccgucuguacaauuagccccuccacgcacucuagcaacgcuugcgggcgcgaagccuccguuauccggaagaaauguuacagcaauaugucugcguuuuucuacauuaaccuggcuggacagaucaccguggugaagugcgagacaaaucauguccucuccagcgauuguggcaacugcaucucuaagucccugagcgggcaaaaaguguauacccccguucaggacguguuuugccagaagggauggacacaguccauuccuucuaccagauacagcaaagauaucuguuccauuggccugcacacggucaaggaaugcaaaaucggcacaaccucuuucgagcgcgugggguuuauuguugugaagggacggaagauguauaucgagcaaaugaaaaugagaagccgccaggaauacuccgaggaccaguuccucuguuauaagagcgaaucuggcuccgggagcucugucaaacugaagaaauucaagguggaguccugcaagggagucaccacaagcucugccagcaaauguuccggcgaugaauacuuuugcagccgguauccgugugagaccgccaauguggaggcucauugcauccuuagacgccacucugccauuguugaagugaacgucaaugggguguggguugugccccgguguaucggauacgaggaaguccuggugaagagaacaucccucaaaguggaggacacgaccggccgggaaugcgauagcugucugugggagugcggcaagaacaaacugauuguuaagacacaugggccuaaagucguguacgcuaccgccugcucccacggaucuuguaagagcgugaugcagaagcccgcgacauucgucuaucuuccuuaccccggcaauuccgagaucguugggggagacauuggcauccacaugaccgaagagucuagcccguccaacauucaucucguggcccacugcccugcucgcgacucuugugaugugagcgacugccuguuuuguguccaugggcugcucaauuaucaaugccacacgcuguucuccgcccuucugaucagcaccacagugaugucuauccucacccugcugcuucuccugguuaaaggcgcuaaggaucuggugaaaaagcucuuuuacuggcugauuacaccccuuuguuggcuguccgucuucugcuguugggugguuaaaagcuggaagagacgggugggaucugccaucuccagaaccaacgacacgauuggcuggcgcgaaaaccggagacacgcgcaggauaucgagcgcgcccaguauacagggggagcuccuggcgccaaguacagcuuuuauggggucaugauucucggacugcugucuuccgcucaaagcugcuccgagagcgugaucgccgacucuaaaaucaugcaguguaccacaagcggcuccucuacccuuugcaaggccagcgggaccgugauuaugagacucggccccaucggauccgaaucuugccugauucugaaaggccucaaggauagcgagaaacaguucaucuccauuaagacaaucucuagcgaacugacgugucgggagggggaauccuuuuggaccacacuuuacaccccuaucugccugagcucucgcagaugucaucucaugggagagugcgucuccgaccggugucugaaguggaaaacaaaucagaccagcgcugaguucacgggcaaggcgcacggggauguuaugcaugaaaaccgcugcuuugagcaaucuggaggcauuggguacggcuguuucaaugugaaccccuccugccuguaugugcacagcuaccuuaaauccgucuauagaaauggauuuaagguguuccgguguguugccuggaaccaucgcaucagacucgaagugacaacccacucucggaaauucccgaugguccugauggcuaugagcacccagccuacagacuggggcuccauugggcugauccucgauagcgagggaauuaccggcacaaauucuuacuccuuuaugaagcacgggagcggaucuuucgccaucaucgacgaucccuauagccccgaaccucgcaagggcuuucugggggaggugagaugcccgacggaggaaaccgccaugcgggcuucccccucuuguaaaauggccccuaaccuuguugaguaccagcccgaaauggacacagcggagugcaccacaaauaugauugacccuauggcuaucuucaacagaggcagccugccccaggugcgcgauggaaugaccuuuacgcaauccauugaaaagaauaccguccaggcccucacaaccggcgaggugaaagccucuauccggcugacacuggacgauuaugacguuguguaccagaacagccaguccgauugcagcgcuaccuucaagaaucuuacaggguguuacucuugcgacgagggauccagacuguguuaucaagucaaagccgaaggcgagaccauuuuucauuucaucaacgaagaggagagcauuaaugugaucaacaagguguccccucgcgucucugauuacugcacgguucuccacuuuagccggcccgugaucuccauugaagggacauaugacuguggacugucuaaaagaccgauggugaucaagggcacccucauugcgaccgcuccucaugaugaccgcaagcacgagggcgggagcucccuggucgugaaccccaaaggaggcagcguugauuucuuuggguggcuuucuggacugacauccuggcucggcgggccucugaagaccuuccugacgauccuuggauuucuggccgugggccuccugcucgucgugauuaucaucauuaucauucggacaggcaugcagcaggcccugaaaaagaaaaucaaguga

SEQ ID NO: 14722 - RNA, 4020 nt, Artificial Sequence
  derived and/or modified CDS sequence (opt5) from TOSV(TOSV_Italy/BB8/2014/human)__KY626661.1__GP
auguucaucgccaagcugcuccugauuagcugccuugugcagcaggcuuaccugaaauauaccaucauuuccgagaucggcaacgggacaagaacgucuuuuuguuacagcucccggaccucucucggaagccugcuugaagccugggacaauauuacagaguccaucggccugaccucugggacaugcaaggucggaagccucgaaaaccgcgauuguaaaagagacaucauguccaauuauguugcggaggugcacagcaaccugcauggccugggggcuaugaugcacaauuacggagaugacaagcggguggaaguccucaacgaugugauucccgacgagcugaauccuggccgccauaacugcucugaucuugacagaaaaccguucuggaccgaguuuaucgauguugccaagcccacaaauaagauugccccuauguccgugaucccuccucccauugucaaaccuaucccgguggcugaaagcaccauuaagaaaucuauccccuucgacaagcugcucuccgaggccgaaaaagagcugaaccaaacgaagauccggcuugagaccgaacgcagaagcaaugcugaggaagccgcgaaggagcgggcccgcaugagagaaauugaggauaaacugcggaaggacugggagcucgaacgcgagagaaaagaugcuguugccgacgaccuggcuaaggaaaucgcccggcgcagagagauugaacggaaagcgcacgagcuggauaagaugcucaaaaagaaggagagagaagaccugguggcccgcgagcgggucucugaagauaugagaaaccauguguguaaaccuaauacaaccaucgcucccgccccuacaauuaucaccacgcuucugauggcuuccgccgugauggccggcccccucgagaaccgcgaaacaaaucaucugcuuaaccggccggggaacggagcuuauacccugagcgacuuugcggaguccacaugcacccucgccuacggcucugaguguaagagcugggaacaccagcuggaugagcuguccuuccccuuuuuccacagcaaucucgacaaauauucuaugcuggaagcugccaccgagacaauccccauucuuaacaaguccagcgccgucugcacgaucucuccuagcacccacuccucuaaugcuugugggagagaggccagccugauuaaaaagaagugcggauccaacaugagcgcguuuuucuacguuaaucucgcuggccagaucacaguggugaaaugugauaccaaccauguccugucuaaugacugcgggaacugcauuuccaagacacuuagcggacagaaaaucuacacccccgugcaagauauguuuugucagaagggcuggacggaaucuauccccaauacacgcuauuccaaagaccugugcagcauuggccuccacuccguuaaggaguguaagaccgggaccacaaacuucgaacgggugggauuuaucgucgugaaaggcagaaagauguacauugagcagaugaaaaugcgcucucggcaagaguucagcgaggaucaguuccugugcuauaaguccgagucuagcuccgggagcucuguuaaacugaagaaggugaaagucgaauccuguaagggagugaccacaagcucugccuccaaaugcagcggcgacgaguacuuuuguucuagauauccuugcgaaacggccaaugucgaggcucacuguauccuccgccggcauagcgccgugauugaaguuaacgugaauggggucuggaucgugccgagaugcauuggauacgaggagguucuggugcggcgcaccucccuuaaggucgaagacacaagcucuagagagugugauaccugccugugggaaugcggcaaagacaagcucaucgugaaaacacacggccccaagaucguguaugcuaccgccuguucccaugggagcugcaaguccguuaugcagaaaccugcgacguucgucuaccugcccuacccuggaaacucugagauugugggcggggauaucggagugcacaugaccgaagagagcucccccucuaauauucauauggucgcccacuguccggcuaaggacagcugcgagguguccucuugucuguuuugcguucacggccuucucaacuaucagugucauacacuguucagcgcccugcucaucuccaccacagugaugagcauucugacccuucugcuccugcugaugaaaggggcuaaggaucuugucaaacggcucuuuuacuggcugaucacgccucugugcuggcucucuguguucuguggcuggguuaucaaguccuggaagaaaagagugggaagcgccauuucucgcacaaacgacaccaucggcuggcgggauaauagacgcuauagacaagacgucgaacgggcgcaguacacagggggagcccccggcgcuaaguauuccuuuuacggggugaugguucugggacuucugggcaacgugcacagcugcucugaguccgucauugccgauagcaaaaucaugcaguguaccaccuccgggagcucuacacucugcaaggcuagcggcacggugauuaugaaacugggaccuaucggcuccgaaucuugccugauccuuaaggggcucaaggacagcgagaaacaauucauuuccaucaagaccauuucuagcgagcugacaugucgcgaaggagaguccuuuuggaccacacuguauacccccgugugccucucuagcagacggugucaucugaugggcgaaugcgucuccgaucgcugucuuaaauggaagacgaaugagacaagcgccgaguucaccgggaaagcccacggagaaguuaugcacgagaacagaugcuuugaacagucuggcgggaucggcuacggauguuucaaugugaacccuuccugccuguacgugcauagcuaucucaagucugucuacaagaauggcuuuaaaaccuuccgguguguggcuuggaaccaccgcauuagacuggagguuacaacccauucccggaaguuccccauggugcugauggcgaugagcacacagccgacggacuggggguccaucggacuuauccucgauucugaaggcauuaccgggacaaaugccuauagcuuuaugcgccacggauccggcagcuucgcuaucauugacgacccuuacucucccgagcccagaaaaggguuucugggcgaaguccggugcccuaccgaggagacagccaucagagccuccccgagcuguaagauggcucccaaccugauugaauaucagccugagauggauaccgccgaaugcacgaccaauaugaucgaccccauggcgauuuucaaccgcggaucucucccucaagugcgggauggcaugacauuuacccagagcaucgagaaaaauacaguucaggcucugaccacaggggaagugagagccuccauccgccuuacccuggacgauuacgacgucguguaucagaacucucaaagcgauugcuccgccacguucaagaaucucacaggauguuacucuugcgacgagggcagccggauguguuaccagguuaaagcugagggggaaaccauuuuucauuucaucaacgaggaugaauccauuaacgugaucagcaaggucaaucccgacgugucugauuauugcaccgugcugcacuuuuccagaccugucauuagcaucgagggacgcuacgacuguggccuguccaagcggcccaugguuaucaaaggcacacuuauugccaccgcgccgcacgaugacagaaagcaugaagggggaucuagccugaucgugaacccuaaaggcgggacgguggacuucuuuggaugggucuccggccucacaucuuggcucgggggaccccugaagaccuuccugacaauucuuggcuuucuggcucucggccugcugcuugugguuaucauuaucaucauugcccgcaccggggugcagcaggcccugaaaaagaagaauaaauga

SEQ ID NO: 14723 - RNA, 4020 nt, Artificial Sequence
  derived and/or modified CDS sequence (opt5) from TOSV(TOSV-54441132704)__KX010933.1__GP
auguucaucgccaagcugcuccugauuagcugccuugugcagcaggcuuaccugaaauauaccaucauuuccgagaucggcaacgggacaagaacgucuuuuuguuacagcucccggaccucucucggaagccugcuugaagccugggacaaugucacagaguccauuggccugaccucugggacaugcaagguuggaagccucgaaaaccgcgauuguagaaaagacaucauguccaauuauguggcggaggugcacagcaaccugcauggccugggggcuaugaugcacaauuacggagaugacaagcgggucgaaauccucaacgaugugauucccgacgagcugaauccuggccaucacaacugcucugaucuugaccgcaaaccguucuggaccgaguuuaucaauguugccaagccccuguccgaaauugugccuaugagcgucauucccccucccgugguuaagcuccaaccuccggccgagcccucuuccaaaaagcaugugccuuucgauguccugcuuagcgaagcugagaaagagcugaaccagacaaagaucagacucgaagacgagcggaaaucuaaugccgaagagaccgcuaaggaacgcgccagaaugaaggagaucgaggaugaacugcggcgcgagugggaacuggagagaaaacggaaggacgcgauggccgaugaccucgcuaaagaaacggcccgcagacgggagauugagcgcaaggcucacgaacuggacaaaaugcuuaagaaaaaggagagaaagucccugaucgccaaagaaaaggcggauguggacaugcggagccacgugcauaaacccaacaccacaagagccccugcucccaccaucauuacaacccuccugauggccuccgcugcccuugccggcccgcuggagaaucgcgaaacgaaccaccuccugaaucggccugggaacggagcuuauacacugucugauuuugcggagagcaccuguacacucgccuacggcuccgagugcaagagcugggaacaucugcuuaacgaggaacuguuccccuuuuuccacucuaaucucgacaaauauuccaugcuggaggcugccaccgagaccgucccuauccuuaacaagagcucugccguuuguacaauuagccccuccacgcacucuagcaaugcuugcgggagagaagccuccgugauccgcaagaaauguuacagcaacaugucugcguuuuucuacauuaaucuggcuggacagaucaccgugaucaagugcgagacaaaccauguccucuccagcgauuguggcaauugcauuucuaaaucccugagcgggcaaaagguguauacccccguucaggacguguuuugccagaaaggauggacacaguccaucccuucuacccgguacagcaaggauauuuguuccaucggccugcacacggucaaggaaugcaaaauuggcacaaccucuuucgagagagugggguuuaucguugugaagggacgcaaaauguauaucgaacaaaugaagaugcggagcagacaggaguacuccgaggaccaguuccucuguuauaaaagcgaaucuggcuccgggagcucugucaagcugaagaaauucaagguggaguccugcaaaggagucaccacaagcucugccagcaaguguuccggcgaugaauacuuuugcagccgcuauccgugugagaccgccaacguggaagcucauugcauucuucggagacacucugccaucguugaggugaaugucaacgggguguggguugugccccgcuguauuggauacgaggaaguccuggugaaacggacaucccucaagguggaggacacgaccggcagagaaugcgauagcugucugugggagugcggcaaaaauaagcugaucguuaagacacaugggccuaaagucguguacgcuaccgccugcucccacggaucuuguaagagcgugaugcagaaacccgcgacauucgucuaucuuccuuaccccggcaacuccgaaauuguugggggagacaucggcauucacaugaccgaggagucuagcccguccaauauccaucucguggcccacugcccugcucgggacucuugugaugugagcgacugccuguuuuguguccaugggcugcucaacuaucaaugccacacgcuguucuccgcccuucugaucagcaccacagugaugucuauucucacccugcugcuucuccugguuaagggcgcuaaagaucuggugaagaagcucuuuuacuggcugaucacaccccuuuguuggcuguccgucuucugcuguugggugguuaaaagcuggaagcgcagagugggaucugccauuucccggaccaaugacacgaucggcuggagagaaaaccgccggcacgcgcaggauauugagagagcccaguauacagggggagcuccuggcgccaaauacagcuuuuauggggucaugauccucggacugcugucuuccgcucaaagcugcuccgaaagcgugaucgccgacucuaagauuaugcaguguaccacaagcggcuccucuacccuuugcaaagccagcgggaccgugaucaugcgccucggccccauuggauccgagucuugccugauccugaagggccucaaggauagcgagaaacaguucauuuccaucaagacaaucucuagcgaacugacguguagagagggggaauccuuuuggaccacacuuuacaccccuauuugccugagcucucggcgcugucaucucaugggagagugcgucuccgacagaugucugaaauggaagacaaaccagaccagcgcugaguucacgggcaaagcgcacggggauguuaugcaugagaaucggugcuuugagcaaucuggaggcaucggguacggcuguuucaacgugaaucccuccugccuguaugugcacagcuaccuuaaguccgucuaucgcaacggauuuaagguguucagauguguugccuggaaucaucggauucgccucgaagugacaacccacucuagaaaauucccgaugguccugauggcuaugagcacccagccuacagacuggggcuccaucgggcugauucucgauagcgagggaaucaccggcacaaacucuuacuccuuuaugaagcacgggagcggaucuuucgccaucauugacgaucccuauagccccgaaccucggaaaggcuuucugggggaggugcgcugcccgacggaagagaccgccaugagagcuucccccucuuguaagauggccccuaaucuuaucgaguaccagcccgaaauggacacagcggagugcaccacaaacaugauugacccuauggcuaucuucaaucggggcagccugccccagguuagagauggaaugaccuuuacgcaauccauugagaaaaacaccgugcaggcccucacaaccggcgaagucaaggccucuauccgccugauucuggacgauuaugacgugguuuaccagaauagccaguccgauugcagcgcuacauucaaaaaccuuaccggguguuacucuugcgacgaaggaucccggcuguguuaucaagugaaggccgagggcgagacaaucuuucauuucaucaaugaagaggaaagcauuaacgucaucaauaagguguccccuggggugucugauuacugcaccguccuccacuuuagcagacccguuauuuccaucgagggaacguaugacuguggccugucuaaacgcccgauggugauuaagggcacacucaucgcgaccgcuccucaugaugaccggaaacacgaagggggaagcucccugguggucaaccccaagggcgggagcguggauuucuuuggauggcuuucuggccugaccuccuggcucgggggaccucugaaaacauuccugaccauccuuggcuuucuggccguuggccuccugcucguggucauuaucauuaucauuaucagaacggggaugcagcaggcccugaagaagaaaaucaaguga

SEQ ID NO: 14724 - RNA, 3222 nt, Artificial Sequence
  derived and/or modified CDS sequence (opt5) from SFTSV(HB29)__NC_018138.1__GP
augaugaaggugaucugguucagcucccugauuugccucgucauccaguguucuggcgacagcgggcccauuaucugcgccggaccuauucacuccaacaaaucugcuggcaucccgcaucugcuuggguacagcgagaagaucugucaaauugauagacugauccacguuuccucuuggcuccggaaucauagccaguuucagggauaugugggccagcgcgggggaagaucccaagugagcuacuaucccgccgaaaacucuuacucccgguggagcggccugcuuucuccuugcgacgcggauuggcugggcaugcucgucgugaaaaaggcuaaagaguccgacaugauuguucccgggccuagcuauaagggaaagguguucuuugaacgccccaccuucgauggcuacgucggguggggauguggcucugggaaauccagaacagagagcggagaacugugcuccucugacagcggcacguccagcggccugcucccuucugaucgggugcuguggaucggggacguugccugucagccgaugacccccauuccugaggagacauuucuugaacugaaguccuucagccagucugaguuucccgauaucugcaaaauugacggaaucguguucaaucagugugaaggcgagagccucccucaacccuuugaugucgccuggauggacguggggcacucccauaagaucauuaugcgcgagcacaaaaccaagugggugcaggaaucuagcuccaaggauuucgucugcuauaaagagggaacaggcccguguagcgaaucugaggaaaaggcuugcaaaaccuccgggagcugcagaggagacaugcaguuuuguaagguugccggcugcgagcacggcgaggaggcuucugaagccaaaugucggugcucccuggugcauaagccuggggaaguggucgugagcuacggaggcacacgcguuagacccaaauguuacggguucucccggaugauggcgacccuugaggugaacccucccgaacagcgcaucggacaaugcacgggcugucaccuggagugcauuaaugggggcgucagacucaucacccugacaucugagcugcggagcgccaccgugugugcuucccauuuuugcucuagcgccuccagcggaaagaagucuacagaaauucacuuccacuccggcagccucguugggaaaaccgcuauccaugugaagggagcccuggucgacggcacggaguucacauuugaagggucuuguauguuccccgauggaugcgacgcgguggauugcaccuuuugucgcgaguuccuuaaaaacccucagugcuauccggccaagaaauggcuguuuaucauuaucgucauucuccugggcuacgcugggcuuaugcugcucacaaaugugcugaaggccaucggcguuuggggauccugggugauugcucccgucaagcugauguucgccaucaucaaaaagcucaugagaaccgugagcugucugguuggcaaacuuauggaccgggggagacaggugauucacgaagagaucggagagaacggcgaagggaaucaagaugacguccgcauugagauggcccggccuagacgcgugcggcauuggauguauucucccgugauccugaccauucucgcuaucggacuggcggaaggcugcgaugagaugguucacgccgacagcaagcuggucuccuguagacaggggagcggcaacaugaaagagugcauuacaacgggacgcgcucugcucccugccgugaaucccggccaggaagccugucugcauuuuaccgcuccggggucuccugauuccaagugccugaagaucaaagugaagcggaucaaccucaaauguaagaaaagcuccucuuacuucguccccgacgccagaagccgcugcacauccgugcggagaugucgcugggcgggagauugccagucuggcugcccuccccacuuuaccagcaauuccuucucugacgacugggcugggaagauggaucgggccggacugggcuuuagcggguguuccgacggcugcggaggcgccgcuugugggugcuucaacgccgcuccuagcuguaucuuuuggagaaaguggguugagaauccccacggaauuauuuggaaagugucuccgugcgccgcgugggucccuuccgccgugaucgaacuuacaaugcccagcggcgagguucggaccuuccaucccaugucugggauuccuacgcaaguguucaagggagucuccgugacauaucugggcagcgauauggaaguuucuggccucaccgaccugugugagaucgaggaacugaaauccaagaaacuugcucucgccccgugcaaccaggcugggaugggaguggucggcaaggugggggagauccaguguagcuccgaagagagcgcccgcaccauuaaaaaggauggaugcaucuggaacgcggaccuggugggcauugaacugagagucgaugacgccguuuguuacucuaagaucacaagcguggaggcuguggccaauuauuccgcuauucccaccacaaucgggggacuccgguuugagagaucucacgauagccagggcaaaaucuccggcucuccucuggacauuacggccauccgcgggagcuucuccgucaacuaccggggacuuagacugucucucagcgaaauuaccgccacaugcaccggcgaggugacaaauguuuccgggugcuacagcuguaugaccggagcuaaggugucuaucaaacugcauuccagcaagaacucuacggcgcacguccgcugcaaaggcgaugaaaccgccuuuuccgugcuggaggggguucacagcuauauugugagacuuuccuucgaccaugcugucguggaugaacaaugucagcucaauugcggaggccacgagucucagguuacacugaagggcaaccugaucuuucucgacgugcccaaguucgucgacgggagcuacaugcagaccuaucauuccacagugccuaccggagccaauauccccagcccuacggauuggcugaacgcccuuuuuggcaaugggcugucucgguggauucucggagugaucggcguccugcuugggggacuugcucucuucuuucugauuauguuccugcucaaacugggcacaaagcaaguuuuucgcuccagaaccaaacuugccuga

SEQ ID NO: 14725 - RNA, 3222 nt, Artificial Sequence
  derived and/or modified CDS sequence (opt5) from SFTSV(Jilin)__KT890281.1__GP
augaugaaggugaucugguucagcucccugauuugccucgucauccaguguggcggggacaccggacccauuaucugcgccggcccuauucacucuaacaaaagcgcuaauaucccgcaucugcuuggguacuccgagaagaucugucaaauugauagacugauccacguuucuagcuggcuccggaaccauucccaguuucagggauaugugggccagcgcgggggaagaucucaagugagcuacuaucccgccgaaaauuccuacagccgguggucuggccugcuuuccccuugcgacgcggauuggcugggcaugcucgucgugaaaaaggcuaaagggagcgacaugauuguucccggaccuucuuauaagggcaagguguucuuugagcgccccacauucgauggguacgucggauggggcuguggguccggaaaaagcagaacggaaucuggcgagcugugcuccagcgacuccggcaccucuagcgggcugcucccuuccgaucgggugcuguggaucggagacguugccugucagccgaugacacccauuccugaagagaccuuucuugagcucaagagcuucucucaguccgaauuucccgauaucugcaaaauugacggcaucguguucaaccagugugagggggaaagccugccucaacccuuugaugucgccuggauggacgugggacacucucauaagaucauuaugcgcgagcacaaaacaaagugggugcaggagagcuccucuaaggauuucgucugcuauaaagaaggcaccgggccguguagcgaguccgaagagaagacaugcaaaaccagcggaucuugcagaggcgacaugcaguuuuguaagguugcuggcugcgaacacggggaggaggccuccgaagcuaaaugucggugcagccuggugcauaagccuggagagguggucgugucuuacggcgggaugcgcguuagacccaaauguuacggauucucccggaugauggccccucuugaagugaauccucccgagcagcgcaucggccaaugcacggggugucaccuggaaugcauuaacggcggagucagacucaucacccugacaagcgagcugaaguccgcgaccgugugugccuaucauuuuugcucuugugcuacaagcggcaagaaauccaccgagauucaguuccacucugggagccucguuggaaagacggccauccacgugaaaggcgcucuggucgacgggacagaguucaccuuugaaggacggugcauguuccccgauggcugcgacgccguggauuguacauuuugccgcgaguuccuuaagaauccgcaguguuaccccgcgcaaaaauggcuguuuaucauuaucgucauucuccugggguaugccggccuuaugcugcucaccaacgugcugaaggcuaugggaguuuggggcuccugggugaucgccccugucaagcugguguucgcuauuaucaaaaagcucaugagagccguuagcugccugauggggaaacuuauggaccggggaagacaggugauccaugaagaaauuggcgagaaucgcgaggggaaccaggaugacguccggaucgaaauggccagaccccgccgggugagacacuggauguacucuccugugauucagaccaucguugcuauuggacuggcggagggcugugaugaaaugguccaugccgacuccaagcucgugagcugccgccaagggucuggcaauaugaaagagugugugacaacgggacgggcucugcuucccgccgucaacccgggccaggaggccugccugcacuuuaccgcuccugggucccccgauagcaagugucucaagaucagagugaaacgcauuaaucugaagugcaaaaagucuagcuccuauuucguuccugacgcccggagcagauguacaucugugcgccggugcagaugggcgggagauugccaguccggcugucccccucauuuuaccagcaacuccuucucugacgacugggcugggaaaauggaucgggccggacugggcuuuagcgggugcuccgacggcuguggaggcgccgcuugcggguguuucaaugccgcucccucuugcaucuuuuggcgcaagugggucgaaaacccgcacggaaucauuuggaaggugagcccuugugccgcguggguucccuccgccgugaucgagcucacaaugcccucuggcgaagucagaaccuuccacccuaugagcgggauuccgacacagguguucaaaggaguuuccgugacguaccugggcagcgauauggaggucucuggccuuaccgaccugugcgaaaucgaggagcucaaguccaaaaagcuggcucuggcccccuguaaccaagcugggaugggaguggugggcaaagucggggaaauucagugcagcucugaggaauccgcccggaccaucaagaaagauggauguaucuggaaugcggaccuuguuggcauugagcucagaguggaugacgccgugugcuauagcaagaucacaucugucgaagcuguggccaacuacuccgcuauuccuaccacaaucgggggacugcgcuuugagcggagccaugauucccagggcaagauuagcggcucuccccuggacaucacggccaucagagggagcuucuccguuaauuaccgcggacucagacugucucuuagcgagauuaccgccacaugcaccggcgaagugacaaacgucuccggguguuauucuugcaugaccggagcuaaagugagcaucaagcugcacuccucuaaaaauagcacggcgcauguucgguguaagggcgaugagaccgccuuuuccgugcucgaagggguccacagcuacucugugucccugagcuucgaccacgcuguuguggaugagcagugccaacugaacuguggaggccaugaaucucaggucacacuucgcggcaaucucauuuuucuggacgugccuaaauucguggacggguccuauaugcagaccuaccacagcacaguccccaccggagccaacaucccuucccccacggauuggcugaaugcccucuuuggcaacgggcugucuagauggauucuuggaguuaucggcgugcugcucgggggacuggcucuguucuuucuuaucaugagccucuucaagcugggcacaaagcagauuuuucggucccgcaccaaacuggccuga

SEQ ID NO: 14726 - RNA, 3222 nt, Artificial Sequence
  derived and/or modified CDS sequence (opt5) from SFTSV(05-Lu'an(CHN)-2015)__KX302597.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuccuggagcuuaaguccuuuagccagucugaguuccccgacaucugcaaaauugauggaaucguguuuaaucagugugagggcgaaagccugccucaacccuucgacgucgccuggauggauguggggcacucccauaagaucauuaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggaggccucuggggcuaaaugucggugcucccucgugcauaagccuggagaaguggucgugagcuacggcgggaugcgcguuagacccaaauguuacggauuuucccggaugauggccacccuggaggugaaccagccugaacaacgcaucggccagugcacggggugucaccuugagugcauuaauggcggagucagacugaucacccucacaucugaacuuaagagcgcgaccgugugugccucccauuucugcucuagcgcuacauccggcaagaaaagcaccgagauucaguuccacucugggucccugguuggaaagacggccauccacgugaaaggcgcucucgucgaugggacagaguuuaccuucgaaggaagcuguauguuucccgacggcugcgaugccguggacugcacauucugucgggaguuucugaagaacccccaaugcuauccugcgaaaaaguggcuuuucaucauuaucgucauucugcucggguacgccggccugaugcuucugaccaaugugcucaaggcuaucggaauuuggggcucuuggguuaucgccccggugaaacugauguuugcuaucauuaagaaacugaugcgcaccgucuccuaucucauggggaagcugauggauagaggaagacaggugauccaugaagagauuggcgaaaaccgggaggggaaucaggacgauguucgcaucgagauggcccggcccagacgcgugcggcacuggauguacagcccugucauucuuacaauccuggccauuggacucgcugaaucuugugacgagauggugcaugcggauagcaaacugguguccugcagacagggcagcgggaacaugaaggaauguguuacgaccggccgcgcccuucugcccgcugucaauccuggacaagaggccugccuccacuucacagcccccggcucuccggacuccaagugucugaaaaucaaggugaaacggaucaaccugaagugcaaaaagagcuccucuuauuuugugccugaugcuagaagccgcuguaccuccguccggagaugccgcugggccggggacugucagucuggaugucccccucauuucacaagcaauuccuuuucugacgauugggcgggcaagauggaccgggcugggcucggauucagcggcugcuccgaugggugcggcggagccgccugcggcuguuuuaacgcugcccccagcugcauuuucuggagaaaauggguggagaauccucacgggaucauuuggaagguuucucccugugcugccugggugccguccgcggucaucgaacugaccaugccuagcggagaggugcggacguuccaccccaugucuggcauucccacacagguuuuuaaagggguguccgucaccuaccuuggaagcgacauggaagugucuggccugaccgaucucugcgagaucgaagaacugaaguccaaaaagcuggcccuugcuccuuguaaccaggccggcauggggguugugggaaaagucggcgagauccaaugcagcuccgaagagagcgcucgcacaauuaagaaggacggguguaucuggaacgccgaucucgugggaauugaacugagaguggacgaugcggucugcuauucuaaaaucaccagcguugaggccguggcuaauuacuccgccauuccgacaacgaucggcgggcugcgguucgaaagaucucaugacagccagggaaagaucuccggcucuccccucgauauuaccgcuauccgcggcagcuuuuccgugaacuaccgggggcugagacuuucucugagcgagauuacagccaccuguacaggagaggucaccaauguguccggcugcuauagcugcaugacgggggccaaaguuucuaucaagcuccacuccagcaaaaacucuaccgcucaugugcgcuguaagggagacgaaacagcguucuccguccuggagggcgugcacagcuacaccguuucccugucuuuugaucacgccguggucgacgaacagugccagcuuaauugugggggacaugagagccaagugacacucaagggcaaccugauuuuccuggacguuccuaaauuuguggauggcuccuauaugcagaccuaccacagcacgguccccacaggggcuaauaucccuucucccaccgacuggcucaacgcccuguucggaaauggccuuuccagauggauccugggggugauuggagugcuccugggcgggcuggcccuguuuuucaugaucaugagccucuuuaagcugggaacaaaacaggucuuccggucucgcaccaagcuggcuuga

SEQ ID NO: 14727 - RNA, 3222 nt, Artificial Sequence
  derived and/or modified CDS sequence (opt5) from SFTSV(07-Lu'an(CHN)-2015)__KX302598.1__GP
augaugaaggugaucugguucagcucccugauuugccucgucauccaguguucuggcgacagcgggcccauuaucugcgccggaccuauucacuccaacaaaucugcuggcaucccgcaucugcuuggguacagcgagaagaucugucaaauugauagacugauccacguuuccucuuggcuccggaaucauagccaguuucagggauaugugggccagcgcgggggaagaucccaagugagcuacuaucccgccgaaaacucuuacucccgguggagcggccugcuuucuccuugcgacgcggauuggcugggcaugcucgucgugaaaaaggcuaaagaguccgacaugauuguucccgggccuagcuauaagggaaagguguucuuugaacgccccaccuucgauggcuacgucggguggggauguggcucugggaaauccagaacagagagcggagaacugugcuccucugacagcggcacguccagcggccugcucccuucugaucgggugcuguggaucggggacguugccugucagccgaugacccccauuccugaggagacauuucuugaacugaaguccuucagccagucugaguuucccgauaucugcaaaauugacggaaucguguucaaucagugugaaggcgagagccucccucaacccuuugaugucgccuggauggacguggggcacucccauaagaucauuaugcgcgagcacaaaaccaagugggugcaggaaucuagcuccaaggauuucgucugcuauaaagagggaacaggcccguguagcgaaucugaggaaaaggcuugcaaaaccuccgggagcugcagaggagacaugcaguuuuguaagguugccggcugcgagcacggcgaggaagcuagcgaggccaaaugucggugcucccuggugcauaagccuggggaaguggucgugagcuacggaggcaugcgcguuagacccaaauguuacggguucucccggaugauggcgacacuugaggugaacccucccgaacagcgcaucggacaaugcaccggcugucaccuggagugcauuaaugggggcgucagacucaucacgcugaccucugagcugcggagcgccacagugugugcuucccauuuuugcucuagcgccaccuccggaaagaagucuacagaaauucacuuccacucuggcucccucguugggaaaaccgcuauccaugugaagggagcccuggucgacggcacggaguucacauuugaagggagcuguauguuccccgauggaugcgacgcgguggauugcaccuuuugucgcgaguuccuuaaaaacccucagugcuauccggccaagaaauggcuguuuaucauuaucgucauucuccugggcuacgcugggcuuaugcugcucacaaaugugcugaaggccaucggcguuuggggaucuugggugauugcucccgucaagcugauguucgccaucaucaaaaagcucaugagaaccguguccugucugguuggcaaacuuauggaccgggggagacaggugauucacgaagagaucggagagaacggcgaagggaaucaagaugacguccgcauugagauggcccggccuagacgcgugcggcauuggauguauagccccgugauccugaccauucucgcuaucggacuggcggaaggcugcgaugagaugguucacgccgacucuaagcuggucagcuguagacagggguccggcaacaugaaagagugcauuacaacgggacgcgcucugcucccugccgugaaucccggccaggaagccugucugcauuuuaccgcuccggggagcccugauucuaagugccugaagaucaaagugaagcggaucaaccucaaauguaagaaauccagcuccuacuucguccccgacgccagaucucgcugcacaagcgugcggagaugucgcugggcgggagauugccaguccggcugcccuccccacuuuaccucuaauagcuucuccgacgacugggcugggaagauggaucgggccggacugggcuuuucuggguguagcgacggcugcggaggcgccgcuugugggugcuucaacgccgcuccuuccuguaucuuuuggagaaaguggguugagaauccccacggaauuauuuggaaagugagcccgugcgccgcgugggucccuucugccgugaucgaacuuacaaugcccuccggcgagguucggaccuuccaucccaugagcgggauuccuacgcaaguguucaagggagucucugugacauaucugggcuccgauauggaaguuagcggccucaccgaccugugugagaucgaggaacugaaaucuaagaaacuugcucucgccccgugcaaccaggcugggaugggaguggucggcaaggugggggagauccaguguuccagcgaagaguccgcccgcaccauuaaaaaggauggaugcaucuggaacgcggaccuggugggcauugaacugagagucgaugacgccguuuguuacagcaagaucacaucuguggaggcuguggccaauuauagcgcuauucccaccacaaucgggggacuccgguuugagagaucccacgauucucagggcaaaaucagcggcuccccucuggacauuacggccauccgcgggucuuucagcgucaacuaccggggacuuagacugucccucucugaaauuaccgccacaugcaccggcgaggugacaaauguuagcgggugcuacuccuguaugaccggagcuaaggugagcaucaaacugcauucuuccaagaacagcacggcgcacguccgcugcaaaggcgaugaaaccgccuuuucugugcuggaggggguucacuccuauauugugagccuuuccuucgaccaugcugucguggaugaacaaugucagcucaauugcggaggccacgagucucagguuacacugaagggcaaccugaucuuucucgacgugcccaaguucgucgacgggagcuacaugcagaccuaucauuccacagugccuaccggagccaauauccccagcccuacggauuggcugaacgcccuuuuuggcaaugggcugucuagauggauucucggagugaucggcguccugcuugggggacuugcucucuucuuucugauuauguuccugcucaaacugggcacaaagcaaguuuuucggucccgcaccaaacuugccuga

SEQ ID NO: 14728 - RNA, 3222 nt, Artificial Sequence
  derived and/or modified CDS sequence (opt5) from SFTSV(12-Lu'an(CHN)-2014)__KX302595.1__GP
augaugaaggugaucugguucagcucccugauuugccucgucauccaguguucuggcgacaccgggcccauuaucugcgccggaccuauucacagcaacaaauccgcuaauaucccgcaucugcuuggcuacucugagaagaucugucaaauugauagacugauccacguuagcuccuggcuccggaaccauucucaguuucagggguaugugggacagcgcggcgggagaagccaaguguccuacuaucccgccgaaaauagcuacucucggugguccggacugcuuagcccuugcgacgcggauuggcugggcaugcucgucgugaaaaaggcuaaaggcucugacaugauuguucccgggccuuccuauaagggaaagguguucuuugagcgccccacauucgauggcuacgucggguggggauguggcagcgggaaaucuagaacggaauccggagagcugugcagcuccgacucuggcaccagcuccggccugcucccuagcgaucgggugcuguggaucggggacguugccugucagccgaugacacccauuccugaagagaccuuucuugagcugaagucuuucucccagagcgaauuucccgauaucugcaaaguggacggaauugucuucaaccagugugauucugagagccucccucaacccaucgacguggccuggauggaugugggccacucccauaagaucauuaugcgcgaacacaaaacaaaguggguccaggagucuagcuccaaggacuuuguuugcuauaaagaggggaccggaccguguagcgaaucugaggaaaagacaugcaaaaccuccggcagcugcagaggggacaugcaguucuguaagguggcuggaugcgagcacggcgaagaggccucugaggcuaaaugucggugcucccuggugcauaagccuggcgaagucgugguuagcuacgggggaaugcgcgugagacccaaauguuacggcuuuucccggaugauggccacgcuugaggucaauccucccgaacagcgcaucgggcaaugcaccggaugucaccuggagugcauuaacggcggggugagacucaucacacugaccucugaacuuaagagcgcgacaguuugugccucccauuucugcucuagcgcuaccuccggcaagaaaagcacggagauucaguuucacucuggaucccucgugggcaaggccgcuauccacgucaaaggggcccugguggauggaacagaguucaccuucgaaggcagcuguauguuucccgacgggugcgaugcggucgacugcacauucugucgggaguuucuuaagaauccucagugcuauccggccaaaaaguggcuguucaucauuaucgugauucuccugggauacgcuggccuuaugcugcucaccaacguucugaaggccaucgggguguggggcucuugggucauggcucccgugaaacugauguuugccauuaugaagaaacucaugcgcuccguuagcugucugaugggaaagcugauggauagaggccggcaagugauccaugaagagaucggggaaaauagagagggaaaccaggacgauguccgcauugagauggcccggccuagacgcgugcggcacuggauguauucucccgugauccugaccauucucgcuaucggccuggcggaagggugcgacgagaugguucaugccgauagcaaacuugucuccuguagacagggaagcggcaauaugaaggaaugcgugacaacggggcgcgcucugcucccugccgugaaccccggccaggaggccugucugcacuucaccgcuccgggaucuccugacuccaagugccugaaaauuaaggucaaacggaucaaucucaaguguaaaaagagcuccucuuacuuugugcccgaugccagaagccgcugcacauccguucggagaugucgcugggcgggcgacugccaaucugggugcccuagcuauuucaccuccaacucuuuuagcgacgauugggcuggaaagauggaccgggccggccugggguucuccggauguagcgauggcugcgggggcgccgcuuguggaugcuuuaaugccgcucccucuuguauuuucuggagaaaauggguggagaacccucauggcaucaucuggaaggucucccccugcgccgcgugggugccgagcgccguuauugaacuuacaaugccuucuggggaggugcggaccuuucaccccauguccggaauccccacgcaggucuucaaaggcgugagcguuacauaccuggggucugacauggaaguguccggacucaccgaucugugugagauugaggaacuuaagagcaaaaagcuggcucucgccccuugcaaccaggcuggcaugggcgucguggggaaagugggagagauccaguguuccagcgaagagucugcccgcaccauuaagaaggacggcugcaucuggaaugcggaucuggucgggaucgaacugagaguugacgaugccguguguuauagcaaaauuacauccguggaggcugucgccaacuacucugcuaucccgaccacaauuggaggccuccgguucgaaagaagccacgacucccaagggaagaucucuggaagcccccuggauauuacggccauccgcggcuccuuuucugugaauuaccggggccuuagacugagccucuccgagaucaccgccacaugcaccggggagguuacaaacgugagcggaugcuauucuuguaugaccggcgcuaaagucuccauuaagcugcauagcucuaaaaauuccacggcgcacgugcgcugcagaggggacgaaaccgccuucagcguucuggagggagugcauuccuacacagucucucuuagcuuugaucacgcugugguugacgaacagugucagcucaacugcggcgggcacgagucccaggugacccugaagggaaaucugaucuuccucgacgucccuaaguuuguggauggcagcuauaugcaaacauaccauucuuccgugcccaccggcgccaacauuccuagccccacggacuggcugaaugcccuuuucgggaacggacugucucgguggauccucggcgucauugggguucugcugggagugcuugcucucuuuuuccugaucaugagccuguuuaaacucggcacaaaacaggugauccgcuccagaaccaagcuggccuga

SEQ ID NO: 14729 - RNA, 3222 nt, Artificial Sequence
  derived and/or modified CDS sequence (opt5) from SFTSV(14-Lu'an(CHN)-2014)__KX302596.1__GP
augaugaaggugaucugguucagcucccugauuugccucgucauccaguguucuggcgacaccgggcccauuaucugcgccggaccuauucacagcaacaaauccgcuaauaucccgcaucugcuuggcuacucugagaagaucugucaaauugauagacugauccacguuagcuccuggcuccggaaccauucucaguuucagggguaugugggacagcgcggcgggagaagccaaguguccuacuaucccgccgaaaauagcuacucucggugguccggacugcuuagcccuugcgacgcggauuggcugggcaugcucgucgugaaaaaggcuaaaggcucugacaugauuguucccgggccuuccuauaagggaaagguguucuuugagcgccccacauucgauggcuacgucggguggggauguggcagcgggaaaucuagaacggaauccggagagcugugcagcuccgacucuggcaccagcuccggccugcucccuagcgaucgggugcuguggaucggggacguugccugucagccgaugacacccauuccugaagagaccuuucuugagcugaagucuuucucccagagcgaauuucccgauaucugcaaaguggacggaauugucuucaaccagugugauucugagagccucccucaacccaucgacguggccuggauggaugugggccacucccauaagaucauuaugcgcgaacacaaaacaaaguggguccaggagucuagcuccaaggacuuuguuugcuauaaagaggggaccggaccguguagcgaaucugaggaaaagacaugcaaaaccuccggcagcugcagaggggacaugcaguucuguaagguggcuggaugcgagcacggcgaagaggccucugaggcuaaaugucggugcucccuggugcauaagccuggcgaagucgugguuagcuacgggggaaugcgcgugagacccaaauguuacggcuuuucccggaugauggccacgcuugaggucaauccucccgaacagcgcaucgggcaaugcaccggaugucaccuggagugcauuaacggcggggugagacucaucacacugaccucugaacuuaagagcgcgacaguuugugccucccauuucugcucuagcgcuaccuccggcaagaaaagcacggagauucaguuucacucuggaucccucgugggcaaggccgcuauccacgucaaaggggcccugguggauggaacagaguucaccuucgaaggcagcuguauguuucccgacgggugcgaugcggucgacugcacauucugucgggaguuucuuaagaauccucagugcuauccggccaaaaaguggcuguucaucauuaucgugauucuccugggauacgcuggccuuaugcugcucaccaacguucugaaggccaucgggguguggggcucuugggucauggcucccgugaaacugauguuugccauuaugaagaaacucaugcgcuccguuagcugucugaugggaaagcugauggauagaggccggcaagugauccaugaagagaucggggaaaauagagagggaaaccaggacgauguccgcauugagauggcccggccuagacgcgugcggcacuggauguauucucccgugauccugaccauucucgcuaucggccuggcggaagggugcgacgagaugguucaugccgauagcaaacuugucuccuguagacagggaagcggcaauaugaaggaaugcgugacaacggggcgcgcucugcucccugccgugaaccccggccaggaggccugucugcacuucaccgcuccgggaucuccugacuccaagugccugaaaauuaaggucaaacggaucaaucucaaguguaaaaagagcuccucuuacuuugugcccgaugccagaagccgcugcacauccguucggagaugucgcugggcgggcgacugccaaucugggugcccuagccauuucaccuccaacucuuuuagcgacgauugggcuggaaagauggaccgggccggccugggguucuccggauguagcgauggcugcgggggcgccgcuuguggaugcuuuaaugccgcucccucuuguauuuucuggagaaaauggguggagaacccucacggcaucaucuggaaggucucccccugcgccgcgugggugccgagcgccguuauugaacuuacaaugccuucuggggaggugcggaccuuucaccccauguccggaauccccacgcaggucuucaaaggcgugagcguuacauaucuggggucugacauggaaguguccggacucaccgaucugugugagauugaggaacuuaagagcaaaaagcuggcucucgccccuugcaaccaggcuggcaugggcgucguggggaaagugggagagauccaguguuccagcgaagagucugcccgcaccauuaagaaggacggcugcaucuggaaugcggaucuggucgggaucgaacugagaguugacgaugccguguguuacagcaaaauuacauccguggaggcugucgccaacuauucugcuaucccgaccacaauuggaggccuccgguucgaaagaagccaugacucccaagggaagaucucuggaagcccccuggauauuacggccauccgcggcuccuuuucugugaauuaccggggccuuagacugagccucuccgagaucaccgccacaugcaccggggagguuacaaacgugagcggaugcuacucuuguaugaccggcgcuaaagucuccauuaagcugcacagcucuaaaaauuccacggcgcaugugcgcugcagaggggacgaaaccgccuucagcguucuggagggagugcacuccuauacagucucucuuagcuuugaucacgcugugguugacgaacagugucagcucaacugcggcgggcaugagucccaggugacccugaagggaaaucugaucuuccucgacgucccuaaguuuguggauggcagcuacaugcaaacauaucacucuuccgugcccaccggcgccaacauuccuagccccacggacuggcugaaugcccuuuucgggaacggacugucucgguggauccucggcgucauugggguucugcugggagugcuugcucucuuuuuccugaucaugagccuguuuaaacucggcacaaaacagguguuccgcuccagaaccaagcuggccuga

SEQ ID NO: 14730 - RNA, 3222 nt, Artificial Sequence
  derived and/or modified CDS sequence (opt5) from SFTSV(18-Lu'an(CHN)-2015)__KX302599.1__GP
augaugaaggugaucugguucuuuagccugauuugcuucgucauccaguguuccggcgacucugggcccauuaucugcgccggaccuauucacagcaacaaauccgcugauaucccgcaucuccugggcuacucugagaagaucugucaaauugacagacuuauccacguuagcuccuggcugcggaaucauucucaguuucagggguaugugggacagcgcggcgggagaagccaaguguccuacuaucccgccgaaaacagcuacucucggugguccggacuccugagcccuugcgaugcggacuggcuuggcaugcuggucgugaaaaaggcuaaaggcucugauaugauuguucccgggccuuccuauaagggaaagguguucuuugagcgccccaccuucgacggcuacgucggguggggauguggcagcgggaaaucuagaacagaauccggagagcucugcagcuccgauucuggcacgagcuccggccugcugccuagcgaccgggugcucuggaucggggauguugccugucagccgaugacccccauuccugaagagacauuucuggagcuuaagucuuucucccagagcgaauuucccgacaucugcaaaauugauggaaucguguucaaucagugugagggcgaaucucugccucaacccuuugacgucgccuggauggauguggggcacagccauaagaucauuaugcgcgagcacaaaaccaagugggugcaggaguccucuagcaaggacuucgucugcuauaaagaaggaacaggcccguguuccgagagcgaagagaagaccugcaaaacaucuggguccugcagaggagacaugcaguuuuguaagguugcuggcugcgaacacggcgaggaggccagcgaagcuaaaugucggugcucucucgugcauaagccuggggagguggucguguccuaccgcggaaugagaauccggcccaaauguuacggcuucagccgcaugauggccacccuggaaguuaaccagccugagcaaagaauugggcagugcacgggaugucaccuugaaugcaucaauggcggggugcggcugauuacccucacauccgagcugaagucugcgaccgucugugccagccauuucugcuccucugcuacaagcggcaagaaauccaccgagauccaguuucacagcggaucucuggugggcaagacggccauccacguuaaaggggcucucguggauggaacagaguucaccuuugaaggcuccuguauguuccccgacgggugcgaugccgucgacugcacauuuugucgcgaguuccugaagaacccccaaugcuauccugcgaaaaaguggcuuuuuauuaucauugugauccugcucggauacgccggccugaugcuucugaccaauguccucaaggcuauugggaucuggggcagcugggugaucgccccgguuaaacugauuuucgcuaucauuaagaaacugaugagaaccgugucuugucucaugggaaagcugauggaucggggcagacaggucauccaugaagaaauuggggagaaccgcgagggaaaucaggacgaugugcggaucgaaauggccagaccccgccggguuagacacuggauguauuccccugugauucuuacaauccuggccaucggccucgcugaggggugcgacgaaaugguccaugcggauagcaaacuggugucuugucgccagggaagcggcaacgugaaggagugcguuacgaccgggcgggcccuucugcccgcugucaauccuggccaagaggccugucuccacuuuacagcccccggauccccggacagcaagugccugaaaauuagagugaagcgcaucaaccugaaauguaagaaaucuuccagcuacuucgugccugaugcucgguccagaugcaccucuguccgccgguguagaugggccggcgacugccagagcgggugucccccucauuuuacauccaauucuuucagcgacgauugggcgggaaagauggaccgggcuggccucggguuuuccggaugcucugauggcugcgggggcgccgccuguggaugcuucaacgcugcccccagcuguauuuucuggcgcaaguggguggaaaauccucacggcaucauuuggaaaguuucccccugcgcugccugggugccgagcgcggucaucgagcugaccaugccuucuggggaagugagaacguuucaccccauguccggaauccccacacagguuuucaagggcgugagcauuaccuaucuugggucugacauggaggucuccggacugaccgaucucugugaaaucgaggagcugaaaagcaagaaacuggcccuugcuccuugcaaccaggccggcaugggcgugguugggaaggugggagaaauucaauguucuuccgaggaaagcgcucggacaaucaaaaaggacggcugcauuuggaacgccgaucucgucgggaucgagcugagaguggacgaugcgguguguuacuccaagaucaccagcgucgaagccguugcuaauuauucugccauuccgacaacgaucggaggccugcgcuuugagcggagccaugacucccaggggaaaauuucuggaagcccccucgauaucaccgcuauuagaggcuccuucucugugaacuaccgcggccugagacuuagccuguccgagaucacagcuaccugcacaggggaagugaccaaugucucuggaugcuacagcuguaugacgggcgccaagguguccaucaaacuccacagcaacaaaaauucuaccgcccauguucggugcaagggggacgagacagcguuuuccgugcuggaaggaguccacagcuauaccgugucucuguccuucgaucacgccguuguggacgagcagugucagcuuaacugcggcgggcaugaaagccaagucacacucaagggaaaucugauuuuucuggacgugccuaaguucguugauggcuccuacaugcagaccuaucacucuacggugcccacaggcgcuaacaucccuagccccaccgacuggcucaaugcccuguuugggaacggacuuucccgcuggauucugggcgucaucggggugcuccugggaggccuggcccuuuucuuuaugauuaugagccucuucaaacuggggacaaaacagguguuuagaucucggaccaagcuggcuuga

SEQ ID NO: 14731 - RNA, 3222 nt, Artificial Sequence
  derived and/or modified CDS sequence (opt5) from SFTSV(27-Lu'an(CHN)-2015)__KX302600.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuccuggagcuuaaguccuuuagccagucugaguuccccgacaucugcaaaauugauggaaucguguuuaaucagugugaaggcgaaagccugccucaacccuucgacgucgccuggauggauguggggcacucccauaagaucauuaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcaucagacccaaauguuacggguuuucccggaugauggccacccuggaaguuaaccagccugagcaacgcauuggacagugcacgggcugucaccuugaaugcaucaaugggggcgugagacugauuacccucacaucugagcuuaagagcgcgaccgucugugccucccauuucugcucuagcgcuacauccggaaagaaaagcaccgagauccaguuccacucuggcucccugguggggaagacggccauccacguuaaaggagcucucguggauggcacagaauuuaccuucgaggggagcuguauguuucccgacggaugcgaugccgucgacugcacauucugucgggaauuucugaagaacccccaaugcuauccugcgaaaaaguggcuuuucauuaucauugugauccugcucggcuacgccgggcugaugcuucugaccaauguccucaaggcuauuggcaucuggggaucuugggugaucgccccgguuaaacugauuuuugcuaucauuaagaaacugaugcgcaccguguccugucucaugggcaagcugauggauagagggcggcaggucauccaugaggaaauuggagagaacagagagggcaaucaggacgaugugcgcaucgaaauggcccggcccagacgcguucggcacuggauguauagcccugugauucuuacaauccuggccaucgggcucgcugagucuugcgacgaaaugguccaugcggauagcaaacugguguccuguagacagggaagcggcaacaugaaggagugcgugacgaccgggcgcgcccuucugcccgcuguuaauccuggccaagaggccugucuccacuucacagcccccggaucuccggacuccaagugccugaaaauuaaggucaaacggaucaaccugaaguguaaaaagagcuccucuuacuuugugccugaugcuagaagccgcugcaccuccgugcggagaugucgcugggccggcgacugccagucugggugucccccucauuucacaagcaauuccuuuucugacgauugggcgggaaagauggaccgggcuggccucggguucagcggaugcuccgauggcugcgggggcgccgccuguggaugcuuuaacgcugcccccagcuguauuuucuggagaaaaugggucgaaaauccucacggcaucauuuggaaggugucucccugcgcugccuggguuccguccgcggugaucgagcugaccaugccuagcggggaaguccggacguuccaccccaugucuggaauccccacacagguguuuaaaggcguuuccgugaccuaucuugggagcgacauggaggucucuggacugaccgaucucugugaaauugaggagcugaaguccaaaaagcuggcccuugcuccuugcaaccaggccggcaugggcgugguugggaaagugggagaaauccaauguagcuccgaggaaagcgcucgcacaauuaagaaggacggcugcaucuggaacgccgaucucgucgggauugagcugagaguggacgaugcgguguguuacucuaaaaucaccagcgucgaagccguugcuaauuauuccgccaucccgacaacgauuggaggccugcgguucgagagaucucaugacagccaggggaagaucuccggaucuccccucgauauuaccgcuauccgcggcagcuuuuccgugaacuaccggggccugagacuuucucugagcgagauuacagcuaccugcacaggggaagugaccaaugucuccggaugcuacagcuguaugacgggcgccaaagugucuaucaagcuccacuccagcaaaaacucuaccgcccauguucgcugcaagggggacgagacagcguucuccgugcuggaaggaguccacagcuauaccgugucccugucuuuugaucacgccguuguggacgagcagugucagcuuaauugcggcgggcaugaaagccaagucacacucaagggaaaccugaucuuccuggacgugccuaaauuuguugauggcuccuacaugcagaccuaucacagcacggugcccacaggcgcuaauauuccuucucccaccgacuggcucaacgcccuguucgggaauggacuuuccagauggauccugggcgucauuggggugcuccugggaggccuggcccuguuuuucaugaucaugagccucuuuaagcuggggacaaaacagguguuccggucucgcaccaagcuggcuuga

SEQ ID NO: 14732 - RNA, 3222 nt, Artificial Sequence
  derived and/or modified CDS sequence (opt5) from SFTSV(36-Lu'an(CHN)-2015)__KX302601.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuccuggagcuuaaguccuuuagccagucugaguuccccgacaucugcaaaauugauggaaucguguuuaaucagugugaaggcgaaagccugccucaacccuucgacgucgccuggauggauguggggcacucccauaagaucauuaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcguuagacccaaauguuacggguuuucccggaugauggccacccuggaagugaaccagccugagcaacgcaucggacagugcacgggcugucaccuugaaugcauuaaugggggcgucagacugaucacccucacaucugagcuuaagagcgcgaccgugugugccucccauuucugcucuagcgcuacauccggaaagaaaagcaccgagauucaguuccacucuggcucccugguugggaagacggccauccacgugaaaggagcucucgucgauggcacagaauuuaccuucgaggggagcuguauguuucccgacggaugcgaugccguggacugcacauucugucgggaauuucugaagaacccccaaugcuauccugcgaaaaaguggcuuuucaucauuaucgucauucugcucggcuacgccgggcugaugcuucugaccaaugugcucaaggcuaucggcauuuggggaucuuggguuaucgccccggugaaacugauguuugcuaucauuaagaaacugaugcgcaccgucuccugucucaugggcaagcugauggauagagggagacaggugauccaugaggaaauuggagagaaccgggagggcaaucaggacgauguucgcaucgaaauggcccggcccagacgcgugcggcacuggauguauagcccugucgugcuuacaauucuggccaucgggcucgcugagucuugcgacgaaauggugcaugcggauagcaaacugguuuccuguagacagggaagcggcaacaugaaggagugcgucacgaccgggcgcgcccuucugcccgcugugaauccuggccaagaggccugucuccacuucacagcccccggaucuccggacuccaagugccugaaaauuaaggugaaacggaucaaccugaaguguaaaaagagcuccucuuacuuugucccugaugcuagaagccgcugcaccuccgugcggagaugucgcugggccggcgacugccagucugggugucccccucauuucacaagcaauuccuuuucugacgauugggcgggaaagauggaccgggcuggccucggguucagcggaugcuccgauggcugcgggggcgccgccuguggaugcuuuaacgcugcccccagcuguaucuucuggagaaaauggguugaaaauccucacggcauuaucuggaaggugucucccugcgcugccugggucccguccgcggugauugagcugaccaugccuagcggggaaguucggacguuccaccccaugucuggaauccccacacagguguuuaaaggcgucuccgugaccuaucuugggagcgacauggagguuucuggacugaccgaucucugugaaauugaggagcugaaguccaaaaagcuggcccuugcuccuugcaaccaggccggcaugggcguggucgggaaagugggagaaauccaauguagcuccgaggaaagcgcucgcacaaucaagaaggacggcugcauuuggaacgccgaucucguggggaucgagcugagagucgacgaugcgguuuguuacucuaaaauuaccagcguggaagccguggcuaauuauuccgccaucccgacaacgauuggaggccugcgguucgagagaucucaugacagccaggggaagaucuccggaucuccccucgauaucaccgcuauucgcggcagcuuuuccgucaacuaccggggccugagacuuucucugagcgagaucacagcuaccugcacaggggaagugaccaauguuuccggaugcuacagcuguaugacgggcgccaaagugucuauuaagcuccacuccagcaaaaacucuaccgcccauguccgcugcaagggggacgagacagcguucuccgugcuggaaggaguucacagcuauaccgugucccugucuuuugaucacgccgucguggacgagcagugucagcuuaauugcggcgggcaugaaagccaaguuacacucaagggaaaccugaucuuccuggacgugccuaaauuugucgauggcuccuacaugcagaccuaucacagcacggugcccacaggcgcuaauauuccuucucccaccgacuggcucaacgcccuguucgggaauggacuuuccagauggauccugggcgugaucgggguccuccugggaggccuggcccuguuuuucaugauuaugagccucuuuaagcuggggacaaaacagguuuuccggucucgcaccaagcuggcuuga

SEQ ID NO: 14733 - RNA, 3222 nt, Artificial Sequence
  derived and/or modified CDS sequence (opt5) from SFTSV(42-Lu'an(CHN)-2015)__KX302602.1__GP
augaugaaggugaucugguucagcucccugauuugcuuugucauccaguguucuggcgacagcgggcccauuaucugcgccggaccuauucacuccaacaaaucugcugauaucccgcaucuccugggcuucagcgagaagaucugucaaauugacagacuuauccacguuuccucuuggcugcggaaucauagccaguuucagggguacgugggacagcgcggcgggagaucccaagugagcuauuaccccgccgaaaacucuuauucccgguggagcggacuccugucuccuugcgaugcggacuggcuuggcaugcuggucgugaaaaaggcuaaaggcuccgauaugauuguucccgggccuagcuacaagggaaagguguucuuugagcgccccaccuucgacggcuaugucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuucuggagcuuaaguccuucagccagucugaauuucccgacaucugcaaaauugauggaaucguguucaaucagugugagggcgaaagccugccucaacccuuugacgucgccuggauggauguggggcacucccauaagaucauuaugcgcgagcacaaaaccaagugggugcaggagucuagcuccaaggacuucgucugcuacaaagaaggaacaggcccguguagcgagucugaagagaagaccugcaaaacauccgggagcugcagaggagacaugcaguuuuguaagguugcuggcugcgaacacggcgaggaggccucugaagcuaaaugucggugcucccucgugcauaagccuggggagguggucgugagcuauggacgcaugagaguucggcccaaauguuacggcuucucccgcaugauggccacccuggaagugaaccagccugagcaaagaaucgggcagugcacgggaugucaccuugaaugcauuaauggcgggguccggcugaucacccucacaucugagcucaagagcgcgaccgugugugccucccauuucugcucuagcgcuacauccggcaagaaaagcaccgagauucaguuucacucuggaucccugguuggcaagacggccauccacgugaaaggggcucuggucgauggaacagaguucaccuuugaaggcagcuguauguuccccgacgggugcgaugccguggacugcacauuuugucgcgaguuccugaagaacccccaaugcuacccugcgaaaaaguggcuuuuuaucauuaucgucauucugcucggauaugccggccugaugcuucugaccaaugugcucaaggcuaucgggauuuggggcucuuggguuaucgccccggugaaacugaucuucgcuauuaucaagaaacugaugagaaccgucuccugucucaugggaaagcugauggaucggggcagacaggugauucaugaagaaaucggggagaaccgcgagggaaaucaggacgauguucggauugaaauggccagaccccgccgggugagacacuggauguacagcccugucauccuuacaauucuggccaucggccucgcugagucuugcgacgaaauggugcaugcggauagcaaacugguguccugucgccaggggagcggaaacaugaaggagugcguuacgaccggccgggcccuucugcccgcugucaauccugggcaagaggccugucuccacuuuacagcccccggcucuccggacuccaagugccugaaaaucaaggugaaaagaauuaaccugaaguguaaaaagagcuccucuuauuucgugccugaugcucgcagccggugcaccuccgucagacgcugucggugggccggagacugccagucuggcugucccccucauuuuacaagcaauuccuucucugacgauugggcggggaagauggacagagcuggacucggcuuuagcgggugcuccgauggaugcggcggggccgccuguggcugcuucaacgcugcccccagcuguaucuucuggcggaaauggguggaaaauccucacggaauuaucuggaagguuucucccugcgcugccugggugccguccgcggucauugagcugaccaugccuagcggcgaagugcgcacguuucaccccaugucugggauccccacacagguuuucaaaggaguguccgucaccuaccuuggcagcgacauggaggugucugggcugaccgaucucugugaaaucgaggagcugaaguccaaaaagcuggcccuugcuccuugcaaccaggccggaaugggcguugugggcaaagucggggaaauucaauguagcuccgaggaaagcgcuagaacaaucaagaaggacggaugcauuuggaacgccgaucucgugggcaucgagcugcggguggacgaugcggucuguuauucuaaaauuaccagcguugaagccguguccaauuacucugcuaucccgacaacgaucgggggacugagauuugagcgcagccaugacucccagggcaagauuucugggagcccccucgauaucaccgccauucggggauccuucucugugaacuauagaggccugcgccuuagccuguccgagaucacagcuaccugcacaggcgaagucaccaaugugagcgggugcuacucuuguaugacgggagccaaaguuuccauuaagcuccacagcucuaaaaacuccaccgcccaugugagaugcaagggcgacgagacagcuuuuagcguccuggaaggggugcacuccuacaccguuucucugagcuucgaucacgcgguggucgacgagcagugucagcuuaauugcggaggccaugaaucccaagugacacucaaggggaaccugaucuuucuggacguuccuaaauucguggauggaagcuauaugcagaccuaccacucuacgguccccacaggcgccaauaucccuucccccaccgacuggcucaacgcucuguuuggcaaugggcuuagccgguggauucugggagugaucggcgugcuccuugggggacuggcccuguucuuuaugauuaugucucucuucaagcugggcacaaaacaggucuuucgcagcagaaccaagcuggccuga

SEQ ID NO: 14734 - RNA, 3222 nt, Artificial Sequence
  derived and/or modified CDS sequence (opt5) from SFTSV(44-Lu'an(CHN)-2015)__KX302603.1__GP
augaugaaggugaucugguucagcucccugauuugcuuugucauccaguguucuggcgacagcgggcccauuaucugcgccggaccuauucacuccaacaaaucugcugauaucccgcaucuccugggcuucagcgagaagaucugucaaauugacagacuuauccacguuuccucuuggcugcggaaucauagccaguuucagggguacgugggacagcgcggcgggagaucccaagugagcuauuaccccgccgaaaacucuuauucccgguggagcggacuccugucuccuugcgaugcggacuggcuuggcaugcuggucgugaaaaaggcuaaaggcuccgauaugauuguucccgggccuagcuacaagggaaagguguucuuugagcgccccaccuucgacggcuaugucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuucuggagcuuaaguccuucagccagucugaauuucccgacaucugcaaaauugauggaaucguguucaaucagugugagggcgaaagccugccucaacccuuugacgucgccuggauggauguggggcacucccauaagaucauuaugcgcgagcacaaaaccaagugggugcaggagucuagcuccaaggacuucgucugcuacaaagaaggaacaggcccguguagcgagucugaagagaagaccugcaaaacauccgggagcugcagaggagacaugcaguuuuguaagguugcuggcugcgaacacggcgaggaggccucugaagcuaaaugucggugcucccucgugcauaagccuggggagguggucgugagcuauggaggcaugcgcguuagacccaaauguuacggguucucccggaugauggccacccuggaagugaaccagccugagcaacgcaucggacagugcacgggcugucaccuugaaugcauuaaugggggcgucagacugaucacccucacaucugagcucaagagcgcgaccgugugugccucccauuucugcucuagcgcuacauccggaaagaaaagcaccgagauucaguuucacucuggcucccugguugggaagacggccauccacgugaaaggagcucuggucgauggcacagaguucaccuuugaagggagcuguauguuccccgacggaugcgaugccguggacugcacauuuugucgggaguuccugaagaacccccaaugcuacccugcgaaaaaguggcuuuuuaucauuaucgucauucugcucggcuaugccgggcugaugcuucugaccaaugugcucaaggcuaucggcauuuggggaucuuggguuaucgccccggugaaacugaucuucgcuauuaucaagaaacugaugcgcaccgucuccugucucaugggcaagcugauggauagagggagacaggugauucaugaagaaaucggagagaaccgggagggcaaucaggacgauguucgcauugaaauggcccggcccagacgcgugcggcacuggauguacagcccugucauccuuacaauucuggccaucgggcucgcugagucuugcgacgaaauggugcaugcggauagcaaacugguguccuguagacagggaagcggcaacaugaaggagugcguuacgaccgggcgcgcccuucugcccgcugucaauccuggccaagaggccugucuccacuuuacagcccccggaucuccggacuccaagugccugaaaaucaaggugaaacggauuaaccugaaguguaaaaagagcuccucuuauuucgugccugaugcuagaagccgcugcaccuccguccggagaugucgcugggccggcgacugccagucugggugucccccucauuuuacaagcaauuccuucucugacgauugggcgggaaagauggaccgggcuggccucggguuuagcggaugcuccgauggcugcgggggcgccgccuguggaugcuucaacgcugcccccagcuguaucuucuggagaaaauggguggaaaauccucacggcauuaucuggaagguuucucccugcgcugccugggugccguccgcggucauugagcugaccaugccuagcggggaagugcggacguuucaccccaugucuggaauccccacacagguuuucaaaggcguguccgucaccuaccuugggagcgacauggaggugucuggacugaccgaucucugugaaaucgaggagcugaaguccaaaaagcuggcccuugcuccuugcaaccaggccggcaugggcguuguggggaaagucggagaaauucaauguagcuccgaggaaagcgcucgcacaaucaagaaggacggcugcauuuggaacgccgaucucguggggaucgagcugagaguggacgaugcggucuguuauucuaaaauuaccagcguugaagccguguccaauuacucugcuaucccgacaacgaucggaggccugcgguuugagagaagccaugacucccaggggaagauuucuggaagcccccucgauaucaccgccauucgcggcuccuucucugugaacuaucggggccugagacuuagccuguccgagaucacagcuaccugcacaggggaagucaccaaugugagcggaugcuacucuuguaugacgggcgccaaaguuuccauuaagcuccacagcucuaaaaacuccaccgcccaugugcgcugcaagggggacgagacagcuuuuagcguccuggaaggagugcacuccuacaccguuucucugagcuucgaucacgcgguggucgacgagcagugucagcuuaauugcggcgggcaugaaucccaagugacacucaagggaaaccugaucuuucuggacguuccuaaauucguggauggcagcuauaugcagaccuaccacucuacgguccccacaggcgccaauaucccuucccccaccgacuggcucaacgcucuguuugggaauggacuuagcagauggauucugggcgugaucggggugcuccugggaggccuggcccuuuucuuuaugauuaugucucucuucaagcuggggacaaaacaggucuuucggagccgcaccaagcuggccuga

SEQ ID NO: 14735 - RNA, 3222 nt, Artificial Sequence
  derived and/or modified CDS sequence (opt5) from SFTSV(52-Lu'an(CHN)-2015)__KX302604.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuccuggagcuuaaguccuuuagccagucugaguuccccgacaucugcaaaauugauggaaucguguuuaaucagugugaaggcgaaagccugccucaacccuucgacgucgccuggauggauguggggcacucccauaagaucauuaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcguuagacccaaauguuacggguuuucccggaugauggccacccuggaagugaaccagccugagcaacgcaucggacagugcacgggcugucaccuugaaugcauuaaugggggcgucagacugaucacccucacaucugagcuuaagagcgcgaccgugugugccucccauuucugcucuagcgcuacauccggaaagaaaagcaccgagauucaguuccacucuggcucccugguugggaagacggccauccacgugaaaggagcucucgucgauggcacagaauuuaccuucgaggggagcuguauguuucccgacggaugcgaugccguggacugcacauucugucgggaauuucugaagaacccccaaugcuauccugcgaaaaaguggcuuuucaucauuaucgucauucugcucggcuacgccgggcugaugcuucugaccaaugugcucaaggcuaucggcauuuggggaucuuggguuaucgccccggugaaacugaucuuugcuauuaucaagaaacugaugcgcaccgucuccugucucaugggcaagcugauggauagagggagacaggugauucaugaggaaaucggagagaaccgggagggcaaucaggacgauguucgcauugaaauggcccggcccagacgcgugcggcacuggauguauagcccugucauccuuacaauucuggccaucgggcucgcugagucuugcgacgaaauggugcaugcggauagcaaacugguguccuguagacagggaagcggcaacaugaaggagugcguuacgaccgggcgcgcccuucugcccgcugucaauccuggccaagaggccugucuccacuucacagcccccggaucuccggacuccaagugccugaaaaucaaggugaaacggauuaaccugaaguguaaaagaagcuccucuuacuuugugccugaugcucgcagccggugcaccuccgucagacgcugucggugggccggcgacugccagucugggugucccccucauuucacaagcaauuccuuuucugacgauugggcgggaaagauggacagagcuggccucggguucagcggaugcuccgauggcugcgggggcgccgccuguggaugcuuuaacgcugcccccagcuguaucuucuggcggaaguggguggaaaauccucacggcauuaucuggaaaguuucucccugcgcugccugggugccguccgcggucauugagcugaccaugccuagcggggaagugcgcacguuccaccccaugucuggaauccccacacagguuuuuaagggcguguccgucaccuaucuugggagcgacauggaggugucuggacugaccgaucucugugaaaucgaggagcugaaauccaagaaacuggcccuugcuccuugcaaccaggccggcaugggcguuguggggaaggucggagaaauucaauguagcuccgaggaaagcgcuagaacaaucaaaaaggacggcugcauuuggaacgccgaucucguggggaucgagcugcggguggacgaugcggucuguuacucuaagauuaccagcguugaagccguggcuaauuauuccgccaucccgacaacgaucggaggccugagauucgagcgcucucaugacagccaggggaaaauuuccggaucuccccucgauaucaccgcuauucggggcagcuuuuccgugaacuacagaggccugcgccuuucucugagcgagaucacagcuaccugcacaggggaagucaccaauguguccggaugcuacagcuguaugacgggcgccaagguuucuauuaaacuccacuccagcaagaacucuaccgcccaugugagaugcaaaggggacgagacagcguucuccguccuggaaggagugcacagcuauaccguuucccugucuuuugaucacgccguggucgacgagcagugucagcuuaauugcggcgggcaugaaagccaagugacacucaagggaaaccugaucuuccuggacguuccuaaguuuguggauggcuccuacaugcagaccuaucacagcacgguccccacaggcgcuaauaucccuucucccaccgacuggcucaacgcccuguucgggaauggacuuucccgguggauucugggcgugaucggggugcuccugggaggccuggcccuguuuuucaugauuaugagccucuuuaaacuggggacaaagcaggucuuccgcucuagaaccaaacuggcuuga

SEQ ID NO: 14736 - RNA, 3222 nt, Artificial Sequence
  derived and/or modified CDS sequence (opt5) from SFTSV(HL/Injected)__KF791953.1__GP
augaugaaggugaucugguucagcucccugauuugccucgucauccaguguggcggggacaccggacccauuaucugcgccggcccuauucacucuaacaaaagcgcugauaucccgcaucugcuuggguacuccgagaagaucugucaaauugacagacugauccacguuucuagcuggcuccggaaucauucccaguuucagggauaugugggccagcgcgggggaagaucucaagugagcuacuaucccgccgaaaacuccuacagccgguggucuggccugcuuuccccuugcgaugcggacuggcugggcaugcucgucgugaaaaaggcuaaagggagcgauaugauuguucccggaccuucuuauaagggcaagguguucuuugagcgccccacauucgacggguacgucggauggggcuguggguccggaaaaagcagaacggaaucuggcgagcugugcuccagcgauuccggcaccucuagcgggcugcucccuuccgaccgggugcuguggaucggagauguugccugucagccgaugacacccauuccugaagagaccuuucuugagcuuaagagcuucucucaguccgaauuucccgacaucugcaaaauugauggcaucguguucaaucagugugagggggaaagccucccucaacccuuugacgucgccuggauggaugugggacacucucauaagaucauuaugcgcgagcacaaaacaaagugggugcaggagagcuccucuaaggacuucgucugcuauaaagaaggcaccgggccguguagcgaguccgaagagaagacaugcaaaaccagcggaucuugcagaggcgacaugcaguuuuguaagguugcuggcugcgaacacggggaggaggccuccgaagcuaaaugucggugcagccuggugcauaagccuggagagguggucgugucuuacggcgggaugcgcguuagacccaaauguuacggauucucccggaugauggccacgcuugaagugagccagccugagcaacgcaucggccagugcaccgggugucaccuggaaugcauuaacggcggagucagacucaucacacugaccuccgagcugaagucugcgacagugugugccagccauuuuugcuccucugcuaccagcggcaagaaauccacggagauucaguuccacagcgggucucucguuggaaagacagccauccacgugaaaggcgcucuggucgaugggaccgaguucacauuugaaggauccuguauguuccccgacggcugcgaugccguggacugcaccuuuugucgggaguuccuuaagaauccccaaugcuauccugcgaaaaaguggcuguuuaucauuaucgucauucuccugggguacgccggccuuaugcugcucaccaacgugcugaaggcuaucggaguuuggggcagcugggugauugccccggucaaacugguguucgcuaucaucaagaaacucaugcgcgccguuucuugucugauggggaagcugauggauagaggaagacaggugauucaugaagaaaucggcgagaaucgggaggggaaccaggacgauguccgcauugaaauggcccggcccagacgcgugcggcacuggauguauuccccugugauccugacaauucucgcuaucggacuggcggagggcugcgacgaaaugguucaugccgauagcaaacuugucucuuguagacaggggagcggcaauaugaaggagugcgugacgaccggacgcgcucugcuccccgccgugaacccuggccaagaggccugucugcacuuuacagcucccggguccccggacagcaagugccugaaaauuaaggucaaacggaucaaucucaaguguaaaaagucuuccagcuacuucgugccugaugccagaucccgcugcaccucuguucggagaugucgcugggcgggagacugccagagcggcugucccccucauuuuacauccaacucuuucagcgacgauugggcugggaagauggaccgggccggacugggcuuuuccgggugcucugauggcugcggaggcgccgcuugugggugcuucaaugccgcucccagcuguaucuuuuggagaaaauggguggaaaacccucacggaauuaucuggaaggucucccccugcgccgcgugggugccgagcgccguuauugagcuuaccaugccuucuggcgaagugcggacguuccaccccauguccgggauccccacacaggucuucaaaggagugagcguuaccuaucugggcucugacauggagguguccggccucaccgaucugugugaaauugaggagcuuaagagcaaaaagcuggcucucgccccuugcaaucaggcugggaugggagucgugggcaaagugggggaaauccaauguucuuccgaggaaagcgcccgcacaaucaagaaggacggaugcauuuggaacgcggaucuggucggcaucgagcugagaguugacgaugccguguguuacuccaaaauuaccagcguggaagcugucgccaacuauucugcuaucccgacaacgauugggggacuccgguuugagagaagccaugacucccagggcaagaucucuggcagcccccuggauaucaccgccauucgcggguccuucucugugaauuaccggggacuuagacugagccucuccgagaucacagcuaccugcacaggcgaaguuaccaacgugucugggugcuacagcuguaugacgggagccaaagucuccauuaagcugcacagcucuaaaaauuccaccgcgcaugugcgcugcaagggcgacgagacagccuuuagcguucuggaaggggugcacucuuauuccgucagccuuuccuucgaucacgcugugguugacgagcagugucagcucaacugcggaggccaugaaucucaagugacccugagaggcaaucugaucuuucucgacgucccuaaguucguggaugggagcuacaugcagacauaucacuccaccgugcccacgggagccaacauuccuagccccacagacuggcugaaugcccuuuuuggcaacgggcugucucgguggauccucggagucaucggcguucugcuugggggacuggcucucuucuuucugauuaugucccuguucaaacucggcaccaagcagaucuuucgcagcagaacaaaacuggccuga

SEQ ID NO: 14737 - RNA, 3222 nt, Artificial Sequence
  derived and/or modified CDS sequence (opt5) from SFTSV(HL/Larvae/G2)__KF791955.1__GP
augaugaaggugaucugguucagcucccugauuugccucgucauccaguguggcggggacaccggacccauuaucugcgccggcccuauucacucuaacaaaagcgcugauaucccgcaucugcuuggguacuccgagaagaucugucaaauugacagacugauccacguuucuagcuggcuccggaaucauucccaguuucagggauaugugggccagcgcgggggaagaucucaagugagcuacuaucccgccgaaaacuccuacagccgguggucuggccugcuuuccccuugcgaugcggacuggcugggcaugcucgucgugaaaaaggcuaaagggagcgauaugauuguucccggaccuucuuauaagggcaagguguucuuugagcgccccacauucgacggguacgucggauggggcuguggguccggaaaaagcagaacggaaucuggcgagcugugcuccagcgauucccggaccucuagcggccugcucccuuccgaccgcgugcuguggaucggggauguugccugucagccgaugacacccauuccugaagagaccuuucuugagcuuaagagcuucucucaguccgaauuucccgacaucugcaaaauugauggaaucguguucaaucagugugagggcgaaagccucccucaacccuuugacgucgccuggauggauguggggcacucucauaagaucauuaugagagagcacaaaacaaagugggugcaggagagcuccucuaaggacuucgucugcuauaaagaaggaaccggcccguguagcgaguccgaagagaagacaugcaaaaccagcgggucuugccggggagacaugcaguuuuguaagguugcuggcugcgaacacggcgaggaggccuccgaagcuaaaugucgcugcagccuggugcauaagccuggggagguggucgugucuuacggaggcaugagaguucggcccaaauguuacggguucucccgcaugauggccacgcuugaagugagccagccugagcaaagaaucggacagugcaccggcugucaccuggaaugcauuaacgggggcguccggcucaucacacugaccuccgagcugaagucugcgacagugugugccagccauuuuugcuccucugcuaccagcggaaagaaauccacggagauucaguuccacagcggcucucucguugggaagacagccauccacgugaaaggagcucuggucgauggcaccgaguucacauuugaaggguccuguauguuccccgacggaugcgaugccguggacugcaccuuuugucgcgaguuccuuaagaauccccaaugcuauccugcgaaaaaguggcuguuuaucauuaucgucauucuccugggcuacgccgggcuuaugcugcucaccaacgugcugaaggcuaucggcguuuggggaagcugggugauugccccggucaaacugguguucgcuaucaucaagaaacucaugagagccguuucuugucugaugggcaagcugauggaucgggggagacaggugauucaugaagaaaucggagagaaucgcgagggcaaccaggacgauguccggauugaaauggccagaccccgccgggugagacacuggauguauuccccugugauccugacaauucucgcuaucgggcuggcggagggaugcgacgaaaugguucaugccgauagcaaacuugucucuugucgccagggcagcgggaauaugaaggagugcgugacgaccggccgggcucugcuccccgccgugaacccuggacaagaggccugucugcacuuuacagcucccggcuccccggacagcaagugccugaaaauuaaggucaaaagaaucaaucucaaguguaaaaagucuuccagcuacuucgugccugaugcccgcucccggugcaccucuguuagacgcugucggugggcgggggacugccagagcggaugucccccucauuuuacauccaacucuuucagcgacgauugggcuggcaagauggacagagccgggcugggauuuuccggcugcucugaugggugcggcggagccgcuuguggcugcuucaaugccgcucccagcuguaucuuuuggcggaaauggguggaaaacccucacgggauuaucuggaaggucucccccugcgccgcgugggugccgagcgccguuauugagcuuaccaugccuucuggagaagugcgcacguuccaccccauguccggcauccccacacaggucuucaaaggggugagcguuaccuaucugggaucugacauggagguguccggccucaccgaucugugugaaauugaggagcuuaagagcaaaaagcuggcucucgccccuugcaaucaggcuggcaugggggucgugggaaaagugggcgaaauccaauguucuuccgaggaaagcgccagaacaaucaagaaggacgggugcauuuggaacgcggaucuggucggaaucgagcugcggguugacgaugccguguguuacuccaaaauuaccagcguggaagcugucgccaacuauucugcuaucccgacaacgauuggcgggcucagauuugagcgcagccaugacucccagggaaagaucucuggcagcccccuggauaucaccgccauucggggcuccuucucugugaauuacagagggcuucgccugagccucuccgagaucacagcuaccugcacaggagaaguuaccaacgugucuggcugcuacagcuguaugacgggggccaaagucuccauuaagcugcacagcucuaaaaauuccaccgcgcaugugagaugcaagggagacgagacagccuuuagcguucuggaaggcgugcacucuuauuccgucagccuuuccuucgaucacgcugugguugacgagcagugucagcucaacugcgggggacaugaaucucaagugacccugcggggcaaucugaucuuucucgacgucccuaaguucguggauggcagcuacaugcagacauaucacuccaccgugcccacgggggccaacauuccuagccccacagacuggcugaaugcccuuuuuggaaacggccugucucgcuggauccucggggucaucggaguucugcugggcgggcuugcucucuucuuucugauuaugucccuguucaaacucggaaccaagcagaucuuuagaagccggacaaaacuggccuga

SEQ ID NO: 14738 - RNA, 3222 nt, Artificial Sequence
  derived and/or modified CDS sequence (opt5) from SFTSV(JS2011-004)__KC505124.1__GP
augaugaaggugaucugguucagcucccugauuugccucgucauccaguguggcggggacaccggacccauuaucugcgccggcccuauucacucuaacaaaagcgcugauaucccgcaucugcuuggguacuccgagaagaucugucaaauugacagacugauccacguuucuagcuggcuccggaaucauucccaguuucagggauaugugggccagcgcgggggaagaucucaagugagcuacuaucccgccgaaaacuccuacagccgguggucuggccugcuuuccccuugcgaugcggacuggcugggcaugcucgucgugaaaaaggcuaaagggagcgauaugauuguucccggaccuucuuauaagggcaagguguucuuugagcgccccacauucgacggguacgucggauggggcuguggguccggaaaaagcagaacggaaucuggcgagcugugcuccagcgauuccggcaccucuagcgggcugcucccuuccgaccgggugcuguggaucggagauguugccugucagccgaugacacccauuccugaagagaccuuucuugagcuuaagagcuucucucaguccgaauuucccgacaucugcaaaauugauggcaucguguucaaucagugugggggagagagccucccucaacccuuugacgucgccuggauggaugugggccacucucauaagaucauuaugcgcgaacacaaaacaaagugggugcaggagagcuccucuaaggacuucgucugcuauaaagaggggaccggaccguguagcgaauccgaggaaaagacaugcaaaaccagcggcucuugcagaggcgacaugcaguuuuguaagguugcugggugcgagcacggagaagaggccuccgaggcuaaaugucggugcagccuggugcauaagccuggcgaaguggucgugucuuacgggggaaugcgcguuagacccaaauguuacggcuucucccggaugauggccacgcuugaggugaaccagccugaacaacgcaucgggcagugcaccggcugucaccuggagugcauuaauggaggcgucagacucaucacacugaccagcgaacugaaguccgcgacagugugugccucucauuuuugcagcuccgcuaccucugggaagaaaagcacggagauucaguuccacuccggaagccucguuggcaagacagccauccacgugaaaggggcucuggucgauggaaccgaguucacauuugaaggcucuuguauguuccccgacgggugcgaugccguggacugcaccuuuugucgggaguuccuuaagaacccccaaugcuauccugcgaaaaaguggcuguuuaucauuaucgucauucuccugggcuacgccggacuuaugcugcucaccaaugugcugaaggcuaucggcguuuggggguccugggugauugccccggucaaacugguguucgcuaucaugaagaaacucaugcgcgccguuagcugucugaugggaaagcugauggauagaggcagacaggugauccaugaagagauuggggaaaaccgggagggaaaucaggacgauguccgcaucgagauggcccggcccagacgcgugcggcacuggauguauucuccugugauucugacaauccucgcuauuggccuggcggaagggugcgacgagaugguucaugccgauuccaaacuugucagcuguagacagggcucuggaaacaugaaggaaugcgugacgaccggccgcgcucugcuccccgccgugaauccugggcaagaggccugucugcacuuuacagcucccggaagcccggacuccaagugccugaaaaucaaggucaaacggauuaaccucaaguguaaaaagagcagcuccuacuucgugccugaugccagaagccgcugcaccuccguucggagaugucgcugggcgggcgacugccagucugggugucccccucauuuuacaagcaauuccuucucugacgauugggcuggaaagauggaccgggccggccugggguuuagcggcugcuccgauggaugcggcggggccgcuuguggaugcuucaacgccgcucccucuuguaucuuuuggagaaaauggguggagaauccucacggcaucauuuggaaggucagccccugcgccgcgugggugccguccgccguuaucgaacuuaccaugccuagcggggaggugcggacguuccaccccaugucuggcauucccacacaggucuucaaaggaguguccguuaccuaucugggcagcgacauggaagugucugggcucaccgaucugugugagaucgaggaacugaaguccaaaaagcucgcucuugccccuugcaaccaggcuggaaugggcgucguggggaaagugggagagauucaauguagcucugaagaguccgcccgcacaaucaagaaggacggcugcaucuggaacgcggaucuggucgggauugaacugagaguugacgaugccguguguuacagcaaaaucaccuccguggaggcugucgccaauuauagcgcuauuccgacaacgaucggaggccuccgguuugaaagaucucaugacagccagggcaagauuuccgggucuccccuggauaucaccgccauccgcggaucuuucuccgugaacuaccggggccuuagacugucucucagcgagauuacagcuaccugcacaggggagguuaccaauguguccggaugcuacucuuguaugacgggcgccaaagucagcaucaagcugcacuccagcaaaaacucuaccgcgcaugugcgcugcaagggggacgaaacagccuuuuccguucuggagggagugcacagcuauucugucucccuuagcuucgaucacgcugugguugacgaacagugucagcucaauugcggcggccaugagucccacgugacccugaaggggaaccugauuuuucucgacgucccuaaauucguggauggaucuuacaugcaaacauaucauagcaccgugcccacgggcgccaauaucccuucccccacagacuggcugaacgcccuuuuugggaauggacugagcagauggauucucggcgucaucgggguucugcugggaggccuugcucucuucuuucugaucaugucucuguucaagcucggcaccaaacagguguuucggucccgcacaaagcuggccuga

SEQ ID NO: 14739 - RNA, 3222 nt, Artificial Sequence
  derived and/or modified CDS sequence (opt5) from SFTSV(JS2011-013-1)__KC505127.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuccuggagcuuaaguccuuuagccagucugaguuccccgacaucugcaaaauugauggaaucguguuuaaucagugugaaggcgaaagccugccucaacccuucgacgucgccuggauggauguggggcacucccauaagaucauuaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcguuagacccaaauguuacggguuuucccggaugauggccacccuggaagugaaccagccugagcaacgccuuggacagugcacgggcugucaccuggaaugcaucaaugggggcgucagacucauuacccugacaucugagcuuaagagcgcgaccgugugugccucccauuucugcucuagcgcuacauccggaaagaaaagcaccgagauccaguuccacucuggcucccucguugggaagacggccauucacgugaaaggagcucuggucgauggcacagaauuuaccuucgaggggagcuguauguuucccgacggaugcgaugccguggacugcacauucugucgggaauuucuuaagaacccccaaugcuauccugcgaaaaaguggcuguucaucaucauugucauccuccugggcuacgccgggcuuaugcugcucaccaaugugcugaaggcuauuggcaucuggggaucuuggguuauugccccggugaaacugauguuugcuaucaucaagaaacucaugcgcaccgucuccugucugaugagaaagcugauggaucggggcagacaggugauucaugaggaaaucggggagaaccgcgagggaaaucaggacgauguucggauugaaauggccagaccccgccgggugagacacuggauguauagcccugucauccugacaauucucgccaucggccuggcugagucuugcgacgaaauggugcaugcggauagcaaacuuguguccugucgccaggggagcggaaacaugaaggagugcguuacgaccggccgggcccugcuccccgcugucaauccugggcaagaggccugucugcacuucacagcccccggcucuccggacuccaagugccugaaaauuaaggugaaaagaaucaaccucaaguguaaaaagagcuccucuuacuuugugccugaugcucgcagccggugcaccuccgucagacgcugucggugggccggagacugccagucuggcugucccccucauuucacaagcaauuccuuuucugacgauugggcggggaagauggacagagcuggacugggcuucagcgggugcuccgauggaugcggcggggccgccuguggcugcuuuaacgcugcccccagcuguaucuucuggcggaaauggguggaaaauccucacggaauuaucuggaagguuucucccugcgcugccugggugccguccgcggucauugagcuuaccaugccuagcggcgaagugcgcacguuccaccccaugucugggauccccacacagguuuuuaaaggaguguccgucaccuaucugggcagcgacauggaggugucugggcucaccgaucugugugaaauugaggagcugaaguccaaaaagcucgcccuugcuccuugcaaccaggccggaaugggcguugugggcaaagucggggaaauccaauguagcuccgaggaaagcgcuagaacaaucaagaaggacggaugcauuuggaacgccgaucuggugggcaucgagcugcggguggacgaugcggucuguuacucuaaaauuaccagcguugaagccguggcuaauuauuccgccaucccgacaacgauugggggacucagauucgagcgcucucaugacagccagggcaagaucuccgggucuccccuggauaucaccgcuauucggggaucuuuuuccgugaaauacagaggccuucgccugucucucagcgagaucacagcuaccugcacaggcgaagucaccaacguguccgggugcuacagcuguaugacgggagccaagguuucuauuaaacugcacuccagcaagaauagcaccgcccaugugagaugcaagggcgacgagacagcguucuccguccuggaagggggacacagcuauaccgugucccuuucuuuugaucacgccguuguggacgagcagugucagcucaacugcggcgggcaugaaagccaagucacacugaaaggaaaucugaucuuccucgacgugccuaaguuuguugauggcuccuacaugcagaccuaucacagcacggugcccacaggcgcuaacauuccuucucccaccgacuggcugaaugcccuuuucgggaacggacugucccgguggauccucggcgucaucggggugcugcugggaggccuugcccucuuuuucaugauuaugagccuguuuaaacuggggacaaaacagguguuccgcucuagaaccaagcucgcuuga

SEQ ID NO: 14740 - RNA, 3222 nt, Artificial Sequence
  derived and/or modified CDS sequence (opt5) from SFTSV(JS2011-027)__KC505130.1__GP
augaugaaggugaucugguucagcucccugauuugccucgucauccaguguggcggggacaccggacccauuaucugcgccggcccuauucacucuaacaaaagcgcugauaucccgcaucugcuuggguacuccgagaagaucugucaaauugacagacugauccacguuucuagcuggcuccggaaucauucccaguuucagggauaugugggccagcgcgggggaagaucucaagugagcuacuaucccgccgaaaacuccuacagccgguggucuggccugcuuuccccuugcgaugcggacuggcugggcaugcucgucgugaaaaaggcuaaagggagcgauaugauuguucccggaccuucuuauaagggcaagguguucuuugagcgccccacauucgacggguacgucggauggggcuguggguccggaaaaagcagaacggaaucuggcgagcugugcuccagcgauuccggcaccucuagcgggcugcucccuuccgaccgggugcuguggaucggagauguugccugucagccgaugacacccauuccugaagagaccuuucuugagcuuaagagcuucucucaguccgaauuucccgacaucugcaaaauugauggcaucguguucaaucagugugagggggaaagccucccucaacccuuugacgucgccuggauggaugugggacacucucauaagaucauuaugcgcgagcacaaaacaaagugggugcaggagagcuccucuaaggacuucgucugcuauaaagaaggcaccgggccguguagcgaguccgaagagaagacaugcaaaaccagcggaucuugcagaggcgacaugcaguuuuguaagguugcuggcugcgaacacggggaggaggccuccgaagcuaaaugucggugcagccuggugcauaagccuggagagguggucgugucuuacggcgggaugcgcguuagacccaaauguuacggauucucccggaugauggccacgcuugaagugaacgagccugaacagcgcaucggccaaugcaccgggugucaccuggagugcauuagcggcggagucagacucaucacacugaccuccgagcugaagucugcgacagugugugccagccauuuuugcuccucugcuaccagcggcaagaaauccacggaaauucaguuccacagcgggucucucguuggaaagacagccauccacgugaaaggcgcucuggucgaugggaccgaguucacauuugaaggauccuguauguuccccgacggcugcgaugccguggacugcaccuuuugucgggaguuccuuaagaauccccagugcuauccugcgaaaaaguggcuguuuaucauuaucgucauucuccugggguacgccggccuuaugcugcucaccaacgugcugaaggcuaucggaguuuggggcagcugggugauugccccggucaaacugguguucgcuaucaucaagaaacucaugcgcgccguuucuugucugauggggaagcugauggauagaggacggcaagugauucaugaagagaucggcgagaauagagaagggaaccaggacgauguccgcauugagauggcccggcccagacgcgugcggcacuggauguauuccccugugauccugacaauucucgcuaugggacuggcggaaggcugcgacgagaugguucaugccgauagcaaacuugucucuuguagacaggggagcggcaauaugaaggagugcgugacgaccggacgcgcucugcuccccgccgugaacccuggccaggaagccugucugcacuuuacagcucccggguccccggacagcaagugccugaaaaucaaggucaaacggauuaaucucaaguguaaaaagucuuccagcuacuucgugccugaugccagaucccgcugcaccucuguucggagaugucgcugggcgggagacugccaaagcggcugucccccucauuuuacauccaacucuuucagcgacgauugggcugggaagauggaccgggccggacugggcuuuuccgggugcucugauggcugcggaggcgccgcuugugggugcuucaaugccgcucccagcuguaucuuuuggagaaaauggguggagaacccucacggaaucauuuggaaggucucccccugcgccgcgugggugccgagcgccguuaucgaacuuaccaugccuucuggcgaggugcggacguuccaccccauguccgggauucccacacaggucuucaaaggagugagcguuaccuaucugggcucugacauggaaguguccggccucaccgaucugugugagaucgaggaacuuaagagcaaaaagcuggcucucgccccuugcaaucaggcugggaugggagucgugggcaaagugggggagauucaguguucuuccgaagagagcgcccgcacaaucaagaaggacggaugcaucuggaacgcggaucuggucggcauugaacugagaguugacgaugccguguguuacuccaaaaucaccagcguggaggcugucgccaacuauucugcuauuccgacaacgaucgggggacuccgguuugagagaagccaugacucccaaggcaagauuucuggcagcccccuggauaucaccgccauccgcggguccuucucuauuaauuaccggggacuuagacugagccucuccgaaaucacagcuaccugcacaggcgaggugaccaacguuucugggugcuacagcuguaugacgggagccaaaguguccauuaagcugcacagcucuaaaaauuccaccgcgcauguccgcugcaagggcgacgaaacagccuuuagcgugcuggaggggguucacucuuauuccgugagccuuuccuucgaucacgcugucguggacgaacagugucagcucaacugcggaggccaugagucucagguuacccugagaggcaaucugaucuuucucgacgugccuaaguucgucgaugggagcuacaugcaaacauaucacuccaccgugcccacgggagccaacauuccuagccccacagacuggcugaaugcccuuuuuggcaacgggcugucucgguggauccucggagugaucggcguccugcuugggggacuggcucucuucuuucugauuaugucccuguucaaacucggcaccaagcagguuuuucgcagcagaacaaaacuggccuga

SEQ ID NO: 14741 - RNA, 3222 nt, Artificial Sequence
  derived and/or modified CDS sequence (opt5) from SFTSV(JS2011-034)__KC505133.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuccuggagcuuaaguccuuuagccagucugaguuccccgacaucugcaaaauugauggaaucguguuuaaucagugugaaggcgaaagccugccucaacccuucgacgucgccuggauggauguggggcacucccauaagaucauuaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcaucagacccaaauguuacggguuuucccggaugauggccacccuggaaguuaaccagccugagcaacgcauuggacagugcacgggcugucaccuugaaugcaucaaugggggcgugagacugauuacccucacaucugagcucaagagcgcgaccgucugugccucccauuucugcucuagcgcuacauccggaaagaaaagcaccgagauccaguuccacucuggcucccugguggggaagacggccauccacguuaaaggagcucugguggauggcacagaauuuaccuucgaggggagcuguauguuucccgacggaugcgaugccgucgacugcacauucugucgggaauuucugaagaacccccaaugcuauccugcgaaaaaguggcuuuucauuaucauugugauccugcucggcuacgccgggcugaugcuucugaccaauguccucaaggcuauuggcaucuggggaucuugggugaucgccccgguuaaacugauguuugcuauuaucaagaaacugaugcgcaccguguccugucucaugggcaagcugauggauagagggcggcaggucauucaugaggaaaucggagagaacagagagggcaaucaggacgaugugcgcauugaaauggcccggcccagacgcguucggcacuggauguauagcccugugauccuuacauuccuggccauugggcucgcugagucuugcgacgaaaugguccaugcggauagcaaacugguguccuguagacagggaagcggcaacaugaaggagugcgugacgaccgggcgcgcccuucugcccgcuguuaauccuggccaagaggccugucuccacuuuacagcccccggaucuccggacuccaagugccugaaaaucaaggucaaacggaucaaccugaaguguaaaaagagcuccucuuacuucgugccugaugcuagaagccgcugcaccuccgugcggagaugucgcugggccggcgacugccagucugggugucccccucauuuuacaagcaauuccuucucugacgauugggcgggaaagauggaccgggcuggccucggguuuagcugcugcuccgauggauguggcggggccgccugcggcuguuucaacgcugcccccagcugcauuuucuggagaaaaugggucgaaaauccucacggaaucauuuggaaggugucucccugugcugccuggguuccguccgcggugaucgagcugaccaugccuagcggcgaaguccggacguuucaccccaugucugggauucccacacagguguucaaaggaguuuccgugaccuaucuuggcagcgacauggaggucucugggcugaccgaucucugcgaaaucgaggagcugaaguccaaaaagcuggcccuugcuccuuguaaccaggccggaaugggcgugguuggcaaagugggggaaauccaaugcagcuccgaggaaagcgcucgcacaauuaagaaggacggauguaucuggaacgccgaucucgucggcauugagcugagaguggacgaugcggugugcuacucuaaaaucaccagcgucgaagccguugcuaauuauuccgccauuccgacaacgaucgggggacugcgguuugagagaucucaugacagccagggcaagaucuccgggucuccccucgauauuaccgcuauccgcgggagcuucuccgugaacuaccggggccugagacuuucucugagcgagauuacagcuaccugcacaggcgaagugaccaaugucuccggguguuacagcugcaugacgggagccaaagugucuaucaagcuccacuccagcaaaaacucuaccgcccauguucgcuguaagggcgacgagacagcguuuuccgugcuggaagggguccacagcuauaccgugucccugucuuucgaucacgccguuguggacgagcagugccagcuuaauuguggaggccaugaaagccaagucacacucaaggggaaccugauuuuucuggacgugccuaaauucguugauggauccuacaugcagaccuaucacagcacggugcccacaggcgcuaauaucccuucucccaccgacuggcucaacgcccuguuuggcaaugggcuuuccagauggauccugggagucauuggcgugcuccugggaggacuggcccuuuucuuuaugaucaugagccuccugaagcugggcacaaaacagguguaccggucucgcaccaagcucgcuuga

SEQ ID NO: 14742 - RNA, 3222 nt, Artificial Sequence
  derived and/or modified CDS sequence (opt5) from SFTSV(JS2011-062)__KC505136.1__GP
augaugaaggugaucugguucagcucccugauuugccucgucauccaguguucuggcgacagcgggcccauuaucugcgccggaccuauucacuccaacaagucugcugauaucccgcaucugcuuggcuacagcgagaagaucugucaaauugacagacugauccacguuuccucuuggcuccggaaucauagccaguuucagggguaugugggacagcgcggcgggagaucccaagugagcuacuaucccgccgucaacucuuacucccgguggagcggacugcuuucuccuugcgaugcggacuggcugggcaugcucgugguuaaaaaggcuaaaggcuccgauaugauugugcccgggccuagcuauaagggaaaggucuucuuugaacgccccaccuucgacggcuacgugggguggggauguggcucugggaaauccagaacagagagcggagaacugugcuccucugauagcggcacguccagcggccugcucccuucuaaucggguucuguggaucggggacguggccugucagccgaugacccccauuccugaggaaacauuucuugagcugaaguccuucagccagucugaguuucccgauaucugcaaaauugacggaaucgucuucaaccagugugaaggcgagagccucccucaacccuuugauguggccuggauggacguggggcacucccauaagaucauuaugcgcgaacacaaaaccaaguggguccaggagucuagcuccaaggauuucguuugcuauaaagagggaacaggcccguguagcgaaucugaggaaaaggcuugcaaaaccuccgggagcugcagaggagacaugcaguuuuguaagguggccggcugcgagcacggcgaagaggcuucugaggccaaaugucggugcucccuggugcauaagccuggggaagucgugguuagcuacggaggcaugcgcgugagacccaaauguuacggguucucccggaugauggcgacacuugaggucaauccucccgaacagcgcaucggacaaugcaccggcugucaccuggagugcauuaacgggggcgugagacucaucacgcugaccucugaacuuaagagcgccacaguuugugcuucccauuuuugcucuagcgccaccuccggaaagaaaagcacagagauucaguuccacucuggcucccucguggggaagaccgcuauccacgucaaaggagcccugguggacggcacggaguucacauuugaagggagcuguauguuccccgauggaugcgacgcggucgauugcaccuuuugucgggaguuccuuaagaauccucagugcuauccggccaaaaaguggcuguuuaucauuaucgugauucuccugggcuacgcugggcuuaugcugcucacaaacguucugaaggccaucggcguguggggaucuugggucauugcucccgugaaacugauguucgccaucaugaagaaacucaugcgcaccguuuccugucugaugggcaagcugaucgacagagggcggcaagugauucaugaagagaucggagaaaauggcgaggggaacagagaugacguccgcauugagauggcccggccuagacgcgugcggcacuggauguauagccccgugauccugaccauucucgcuaucggacuggcggaaggcugcgaugagaugguucaugccgacucuaaacuugucagcuguagacagggguccggcaauaugaaggaaugcgugacaacgggacgcgcucugcucccugccgugaaccccggccaggaggccugucugcacuuuaccgcuccggggagcccugauucuaagugccugaaaauuaaggucaaacggaucaaucucaaguguaaaaaguccagcuccuacuucgugcccgacgccagaucucgcugcacaagcguucggagaugucgcugggcgggagauugccaguccggcugcccuccccauuuuaccucuaacagcuucuccgacgacugggcugggaagauggaucgggccggacugggcuuuucuggguguagcgacggcugcggaggcgccgcuugugggugcuucaaugccgcuccuuccuguaucuuuuggagaaaauggguggagaacccccacggaauuaucuggaaggucagcccgugcgccgcgugggugccuucugccguuauugaacuuacaaugcccuccggcgaggugcggaccuuccaccccaugagcgggaucccuacgcaagucuucaaaggagugucuguuacauaucugggcuccgauauggaagugagcggccucaccgaccugugugagauugaggaacugaagucuaaaaagcucgcucuugccccgugcaaccaggcugggaugggagucgugggcaaagugggggagauccaguguuccagcgaagaguccgcccgcaccaucaagaaggauggaugcauuuggaaugcggaccuggucggcaucgaacugagaguugaugacgccguguguuacagcaaaauuacaucuguggaggcugucgccaacuauagcgcuauccccaccacaauugggggacuccgguuugaaagaucccaugauucucagggcaagaucagcggcuccccucuggacaucacggccauucgcgggucuuucagcgugaauuaccggggacuuagacugucccucucugagaucaccgccacaugcaccggcgagguuacaaacgugagcgggugcuacuccuguaugaccggagcuaaagucagcauuaagcugcacucuuccaaaaauagcacggcgcaugugcgcugcaagggcgaugaaaccgccuuuucuguucuggagggggugcacuccuauacagucagccuuuccuucgaccacgcugugguugaugaacaaugucagcucaacugcggaggccaugagucucaggugacccugaagggcaaucugaucuuucucgacguccccaaauucguggacgggagcuacaugcagacauaucacuccaccgugccuacgggagccaacauucccagcccuacagauuggcugaaugcccuuuuuggcaacgggcugucuagauggauccucggacugaucggcguccugcuugggggacucgcucuguucuuucugauuaugucccucuucaagcugggcaccaaacaaguuuuucggagccgcacaaaacuugccuga

SEQ ID NO: 14743 - RNA, 3222 nt, Artificial Sequence
  derived and/or modified CDS sequence (opt5) from SFTSV(JS2011-109)__KC505139.1__GP
augaugaaggugaucugguucagcucccugauuugccucgucauccaguguggcggggacaccggacccauuaucugcgccggcccuauucacucuaacaaaagcgcugauaucccgcaucugcuuggguacuccgagaagaucugucaaauugacagacugauccacguuucuagcuggcuccggaaucauucccaguuucagggauaugugggccagcgcgggggaagaucucaagugagcuacuaucccgccgaaaacuccuacagccgguggucuggccugcuuuccccuugcgaugcggacuggcugggcaugcucgucgugaaaaaggcuaaagggagcgauaugauuguucccggaccuucuuauaagggcaagguguucuuugagcgccccacauucgacggguacgucggauggggcuguggguccggaaaaagcagaacggaaucuggcgagcugugcuccagcgauuccggcaccucuagcgggcugcucccuuccgaccgggugcuguggaucggagauguugccugucagccgaugacacccauuccugaagagaccuuucuugagcuuaagagcuucucucaguccgaauuucccgacaucugcaaaauugauggcaucguguucaaucagugugagggggaaagccucccucaacccuuugacgucgccuggauggaugugggacacucucauaagaucauuaugcgcgagcacaaaacaaagugggugcaggagagcuccucuaaggacuucgucugcuauaaagaaggcaccgggccguguagcgaguccgaagagaagacaugcaaaaccagcggaucuugcagaggcgacaugcaguuuuguaagguugcuggcugcgaacacggggaggaggccuccgaagcuaaaugucggugcagccuggugcauaagccuggagagguggucgugucuuacggcgggaugcgcguuagacccaaauguuacggauucucccggaugauggccacgcuugaagugaaccagccugagcaacgcaucggccagugcaccgggugucaccuggaaugcauuaauggcggagucagacucaucacacugaccagcgagcugaaguccgcgacagugugugccucucauuuuugcagcuccgcuaccucuggcaagaaaagcacggagauucaguuccacuccgggagccucguuggaaagacagccauccacgugaaaggcgcucuggucgaugggaccgaguucacauuugaaggaucuuguauguuccccgacggcugcgaugccguggacugcaccuuuugucgggaguuccuuaagaacccccaaugcuauccugcgaaaaaguggcuguuuaucauuaucgucauucuccugggguacgccggccuuaugcugcucaccaaugugcugaaggcuaucggaguuuggggcuccugggugauugccccggucaaacugguguucgcuaucaucaagaaacucaugcgcgccguuagcugucugauggggaagcugauggauagaggaagacaggugauucaugaagaaaucggcgagaaccgggaggggaaucaggacgauguccgcauugaaauggcccggcccagacgcgugcggcacuggauguauucuccugugauccugacaauucucgcuaucggacuggcggagggcugcgacgaaaugguucaugccgauuccaaacuugucagcuguagacaggggucuggcaacaugaaggagugcgugacgaccggacgcgcucugcuccccgccgugaauccuggccaagaggccugucugcacuuuacagcucccgggagcccggacuccaagugccugaaaauuaaggucaaacggaucaaccucaaguguaaaaagucuagcuccuacuucgugccugaugccagaagccgcugcaccuccguucggagaugucgcugggcgggagacugccagucuggcugucccccucauuuuacaagcaauuccuucucugacgauugggcugggaagauggaccgggccggacugggcuuuagcgggugcuccgauggcugcggaggcgccgcuugugggugcuucaacgccgcucccucuuguaucuuuuggagaaaauggguggaaaauccucacggaauuaucuggaaggucagccccugcgccgcgugggugccguccgccguuauugagcuuaccaugccuagcggcgaagugcggacguuccaccccaugucugggauccccacacaggucuucaaaggaguguccguuaccuaucugggcagcgacauggaggugucuggccucaccgaucugugugaaauugaggagcugaaguccaaaaagcuggcucucgccccuugcaaccaggcugggaugggagucgugggcaaagugggggaaauccaauguagcucugaggaauccgcccgcacaaucaagaaggacggaugcauuuggaacgcggaucuggucggcaucgagcugagaguugacgaugccguguguuacagcaaaauuaccuccguggaagcugucgccaauuauagcgcuaucccgacaacgauugggggacuccgguuugagagaucucaugacagccagggcaagaucuccggcucuccccuggauaucaccgccauucgcgggagcuucuccgugaacuaccggggacuuagacugucucucagcgagaucacagcuaccugcacaggcgaaguuaccaauguguccgggugcuacucuuguaugacgggagccaaagucagcauuaagcugcacuccagcaaaaacucuaccgcgcaugugcgcugcaagggcgacgagacagccuuuuccguucuggaaggggugcacagcuauucugucucccuuagcuucgaucacgcugugguugacgagcagugucagcucaauugcggaggccaugaaucccacgugacccugagaggcaaccugaucuuucucgacgucccuaaguucguggaugggucuuacaugcaaacauaucauagcaccgugcccacgggagccaauauuccuucccccacagacuggcugaacgcccuuuuuggcaaugggcugagccgguggauccucggagucaucggcguucugcuugggggacuugcucucuucuuucugauuaugucucuguucaaacucggcaccaaacagguguuucgcuccagaacaaagcuggccuga

SEQ ID NO: 14744 - RNA, 3222 nt, Artificial Sequence
  derived and/or modified CDS sequence (opt5) from SFTSV(JS2011-13-2)__KR230770.1__GP
augaugaaggugaucugguucagcucccugauuugccucgucauccaguguggcggggacaccggacccauuaucugcgccggcccuauucacucuaacaaaagcgcugauaucccgcaucugcuuggguacuccgagaagaucugucaaauugacagacugauccacguuucuagcuggcuccggaaucauucccaguuucagggauaugugggccagcgcgggggaagaucucaagugagcuacuaucccgccgaaaacuccuacagccgguggucuggccugcuuuccccuugcgaugcggacuggcugggcaugcucgucgugaaaaaggcuaaagggagcgauaugauuguucccggaccuucuuauaagggcaagguguucuuugagcgccccacauucgacggguacgucggauggggcuguggguccggaaaaagcagaacggaaucuggcgagcugugcuccagcgauuccggcaccucuagcgggcugcucccuuccgaccgggugcuguggaucggagauguugccugucagccgaugacacccauuccugaagagaccuuucuugagcuuaagagcuucucucaguccgaauuucccgacaucugcaaaauugauggcaucguguucaaucagugugagggggaaagccucccucaacccuuugacgucgccuggauggaugugggacacucucauaagaucauuaugcgcgagcacaaaacaaagugggugcaggagagcuccucuaaggacuucgucugcuauaaagaaggcaccgggccguguagcgaguccgaagagaagacaugcaaaaccagcggaucuugcagaggcgacaugcaguuuuguaagguugcuggcugcgaacacggggaggaggccuccgaagcuaaaugucggugcagccuggugcauaagccuggagagguggucgugucuuacggcgggaugcgcguuagacccaaauguuacggauucucccggaugauggccacgcuugaagugaaccagccugagcaacgcaucggccagugcaccgggugucaccuggaaugcauuaauggcggagucagacucaucacacugaccagcgagcugaaguccgcgacagugugugccucucauuuuugcagcuccgcuaccucuggcaagaaaagcacggagauucaguuccacuccgggagccucguuggaaagacagccauccacgugaaaggcgcucuggucgaugggaccgaguucacauuugaaggaucuuguauguuccccgacggcugcgaugccguggacugcaccuuuugucgggaguuccuuaagaacccccaaugcuauccugcgaaaaaguggcuguuuaucauuaucgucauucuccugggguacgccggccuuaugcugcucaccaaugugcugaaggcuaucggaguuuggggcuccugggugauugccccggucaaacugguguucgcuaucaucaagaaacucaugcgcgccguuagcugucugauggggaagcugauggauagaggaagacaggugauucaugaagaaaucggcgagaaccgggaggggaaucaggacgauguccgcauugaaauggcccggcccagacgcgugcggcacuggauguauucuccugugauccugacaauucucgcuaucggacuggcggagggcugcgacgaaaugguucaugccgauuccaaacuugucagcuguagacaggggucuggcaacaugaaggagugcgugacgaccggacgcgcucugcuccccgccgugaauccuggccaagaggccugucugcacuuuacagcucccgggagcccggacuccaagugccugaaaauuaaggucaaacggaucaaccucaaguguaaaaagucuagcuccuacuucgugccugaugccagaagccgcugcaccuccguucggagaugucgcugggcgggagacugccagucuggcugucccccucauuuuacaagcaauuccuucucugacgauugggcugggaagauggaccgggccggacugggcuuuagcgggugcuccgauggcugcggaggcgccgcuugugggugcuucaacgccgcucccucuuguaucuuuuggagaaaauggguggaaaauccucacggaauuaucuggaaggucagccccugcgccgcgugggugccguccgccguuauugagcuuaccaugccuagcggcgaagugcggacguuccaccccaugucugggauccccacacaggucuucaaaggaguguccguuaccuaucugggcagcgacauggaggugucuggccucaccgaucugugugaaauugaggagcugaaguccaaaaagcuggcucucgccccuugcaaccaggcugggaugggagucgugggcaaagugggggaaauccaauguagcucugaggaauccgcccgcacaaucaagaaggacggaugcauuuggaacgcggaucuggucggcaucgagcugagaguugacgaugccguguguuacagcaaaauuaccuccguggaagcugucgccaauuauagcgcuaucccgacaacgauugggggacuccgguuugagagaucucaugacagccagggcaagaucuccggcucuccccuggauaucaccgccauucgcgggagcuucuccgugaacuaccggggacuuagacugucucucagcgagaucacagcuaccugcacaggcgaaguuaccaauguguccgggugcuacucuuguaugacgggagccaaagucagcauuaagcugcacuccagcaaaaacucuaccgcgcaugugcgcugcaagggcgacgagacagccuuuuccguucuggaaggggugcacagcuauucugucucccuuagcuucgaucacgcugugguugacgagcagugucagcucaauugcggaggccaugaaucccacgugacccugaagggcaaccugaucuuucucgacgucccuaaauucguggaugggucuuacaugcaaacauaucauagcaccgugcccacgggagccaauauuccuucccccacagacuggcugaacgcccuuuuuggcaaugggcugagcagauggauccucggagucaucggcguucugcuugggggacuugcucucuucuuucugauuaugucucuguucaagcucggcaccaaacagguguuucggucccgcacaaagcuggccuga

SEQ ID NO: 14745 - RNA, 3222 nt, Artificial Sequence
  derived and/or modified CDS sequence (opt5) from SFTSV(JS2011-69)__KR230771.1__GP
augaugaaggugaucugguucagcucccuggucugccucguuauucaguguucuggcgacaccgggcccaucauuugcgccggaccuauccacagcaacaaauccgcuaauauuccgcaucugcuuggcuacucugagaagaucugucaaaucgauagacugauucacgugagcuccuggcuccggaaccauucucaguuucagggguaugugggacagcgcggcgggagaagccaagucuccuacuaucccgccgaaaauagcuacucucggugguccggacugcuuagcccuugcgacgcggauuggcugggcaugcucgugguuaaaaaggcuaaaggcucugacaugaucgugcccgggccuuccuauaagggaaaggucuucuuugagcgccccacauucgauggcuacgugggguggggauguggcagcgggaaaucuagaacggaauccggagagcugugcagcuccgacucuggcaccagcuccggccugcucccuagcgaucggguucuguggauuggggacguggccugucagccgaugacacccaucccugaagagaccuuucuugagcugaagucuuucucccagagcgaauuucccgauauuugcaaaaucgacggaauugucuucaaccagugugauucugagagccucccucaacccuuugacguggccuggauggaugugggccacucccauaagaucaucaugcgcgaacacaaaacaaaguggguccaggagucuagcuccaaggacuucguuugcuauaaagaggggaccggaccguguagcgaaucugaggaaaagacaugcaaaaccuccggcagcugcagaggggacaugcaguuuuguaagguggcuggaugcgagcacggcgaagaggccucugaggcuaaaugucggugcucccuggugcauaagccuggcgaagucgugguuagcuacgggggaaugcgcgugagacccaaauguuacggcuucucccggaugauggccacgcuugaggucaauccucccgaacagcgcauugggcaaugcaccggaugucaccuggagugcaucaacggcggggugagacucauuacacugaccucugaacuuaagagcgcgacaguuugugccucccauuuuugcucuagcgcuaccuccggcaagaaaagcacggagauccaguuccacucuggaucccucgugggcaaggccgcuauucacgucaaaggggcccugguggauggaacagaguucaccuuugaaggcagcuguauguuccccgacgggugcgaugcggucgacugcacauuuugucgggaguuccuuaagaauccucagugcuauccggccaaaaaguggcuguuuaucaucauugugauccuccugggauacgcuggccuuaugcugcucaccaacguucugaaggccauugggguguggggcucuugggucauggcucccgugaaacugauguucgccaucauuaagaaacucaugcgcuccguuagcugucugaugggaaagcugauggauagaggccggcaagugauccaugaagagaucggggaaaauagagagggaaaccaggacgauguccgcauugagauggcccggccuagacgcgugcggcacuggauguauucucccgugauccugaccauucucgcuaucggccuggcggaagggugcgacgagaugguucaugccgauagcaaacuugucuccuguagacagggaagcggcaauaugaaggaaugcgugacaacggggcgcgcucugcucccugccgugaaccccggccaggaggccugucugcacuuuaccgcuccgggaucuccugacuccaagugccugaaaauuaaggucaaacggaucaaucucaaguguaaaaagagcuccucuuacuucgugcccgaugccagaagccgcugcacauccguucggagaugucgcugggcgggcgacugccaaucugggugcccuagccauuuuaccuccaacucuuucagcgacgauugggcuggaaagauggaccgggccggccugggguuuuccggauguagcgauggcugcgggggcgccgcuuguggaugcuucaaugccgcucccucuuguaucuuuuggagaaaauggguggagaacccucacggcauuaucuggaaggucucccccugcgccgcgugggugccgagcgccguuauugaacuuacaaugccuucuggggaggugcggaccuuccaccccauguccggaauccccacgcaggucuucaaaggcgugagcguuacauaucuggggucugacauggaaguguccggacucaccgaucugugugagauugaggaacuuaagagcaaaaagcuggcucucgccccuugcaaccaggcuggcaugggcgucguggggaaagugggagagauccaguguuccagcgaagagucugcccgcaccauuaagaaggacggcugcaucuggaaugcggaucuggucgggaucgaacugagaguugacgaugccguguguuacagcaaaauuacauccguggaggcugucgccaacuauucugcuaucccgaccacaauuggaggccuccgguuugaaagaagccaugacucccaagggaagaucucuggaagcccccuggauauuacggccgugcgcggcuccuucucuguuaauuaccggggccuuagacugagccucuccgagaucaccgccacaugcaccggggaggugacaaacgucagcggaugcuacucuuguaugaccggcgcuaaaguguccaucaagcugcacagcucuaaaaauuccacggcgcauguucgcugcaagggggacgaaaccgccuuuagcgugcuggagggaguccacuccuauacagugucucuuagcuucgaucacgcuguuguggacgaacagugucagcucaacugcggcgggcaugagucccaggucacccugaagggaaaucugauuuuucucgacgugccuaaauucguggauggcagcuacaugcaaacauaucacucuuccguccccaccggcgccaacaucccuagccccacggacuggcugaaugcccuuuuugggaacggacugucuagauggauucucggcguuaucggggugcugcugggagugcuugcucucuucuuucugauuaugagccuguucaagcucggcacaaaacaggucuuucggucccgcaccaagcuggccuga

SEQ ID NO: 14746 - RNA, 3222 nt, Artificial Sequence
  derived and/or modified CDS sequence (opt5) from SFTSV(JS2012-020)__KC505142.1__GP
augaugaaggugaucugguucagcucccugauuugccucgucauccaguguggcggggacaccggacccauuaucugcgccggcccuauucacucuaacaaaagcgcugauaucccgcaucugcuuggguacuccgagaagaucugucaaauugacagacugauccacguuucuagcuggcuccggaaucauucccaguuucagggauaugugggccagcgcgggggaagaucucaagugagcuacuaucccgccgaaaacuccuacagccgguggucuggccugcuuuccccuugcgaugcggacuggcugggcaugcucgucgugaaaaaggcuaaagggagcgauaugauuguucccggaccuucuuauaagggcaagguguucuuugagcgccccacauucgacggguacgucggauggggcuguggguccggaaaaagcagaacggaaucuggcgagcugugcuccagcgauuccggcaccucuagcgggcugcucccuuccgaccgggugcuguggaucggagauguugccugucagccgaugacacccauuccugaagagaccuuucuugagcuuaagagcuucucucaguccgaauuucccgacaucugcaaaauugauggcaucguguucaaucagugugggggagagagccucccucaacccuuugacgucgccuggauggaugugggccacucucauaagaucauuaugcgcgaacacaaaacaaagugggugcaggagagcuccucuaaggacuucgucugcuauaaagaggggaccggaccguguagcgaauccgaggaaaagacaugcaaaaccagcggcucuugcagaggcgacaugcaguuuuguaagguugcugggugcgagcacggagaagaggccuccgaggcuaaaugucggugcagccuggugcauaagccuggcgaaguggucgugucuuacgggggaaugcgcguuggccccaaauguuacggguucuccagaaugauggccacgcuugaggugaaccagccugaacaacggaucggccagugcaccggaugucaccuggagugcauuaauggcgggguccgccucaucacacugaccagcgaacugaaguccgcgacagugugugccucucauuuuugcagcuccgcuaccucuggaaagaaaagcacggagauucaguuccacuccggcagccucguugggaagacagccauccacgugaaaggagcucuggucgauggcaccgaguucacauuugaagggucuuguauguuccccgacggcugcgaugccguggacugcaccuuuuguagagaguuccuuaagaacccccaaugcuauccugcgaaaaaguggcuguuuaucauuaucauuauccuccugggauacgccggccuuaugcugcucaccaauguccugaaggcuauugggguguggggauccuggguuaucgccccggugaaacuggucuucgcuaucauuaagaaacucaugcgggccgugagcugucugaugggcaagcugauggaucgcgggagacagguuauccaugaagagauuggagaaaaccgggagggcaaucaggacgaugugagaaucgagauggcccgcccccggagaguccgccacuggauguauucuccugugauucugacaauccucgcuauugggcuggcggaaggcugcgacgagauggugcaugccgauuccaaacuuguuagcugucggcagggaucuggcaacaugaaggaaugcgucacgaccgggagagcucugcuccccgccgugaauccuggacaagaggccugucugcacuuuacagcucccggcagcccggacuccaagugccugaaaaucaaggugaaacgcaucaaccucaaguguaaaaagucuagcuccuacuucgucccugaugcccggagcagaugcaccuccgugcgccgguguagaugggcgggggacugccagucuggaugucccccucauuuuacaagcaauuccuucucugacgauugggcuggcaagauggaccgcgccgggcugggcuuuagcggaugcuccgauggcugcgggggagccgcuuguggcugcuucaacgccgcucccucuuguaucuuuuggcggaaauggguugagaauccucacgggauuauuuggaaggugagccccugcgccgcgugggucccguccgccgugaucgaacuuaccaugccuagcggagagguuagaacguuccaccccaugucuggcauucccacacagguguucaaaggcgucuccgugagcuaucuggggucugacauggaaguuuccggacucaccgaucugugugagaucgaggaacuuaagagcaaaaagcuggcucucgccccuugcaaccaggcuggcauggggguggucggaaaagugggcgagauccaauguucuuccgaagagagcgcccggaccauuaagaaggacgggugcaucuggaacgcggaucuggugggaauugaacugcgcgucgacgaugccguuuguuacuccaaaaucacaagcguggaggcuguggccaauuauucugcuauuccgaccacaaucggcggccucagauuugaacggagccaugacucccaggggaagaucucuggaagcccccuggauauuacggccaucagaggcuccuucucugucaacuaccgcgggcuucggcugagccucuccgagauuaccgccacaugcaccggagaggugacaaauguuucuggcugcuacagcuguaugaccggggcuaaaguguccaucaagcugcacagcucuaaaaacuccacggcgcaugucagaugcaagggagacgaaaccgccuuuagcgugcuggagggcguucacucuuauuccgugagccuuuccuucgaucacgcugucguggacgaacagugucagcucaauugcggcgggcaugagucucacguuacacugaagggaaaccugauuuuucucgacgugccuaaauucgucgauggcagcuacaugcaaaccuaucauuccacagugcccaccggggccaauaucccuagccccacggacuggcugaacgcccuuuuuggaaauggccugucucgcuggauccucggggugauuggaguccugcugggcggccuugcucucuucuuucugaucaugucccuguucaagcucgggacaaaacagguuuuuagaagccggaccaagcuggccuga

SEQ ID NO: 14747 - RNA, 3222 nt, Artificial Sequence
  derived and/or modified CDS sequence (opt5) from SFTSV(JS2012-035)__KC505145.1__GP
augaugaaggugaucugguucagcucccugauuugccucgucauccaguguggcggggacaccggacccauuaucugcgccggcccuauucacucuaacaaaagcgcugauaucccgcaucugcuuggguacuccgagaagaucugucaaauugacagacugauccacguuucuagcuggcuccggaaucauucccaguuucagggauaugugggccagcgcgggggaagaucucaagugagcuacuaucccgccgaaaacuccuacagccgguggucuggccugcuuuccccuugcgaugcggacuggcugggcaugcucgucgugaaaaaggcuaaagggagcgauaugauuguucccggaccuucuuauaagggcaagguguucuuugagcgccccacauucgacggguacgucggauggggcuguggguccggaaaaagcagaacggaaucuggcgagcugugcuccagcgauuccggcaccucuagcgggcugcucccuuccgaccgggugcuguggaucggagauguugccugucagccgaugacacccauuccugaagagaccuuucuugagcuuaagagcuucucucaguccgaauuucccgacaucugcaaaauugauggcaucguguucaaucagugugagggggaaagccucccucaacccuuugacgucgccuggauggaugugggacacucucauaagaucauuaugcgcgagcacaaaacaaagugggugcaggagagcuccucuaaggacuucgucugcuauaaagaaggcaccgggccguguagcgaguccgaagagaagacaugcaaaaccagcggaucuugcagaggcgacaugcaguuuuguaagguugcuggcugcgaacacggggaggaggccuccgaagcuaaaugucggugcagccuggugcauaagccuggagagguggucgugucuuacggcgggaugcgcguuagacccaaauguuacggauucucccggaugauggccacgcuuggcgugaaccagccugaacaacgcaucgggcagugcaccggcugucaccuggagugcauuaauggaggcgucagacucaucacacugaccagcgaacugaaguccgcgacagugugugccucucauuuuugcagcuccgcuaccucugggaagaaaagcacggagauucaguuccacuccggaagccucguuggcaagacagccauccacgugaaaggggcucuggucgauggaaccgaguucacauuugaaggcucuuguauguuccccgacgggugcgaugccguggacugcaccuuuugucgggaguuccuuaagaacccccaaugcuauccugcgaaaaaguggcuguuuaucauuaucgucauucuccugggcuacgccggacuuaugcugcucaccaaugugcugaaggcuaucggcguuuggggguccugggugauugccccggucaaacugguguucgcuaucaucaagaaacucaugcgcgccguuagcugucugaugggaaagcugauggauagaggcagacaggugauucaugaagagaucggggaaaaccgggagggaaaucaggacgauguccgcauugagauggcccggcccagacgcgugcggcacuggauguauucuccugugauccugacaauucucgcuaucggccuggcggaagggugcgacgagaugguucaugccgauuccaaacuugucagcuguagacagggcucuggaaacaugaaggaaugcgugacgaccggccgcgcucugcuccccgccgugaauccugggcaagaggccugucugcacuuuacagcucccggaagcccggacuccaagugccugaaaauuaaggucaaacggaucaaccucaaguguaaaaagagcagcuccuacuucgugccugaugccagaagccgcugcaccuccguucggagaugucgcugggcgggcgacugccagucugggugucccccucauuuuacaagcaauuccuucucugacgauugggcuggaaagauggaccgggccggccugggguuuagcggcugcuccgauggaugcggcggggccgcuuguggaugcuucaacgccgcucccucuuguaucuuuuggagaaaauggguggagaauccucacggcauuaucuggaaggucagccccugcgccgcgugggugccguccgccguuauugaacuuaccaugccuagcggggaggugcggacguuccaccccaugucuggaauccccacacaggucuucaaaggcguguccguuaccuaucugggcagcgacauggaagugucugggcucaccgaucugugugagauugaggaacugaaguccaaaaagcucgcucuugccccuugcaaccaggcuggaaugggcgucguggggaaagugggagagauccaauguagcucugaagaguccgcccgcacaaucaagaaggacggcugcauuuggaacgcggaucuggucgggaucgaacugagaguugacgaugccguguguuacagcaaaauuaccuccguggaggcugucgccaauuauagcgcuaucccgacaacgauuggaggccuccgguuugaaagaucucaugacagccagggcaagaucuccgggucuccccuggauaucaccgccauucgcggaucuuucuccgugaacuaccggggccuuagacugucucucagcgagaucacagcuaccugcacaggggagguuaccaauguguccggaugcuacucuuguaugacgggcgccaaagucagcauuaagcugcacuccagcaaaaacucuaccgcgcaugugcgcugcaagggggacgaaacagccuuuuccguucuggagggagugcacagcuauucugucucccuuagcuucgaucacgcugugguugacgaacagugucagcucaauugcggcggccaugagucccacgugacccugagagggaaccugaucuuucucgacgucccuaaguucguggauggaucuuacaugcaaacauaucauagcaccgugcccacgggcgccaauauuccuucccccacagacuggcugaacgcccuuuuugggaauggacugagccgguggauccucggcgucaucgggguucugcugggaggccuugcucucuucuuucugauuaugucucuguucaaacucggcaccaaacagguguuucgcuccagaacaaagcuggccuga

SEQ ID NO: 14748 - RNA, 3222 nt, Artificial Sequence
  derived and/or modified CDS sequence (opt5) from SFTSV(JS2012-79)__KR230772.1__GP
augaugaaggugaucugguucagcucccugaccugcuuugucauucaguguucuggcgacagcgggcccaucauuugcgccggaccuauccacuccaacaaaucugcugauauuccgcaucuccugggcuacagcgagaagaucugucaaaucgacagacuuauucacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugaucguucccgggccuagcuauaagggaaagguguuuuucgagcgccccacauuugacggcuacgucggguggggauguggcucugggaaauccagaacggaaagcggagagcucugcuccucugauagcggcaccuccagcggccugcugccuucugaccgggugcucuggauuggggauguugccugucagccgaugacacccaucccugaagagaccuuccuggagcuuaaguccuuuagccagucugaguuccccgacauuugcaaaaucgauggaauuguguuuaaucagugugaaggcgaaagccugccucaacccuucgacgucgccuggauggauguggggcacucccauaagaucaucaugcgcgagcacaaaacaaagugggugcaggagucuagcuccaaggacuuugucugcuauaaagaaggaaccggcccguguagcgagucugaagagaagacaugcaaaaccuccgggagcugcagaggagacaugcaguucuguaagguugcuggcugcgaacacggcgaggaggccucugaagcuaaaugucggugcucccucgugcauaagccuggggagguggucgugagcuacggaggcaugcgcauuagacccaaauguuacggguuuucccggaugauggccacgcuggaaguuaaccagccugagcaacgccuuggacagugcaccggcugucaccuggaaugcaucaaugggggcgugagacucauuacacugaccucugagcuuaagagcgcgacagucugugccucccauuucugcucuagcgcuaccuccggaaagaaaagcacggagauccaguuccacucuggcucccucguggggaagacagccauucacguuaaaggagcucugguggauggcaccgaauuuacauucgaggggagcuguauguuucccgacggaugcgaugccgucgacugcaccuucugucgggaauuucuuaagaacccccaaugcuauccugcgaaaaaguggcuguucaucaucauugugauccuccugggcuacgccgggcuuaugcugcucaccaauguccugaaggcuauuggcaucuggggaucuugggugauugccccgguuaaacugauguuugcuaucaucaagaaacucaugcgcacaguguccugucugaugagaaagcugauggaucggggcagacaggucauucaugaggaaaucggggagaaccgcgagggaaaucaggacgaugugcggauugaaauggccagaccccgccggguuagacacuggauguauagcccugugauccugacgauucucgccaucggccuggcugagucuugcgacgaaaugguccaugcggauagcaaacuuguguccugucgccaggggagcggaaacaugaaggagugcgugaccacaggccgggcccugcucucugcuguuaaucccgggcaagaggccugucugcacuucaccgccccuggcucccccgacagcaagugccugaaaauuaaggucaaaagaaucaaccucaaguguaaaaaguccucuagcuacuuugugccggaugcucgcucccggugcacaucugugagacgcugucggugggccggagacugccagagcggcugcccuccccauuucaccuccaauucuuuuagcgacgauugggcggggaagauggacagagcuggacugggcuucuccggguguagcgauggaugcggcggggccgccuguggcugcuuuaacgcugccccuucuuguaucuucuggcggaaaugggucgaaaauccccacggaauuaucuggaagguguccccuugcgcugccuggguucccagcgcggugauugagcuuacgaugccgucuggcgaaguccgcacauuccacccuauguccgggauccccacccagguguuuaaaggaguuagcgugaccuaucugggcucugacauggaggucuccgggcucacagaucugugugaaauugaggagcuuaagagcaaaaagcuggcccucgcucccugcaaccaggccggaaugggcgugguuggcaaagugggggaaauccaauguuccagcgaggaaucugcuagaaccaucaagaaggacggaugcauuuggaacgccgaucuggucggcaucgagcugcggguggacgaugcgguguguuacagcaaaauuacauccgucgaagccguugcuaauuauucugccaucccuacgaccauugggggacucagauucgagcgcagccaugacucccagggcaagaucucugggagcccgcuggauaucacagcuauucggggauccuuuucugugaacuacagaggccuucgccugagccucuccgagaucaccgccacaugcaccggcgaagugacgaaugucagcgggugcuacucuuguaugaccggagccaaaguguccauuaagcugcacagcucuaaaaacuccacagcucauguuagaugcaagggcgacgagaccgcguucagcgugcuggaagggggacacuccuauacagucucucuuagcuuugaucacgccgugguugacgagcagugucagcucaauugcggcgggcaugaaucccaagugacccugaagggaaaccugaucuuccucgacguccccaaauuuguggauggcagcuacaugcagacguaucacucuacaguuccuaccggcgcuaauauucccuccccuacagacuggcugaacgcccuuuucgggaauggacugagccgguggauccucggcgugaucgggguccugcugggaggccuugcccucuuuuucaugauuaugucucuguuuaagcuggggaccaaacagguguuccgcagcagaaccaagcucgcuuga

SEQ ID NO: 14749 - RNA, 3222 nt, Artificial Sequence
  derived and/or modified CDS sequence (opt5) from SFTSV(JS2013-44)__KR230773.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuccuggagcuuaaguccuuuagccagucugaguuccccgacaucugcaaaauugauggaaucguguuuaaucagugugaaggcgaaagccugccucaacccuucgacgucgccuggauggauguggggcacucccauaagaucauuaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggagaccucugaagccaaaugucggugcucccucgugcauaagccuggggagguggucgugagcuacggaggcaugcgcaucagacccaaauguuacggguuuucccggaugauggcuacgcuggaaguuaaccagccugagcaacgccuuggacagugcaccggcugucaccuggaaugcauuaaugggggcgugagacucaucacacugaccucugagcuuaagagcgccacagucugugcgucccauuucugcucuagcgccaccuccggaaagaaaagcacggagauucaguuccacucuggcucccucguggggaagacagcuauccacguuaaaggagcccugguggauggcaccgaauuuacauucgaggggagcuguauguuucccgacggaugcgaugcugucgacugcaccuucugucgggaauuucuuaagaacccccaaugcuauccugccaaaaaguggcuguucaucauuaucgugauucuccugggcuacgcggggcuuaugcugcucaccaauguccugaaggccaucggcauuuggggaucuugggugaucgcuccgguuaaacugauguuugccaucauuaagaaacucaugcgcacaguguccugucugaugagaaagcugauggaucggggcagacaggucauccaugaggaaauuggggagaaccgcgagggaaaucaggacgaugugcggaucgaaauggcuagaccccgccggguuagacacuggauguauagcccugugauucugacgauccucgccauuggccuggccgagucuugcgacgaaaugguccaugcugauagcaaacuuguguccugucgccaggggagcggaaacaugaaggagugcgugaccacaggccgggcgcugcuccccgccguuaauccugggcaagaggcuugucugcacuucaccgcccccggcucuccggacuccaagugccugaaaaucaaggucaaaagaaucaaccucaaguguaaaaagagcuccucuuacuuugugccugaugcccgcagccggugcacauccgugagacgcugucggugggcuggagacugccagucuggcugucccccucauuucaccagcaauuccuuuucugacgauugggccgggaagauggacagagcgggacugggcuucagcgggugcuccgauggaugcggcggggcugccuguggcugcuuuaacgccgcucccagcuguauuuucuggcggaaaugggucgaaaauccucacggaaucauuuggaaggugucucccugcgccgcuuggguuccguccgccgugaucgagcuuacgaugccuagcggcgaaguccgcacauuccaccccaugucugggauucccacccagguguuuaaaggaguuuccgugaccuaucugggcagcgacauggaggucucugggcucacagaucugugugaaaucgaggagcugaaguccaaaaagcuggcgcucgccccuugcaaccaggcuggaaugggcgugguuggcaaagugggggaaauccaauguagcuccgaggaaagcgccagaaccauuaagaaggacggaugcaucuggaacgcugaucuggucggcauugagcugcggguggacgaugccguguguuacucuaaaaucacaagcgucgaagcgguugccaauuauuccgcuauuccgacgaccaucgggggacucagauucgagcgcucucaugacagccagggcaagaucuccgggucuccccuggauauuagcgccauccggggauccuuuucugugaacuacagaggccuucgccugagccucuccgagauuacagcuaccugcacaggcgaagugaccaaugucagcgggugcuacucuuguaugacgggagccaaaguguccaucaagcugcacagcucuaaaaacuccaccgcccauguuagaugcaagggcgacgagacagcuuucagcgugcuggaagggguccacuccuauauugugucucuuagcuuugaucacgcgguuguggacgagcagugucagcucaauugcggaggccaugaaucccaagucacccugaaggggaaccugaucuuccucgacgugccuaaauuuguugauggaagcuacaugcagacauaucacucuaccgugcccacgggcgccaauaucccuucccccacagacuggcugaacgcucuuuucggcaaugggcugagccgguggauucucggagucaucggcgugcugcuugggggacuugcccucuuuucuaugauuaugagccuguucaagcugggcaccaaacagguguuucgcuccagaacaaagcucgccuga

SEQ ID NO: 14750 - RNA, 3222 nt, Artificial Sequence
  derived and/or modified CDS sequence (opt5) from SFTSV(JS2013-46)__KR230774.1__GP
augaugaaggugaucugguucagcucccugauuugccucgucauccaguguggcggggacaccggacccauuaucugcgccggcccuauucacucuaacaaaagcgcugauaucccgcaucugcuuggguacuccgagaagaucugucaaauugacagacugauccacguuucuagcuggcuccggaaucauucccaguuucagggauaugugggccagcgcgggggaagaucucaagugagcuacuaucccgccgaaaacuccuacagccgguggucuggccugcuuuccccuugcgaugcggacuggcugggcaugcucgucgugaaaaaggcuaaagggagcgauaugauuguucccggaccuucuuauaagggcaagguguucuuugagcgccccacauucgacggguacgucggauggggcuguggguccggaaaaagcagaacggaaucuggcgagcugugcuccagcgauuccggcaccucuagcgggcugcucccuuccgaccgggugcuguggaucggagauguugccugucagccgaugacacccauuccugaagagaccuuucuugagcuuaagagcuucucucaguccgaauuucccgacaucugcaaaauugauggcaucguguucaaucagugugagggggaaagccucccucaacccuuugacgucgccuggauggaugugggacacucucauaagaucauuaugcgcgagcacaaaacaaagugggugcaggagagcuccucuaaggacuucgucugcuauaaagaaggcaccgggccguguagcgaguccgaagagaagacaugcaaaaccagcggaucuugcagaggcgacaugcaguuuuguaagguugcuggcugcgaacacggggaggaggccuccgaagcuaaaugucggugcagccuggugcauaagccuggagagguggucgugucuuacggcgggaugcgcguuagacccaaauguuacggauucucccggaugauggccacgcuugaagugaacgagccugaacagcgcaucggccaaugcaccgggugucaccuggagugcauuagcggcggagucagacucaucacacugaccuccgagcugaagucugcgacagugugugccagccauuuuugcuccucugcuaccagcggcaagaaauccacggaaauucaguuccacagcgggucucucguuggaaagacagccauccacgugaaaggcgcucuggucgaugggaccgaguucacauuugaaggauccuguauguuccccgacggcugcgaugccguggacugcaccuuuugucgggaguuccuuaagaauccccagugcuauccugcgaaaaaguggcuguuuaucauuaucgucauucuccugggguacgccggccuuaugcugcucaccaacgugcugaaggcuaucggaguuuggggcagcugggugauugccccggucaaacugguguucgcuaucaucaagaaacucaugcgcgccguuucuugucugauggggaagcugauggauagaggacggcaagugauucaugaagagaucggcgagaauagagaagggaaccaggacgauguccgcauugagauggcccggcccagacgcgugcggcacuggauguauuccccugugauccugacaauucucgcuaugggacuggcggaaggcugcgacgagaugguucaugccgauagcaaacuugucucuuguagacaggggagcggcaauaugaaggagugcgugacgaccggacgcgcucugcuccccgccgugaacccuggccaggaagccugucugcacuuuauggcucccggguccccggacagcaagugccugaaaaucaaggucaaacggauuaaucucaaguguaaaaagucuuccagcuacuucgugccugaugccagaucccgcugcacaucuguucggagaugucgcugggcgggagacugccaaagcggcugucccccucauuuuaccuccaacucuuucagcgacgauugggcugggaagauggaccgggccggacugggcuuuuccgggugcucugauggcugcggaggcgccgcuugugggugcuucaaugccgcucccagcuguaucuuuuggagaaaauggguggagaacccucacggaaucauuuggaaggucucccccugcgccgcgugggugccgagcgccguuaucgaacuuacaaugccuucuggcgaggugcggaccuuccaccccauguccgggauucccacgcaggucuucaaaggagugagcguuacauaucugggcucugacauggaaguguccggccucaccgaucugugugagaucgaggaacuuaagagcaaaaagcuggcucucgccccuugcaaucaggcugggaugggagucgugggcaaagugggggagauucaguguucuuccgaagagagcgcccgcaccaucaagaaggacggaugcaucuggaacgcggaucuggucggcauugaacugagaguugacgaugccguguguuacuccaaaaucacaagcguggaggcugucgccaacuauucugcuauuccgaccacaaucgggggacuccgguuugagagaagccaugacucccaaggcaagauuucuggcagcccccuggauaucacggccauccgcggguccuucucuauuaauuaccggggacuuagacugagccucuccgaaaucucugcuaccugcacaggcgaggugaccaacguuagcgggugcuacuccuguaugacaggagccaaagugagcauuaagcugcacucuuccaaaaauagcaccgcgcauguccgcugcaagggcgacgaaacggccuuuucugugcuggaggggguucacuccuauagcgugucccuuucuuucgaucacgcugucguggacgaacagugucagcucaacugcggaggccaugagagccagguuacccugagaggcaaucugaucuuucucgacgugccuaaguucgucgauggguccuacaugcaaacauaucacagcaccgugcccacaggagccaacauuccuucucccaccgacuggcugaaugcccuuuuuggcaacgggcugucccgguggauccucggagugaucggcguccugcuugggggacuggcucucuucuuucugauuaugagccuguucaaacucggcacgaagcagguuuuucgcucuagaacaaaacuggccuga

SEQ ID NO: 14751 - RNA, 3222 nt, Artificial Sequence
  derived and/or modified CDS sequence (opt5) from SFTSV(JS2013-52)__KR230775.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuccuggagcuuaaguccuuuagccagucugaguuccccgacaucugcaaaauugauggaaucguguuuaaucagugugaaggcgaaagccugccucaacccuucgacgucgccuggauggauguggggcacucccauaagaucauuaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcguuagacccaaauguuacggguuuucccggaugauggccacccuggaagugaaccagccugagcaacgcaucggacagugcacgggcugucaccuugaaugcauuaaugggggcgucagacugaucacccucacaucugagcucaagagcgcgaccgugugugccucccauuucugcucuagcgcuacauccggaaagaaaagcaccgagauucaguuccacucuggcucccugguugggaagacggccauccacgugaaaggagcucuggucgauggcacagaauuuaccuucgaggggagcuguauguuucccgacggaugcgaugccguggacugcacauucugucgggaauuucugaagaacccccaaugcuauccugcgaaaaaguggcuuuucaucauuaucgucauucugcucggcuacgccgggcugaugcuucugaccaaugugcucaaggcuaucggcauuuggggaucuuggguuaucgccccggugaaacugauguuugcuaucauuaagaaacugaugcgcaccgucuccugucucaugggcaagcugauggauagagggagacaggugauccaugaggaaauuggagagaaccgggagggcaaucaggacgauguucgcaucgaaauggcccggcccagacgcgugcggcacuggauguauagcccugucauucuuacauuccuggccaucgggcucgcugagucuugcgacgaaauggugcaugcggauagcaaacugguguccuguagacagggaagcggcaacaugaaggagugcguuacgaccgggcgcgcccuucugcccgcugucaauccuggccaagaggccugucuccacuuuacagcccccggaucuccggacuccaagugccugaaaauuaaggugaaacggaucaaccugaaguguaaaaagagcuccucuuacuucgugccugaugcuagaagccgcugcaccuccguccggagaugucgcugggccggcgacugccagucugggugucccccucauuuuacaagcaauuccuucucugacgauugggcgggaaagauggaccgggcuggccucggguuuagcggaugcuccgauggcugcgggggcgccgccuguggaugcuucaacgcugcccccagcuguaucuucuggagaaaauggguggaaaauccucacggcauuaucuggaagguuucucccugcgcugccugggugccguccgcggucauugagcugaccaugccuagcggggaagugcggacguuucaccccaugucuggaauccccacacagguuuucaaaggcguguccgucaccuaucuugggagcgacauggaggugucuggacugaccgaucucugugaaauugaggagcugaaguccaaaaagcuggcccuugcuccuugcaaccaggccggcaugggcguuguggggaaagucggagaaauccaauguagcuccgaggaaagcgcucgcacaaucaagaaggacggcugcauuuggaacgccgaucucguggggaucgagcugagaguggacgaugcggucuguuacucuaaaauuaccagcguugaagccguggcuaauuauuccgccaucccgacaacgauuggaggccugcgguuugagagaucucaugacagccaggggaagaucuccggaucuccccucgauaucaccgcuauucgcggcagcuucuccgugaacuaccggggccugagacuuucucugagcgagaucacagcuaccugcacaggggaagucaccaauguguccggaugcuacagcuguaugacgggcgccaaaguuucuauuaagcuccacuccagcaaaaacucuaccgcccaugugcgcugcaagggggacgagacagcguuuuccguccuggaaggagugcacagcuauaccguuucccugucuuucgaucacgccguggucgacgagcagugucagcuuaauugcggcgggcaugaaagccaagugacacucaagggaaaccugaucuuucuggacguuccuaaauucguggauggcuccuacaugcagaccuaucacagcacgguccccacaggcgcuaauauuccuucucccaccgacuggcucaacgcccuguuugggaauggacuuuccagauggauccugggcgugaucggggugcuccugggaguccuggcccuuuucuuucucauuaugagccuguucaagcugggcacaaaacagguuuuucggucucgcaccaagcucgcuuga

SEQ ID NO: 14752 - RNA, 3222 nt, Artificial Sequence
  derived and/or modified CDS sequence (opt5) from SFTSV(JS2013-69)__KR230776.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauauuaucguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggauuggggauguugccugucagccgaugacccccaucccugaagagacauuccuggagcuuaaguccuuuagccagucugaauuucccgacauuugcaaaaucgauggaaucguguuuaaucagugugagggcgaaagccugccucaacccuucgacgucgccuggauggauguggggcacucccauaagauuaucaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcguuagacccaaauguuacggguuuucccggaugauggccacccuggaagugaaccagccugagcaacgccuuggacagugcacgggcugucaccuggaaugcauuaaugggggcgucagacucaucacccugacaucugagcuuaagagcgcgaccgugugugccucccauuucugcucuagcgcuacauccggaaagaaaagcaccgagauucaguuccacucuggcucccucguugggaagacggccauccacgugaaaggagcucuggucgauggcacagaauuuacccuugagagcucuuguauguuccccgacgggugcgaugccguggacugcacauuuugucgggaguuccugaagaacccccaaugcuauccugcgaaaaaguggcucuuuaucauuaucgucauucugcuuggauacgccggccugaugcuccugaccaaugugcugaaggcuaucgggauuuggggcuccuggguuaucgccccggugaaacucauguucgcuaucauuaagaaacugaugcgcaccgucagcugucuuaugagaaagcugauggaucggggaagacaggugauccaugaagaaauuggcgagaaccgcgaggggaaucaggacgauguucggaucgaaauggccagaccccgccgggugagacacuggauguauucuccugucauucucacaauccuggccauuggacuugcugagagcugcgacgaaauggugcaugcggauuccaaacuggugagcugucgccagggcucugggaacaugaaggagugcguuacgaccggacgggcccuccugcccgcugucaauccuggccaagaggccugucugcacuuuacagcccccggguccccggacagcaagugccucaaaaucaaggugaaaagaaucaaccugaaguguaaaaaguccucuagcuacuucgugccugaugcucgcucccggugcaccucugucagacgcugucggugggccggcgacugccagagcggaugucccccucauuuuacauccaauucuuucagcgacgauugggcgggcaagauggacagagcugggcuuggauuuuccggcugcagcgaugggugcggaggcgccgccugugggugcuucaacgcugcccccucuuguauuuucuggcggaaauggguggaaaauccucacggcaucauuuggaagguuucccccugcgcugccugggugccgagcgcggucaucgagcugaccaugccuucuggagaagugcgcacguuccaccccauguccggcauucccacacagguuuucaaaggggugagcgucaccuaucucggaucugacauggagguguccggccugaccgaucugugugaaaucgaggagcuuaagagcaaaaagcucgcccuggcuccuugcaaccaggccgggaugggaguugugggcaaagucggcgaaauccaauguuccagcgaggaaucugcuagaacaauuaagaaggacgggugcaucuggaacgccgaucuggugggaauugagcuccggguggacgaugcggucuguuacagcaaaaucaccuccguugaagccguggcuaauuauucugccauuccgacaacgaucggcgggcugagauuugagcgcagccaugacucccagggaaagaucucuggcagcccccuugauauuaccgcuauccggggguccuucucugugaacuacagaggacugcgccucagccuguccgagauuacagcuaccugcacaggcgaagucaccaaugugagcggcugcuacucuuguaugacgggggccaaaguuuccaucaagcugcacagcucuaaaaacuccaccgcccaugugagaugcaagggagacgagacagcguuuagcguccuugaaggcgugcacuccuauaccguuucucucagcuucgaucacgccguggucgacgagcagugucagcugaauugcgggggacaugaaucccaagugacacugaagggcaaccucauuuuucuggacguuccuaaauucguggaugggagcuacaugcagaccuaucacucuuccguccccacgggagcuaauaucccuagccccacagacuggcuuaacgcccuguuuggcaauggccucucucgguggauccugggggugauuggagugcugcuuggcguccucgcccuguucuuucugaucaugagccucuucaagcuggggaccaaacagguuuuucgcuccagaacaaagcuggcuuga

SEQ ID NO: 14753 - RNA, 3222 nt, Artificial Sequence
  derived and/or modified CDS sequence (opt5) from SFTSV(JS2013-71)__KR230777.1__GP
augaugaaggugaucugguucagcucccugauuugcuuugucauccaguguggcggggacaccggacccauuaucugcgccggcccuauucacucuaacaaaagcgcugauaucccgcaucuccugggguacuccgagaagaucugucaaauugacagacuuauccacguuucuagcuggcugcggaaucauucccaguuccagggauaugugggccagcgcgggggaagaucucaagugagcuacuaucccgccgaaaacuccuacagccgguggucuggccuccuguccccuugcgaugcggacuggcuuggcaugcuggucgugaaaaaggcuaaagggagcgauaugauuguucccggaccuucuuauaagggcaagguguuuuucgagcgccccacauuugacggguacgucggauggggcuguggguccggaaaaagcagaacggaaucuggcgagcucugcuccagcgauuccggcaccucuagcgggcugcugccuuccgaccgggugcucuggaucggagauguugccugucagccgaugacacccauuccugaagagaccuuccuggagcuuaagagcuuuucucaguccgaguuccccgacaucugcaaaauugauggcaucguguuuaaucagugugaaggggaaagccugccucaacccuucgacgucgccuggauggaugugggacacucucauaagaucauuaugcgcgagcacaaaacaaagugggugcaggagagcuccucuaaggacuuugucugcuauaaagaaggcaccgggccguguagcgaguccgaagagaagacaugcaaaaccagcggaucuugcagaggcgacaugcaguucuguaagguugcuggcugcgaacacggggaggaggccuccgaagcuaaaugucggugcagccucgugcauaagccuggagagguggucgugucuuacggcgggaugcgcguuagacccaaauguuacggauuuucccggaugauggccacgcuggaagugaaccagccugagcaacgcaucggccagugcaccgggugucaccuugaaugcauuaauggcggagucagacugaucacacucaccagcgagcugaaguccgcgacagugugugccucucauuucugcagcuccgcuaccucuggcaagaaaagcacggagauucaguuccacuccgggagccugguuggaaagacagccauccacgugaaaggcgcucucgucgaugggaccgaauuuacauucgagggaucuuguauguuucccgacggcugcgaugccguggacugcaccuucugucgggaauuucugaagaacccccaaugcuauccugcgaaaaaguggcuuuucaucauuaucgucauucugcucggguacgccggccugaugcuucugaccaaugugcucaaggcuaucggaguuuggggcuccugggugauugccccggucaaacugguguuugcuaucaucaagaaacugaugcgcgccguuagcugucucauggggaagcugauggauagaggaagacaggugauucaugaggaaaucggcgagaaccgggaggggaaucaggacgauguccgcauugaaauggcccggcccagacgcgugcggcacuggauguauucuccugugauccuuacaauucuggcuaucggacucgcggagggcugcgacgaaaugguucaugccgauuccaaacuggucagcuguagacaggggucuggcaacaugaaggagugcgugacgaccggacgcgcccuucugcccgccgugaauccuggccaagaggccugucuccacuucacagcucccgggagcccggacuccaagugccugaaaauuaaggucaaacggaucaaccugaaguguaaaaagucuagcuccuacuuugugccugaugccagaagccgcugcaccuccguucggagaugucgcugggcgggagacugccagucuggcugucccccucauuucacaagcaauuccuuuucugacgauugggcugggaagauggaccgggccggacucggcuucagcgggugcuccgauggcugcggaggcgccgcuugugggugcuuuaacgccgcucccucuuguaucuucuggagaaaauggguggaaaauccucacggaauuaucuggaaggucagccccugcgccgcgugggugccguccgccguuauugagcugaccaugccuagcggcgaagugcggacguuccaccccaugucugggauccccacacaggucuuuaaaggaguguccguuaccuaucuuggcagcgacauggaggugucuggccugaccgaucucugugaaauugaggagcugaaguccaaaaagcuggcucuugccccuugcaaccaggcugggaugggagucgugggcaaagugggggaaauccaauguagcucugaggaauccgcccgcacaaucaagaaggacggaugcauuuggaacgcggaucucgucggcaucgagcugagaguugacgaugccguguguuacagcaaaauuaccuccguggaagcugucgccaauuauagcgcuaucccgacaacgauugggggacugcgguucgagagaucucaugacagccagggcaagaucuccggcucuccccucgauaucaccgccauucgcgggagcuuuuccgugaacuaccggggacugagacuuucucugagcgagaucacagcuaccugcacaggcgaaguuaccaauguguccgggugcuacucuuguaugacgggagcuaaagucagcauuaagcuccacuccagcaaaaacucuaccgcgcaugugcgcugcaagggcgacgagacagccuucuccguucuggaaggggugcacagcuauucugucucccugagcuuugaucacgcugugguugacgagcagugucagcuuaauugcggaggccaugaaucccacgugacccucagaggcaaccugaucuuccuggacgucccuaaguuuguggaugggucuuacaugcaaacauaucauagcaccgugcccacgggagccaauauuccuucccccacagacuggcucaacgcccuguucggcaaugggcuuagccgguggauccugggagucaucggcguucuccuugggggacuggcucuguuuuuccucauuaugucucuguuuaaacugggcaccaaacagguguuccgcuccagaacaaagcucgccuga

SEQ ID NO: 14754 - RNA, 3222 nt, Artificial Sequence
  derived and/or modified CDS sequence (opt5) from SFTSV(JS2014-03)__KR230778.1__GP
augaugaaggugaucugguucagcucccugauuuacuuugucauccagugcucuggcgacagcgggcccauuaucugugccggaccuauucacuccaacaaaucugcugauaucccgcaucuccugggcuauagcgagaagaucugccaaauugacagacuuauccacguuuccucuuggcugcggaaucauagccaguuccagggguacgugggacagcgcggcgggagaucccaagugagcuauuaccccgccgaaaacucuuauucccgguggagcggacuccugucuccuugugaugcggacuggcuuggcaugcuggucgugaaaaaggcuaaaggcuccgauaugauuguucccgggccuagcuacaagggaaagguguuuuucgagcgccccaccuuugacggcuaugucggguggggaugcggcucugggaaauccagaacagaaagcggagagcucuguuccucugauagcggcacguccagcggccugcugccuucugaccgggugcucuggaucggggauguugccugccagccgaugacccccauuccugaagagacauuccuggagcuuaaguccuuuagccagucugaguuccccgacaucuguaaaauugauggaaucguguuuaaucagugcgaaggcgaaagccugccucaacccuucgacgucgccuggauggauguggggcacucccauaagaucauuaugcgcgagcacaaaaccaagugggugcaggagucuagcuccaaggacuuugucuguuacaaagaaggaacaggcccgugcagcgagucugaagagaagaccuguaaaacauccgggagcugcagaggagacaugcaguucugcaagguugcuggcugugaacacggcgaggaggccucugaagcuaaaugccgguguucccucgugcauaagccuggggagguggucgugagcuacggaggcaugcgcaucagacccaaaugcuauggguuuucccggaugauggccacccuggaaguuaaccagccugagcaacgcauuggacaguguacgggcugccaccuugaauguaucaaugggggcgugagacugauuacccucacaucugagcucaagagcgcgaccgucugcgccucccauuucuguucuagcgcuacauccggaaagaaaagcaccgagauccaguuccacucuggcucccugguggggaagacggccauccacguuaaaggagcucugguggauggcacagaauuuaccuucgaggggagcugcauguuucccgacggaugugaugccgucgacugcacauucugccgggaauuucugaagaacccccaauguuacccugcgaaaaaguggcuuuucauuaucauugugauccugcucggcuaugccgggcugaugcuucugaccaauguccucaaggcuauuggcaucuggggaucuugggugaucgccccgguuaaacugauguuugcuauuaucaagaaacugaugcgcaccguguccugccucaugggcaagcugauggauagagggcggcaggucauucaugaggaaaucggagagaacagagagggcaaucaggacgaugugcgcauugaaauggcccggcccagacgcguucggcacuggauguacagcccugugauccuuacauuccuggccauugggcucgcugagucuugugacgaaaugguccaugcggauagcaaacugguguccugcagacagggaagcggcaacaugaaggagugugugacgaccgggcgcgcccuucugcccgcuguuaauccuggccaagaggccugccuccacuuuacagcccccggaucuccggacuccaagugucugaaaaucaaggucaaacggaucaaccugaagugcaaaaagagcuccucuuauuucgugccugaugcuagaagccgcuguaccuccgugcggagaugccgcugggccggcgacugucagucugggugucccccucauuuuacaagcaauuccuucucugacgauugggcgggaaagauggaccgggcuggccucggguuuagcggaugcuccgauggcugcgggggcgccgccugcggauguuucaacgcugcccccagcugcauuuucuggagaaaaugggucgaaaauccucacggcaucauuuggaaggugucucccugugcugccuggguuccguccgcggugaucgagcugaccaugccuagcggggaaguccggacguuucaccccaugucuggcauucccacacagguguucaaaggaguuuccgugaccuaccuugggagcgacauggaggucucuggacugaccgaucucugcgaaaucgaggagcugaaguccaaaaagcuggcccuugcuccuuguaaccaggccggcaugggcgugguugggcgcgugggagaaauccaaugcagcuccgaggaaagcgcuagaacaauuaaaaaggacggcuguaucuggaacgccgaucucgucgggauugagcugcggguggacgaugcggugugcuauucuaagaucaccagcgucgaagccguugcuaauuacuccgccauuccgacaacgaucggaggccugagauuugagcgcucucaugacagccaggggaaaaucuccggaucuccccucgauauuaccgcuauccggggcagcuucuccgugaacuacagaggccugcgccuuucucugagcgagauuacagccaccuguacaggggaagugaccaaugucuccggaugcuauagcugcaugacgggcgccaaggugucuaucaaacuccacuccagcaagaacucuaccgcucauguuagauguaaaggggacgagacagcguuuuccgugcuggaaggaguccacagcuacaccgugucccugucuuucgaucacgccguuguggacgagcagugccagcuuaauuguggcgggcaugaaagccaagucacacucaagggaaaccugauuuuucuggacgugccuaaguucguugauggcuccuauaugcagaccuaccacagcacggugcccacaggcgcuaauaucccuucucccaccgacuggcucaacgcccuguuugggaauggacuuucccgguggauccugggcgucauuggggugcuccugggaggccuggcccuuuucuuuaugaucaugagccucuucaaacuggggacaaaacagguguuucgcucuagaaccaagcuggcuuga

SEQ ID NO: 14755 - RNA, 3222 nt, Artificial Sequence
  derived and/or modified CDS sequence (opt5) from SFTSV(JS2014-16)__KR230780.1__GP
augaugaaggugaucugguucagcucccugauuugccucgucauccaguguucuggcgacaccgggcccauuaucugcgccggaccuauucacagcaacaaauccgcuaauaucccgcaucugcuuggcuacucugagaagaucugucaaauugauagacugauccacguuagcuccuggcuccggaaccauucucaguuucagggguaugugggacagcgcggcgggagaagccaaguguccuacuaucccgccgaaaauagcuacucucggugguccggacugcuuagcccuugcgacgcggauuggcugggcaugcucgucgugaaaaaggcuaaaggcucugacaugauuguucccgggccuuccuauaagggaaagguguucuuugagcgccccacauucgauggcuacgucggguggggauguggcagcgggaaaucuagaacggaauccggagagcugugcagcuccgacucuggcaccagcuccggccugcucccuagcgaucgggugcuguggaucggggacguugccugucagccgaugacacccauuccugaagagaccuuucuugagcugaagucuuucucccagagcgaauuucccgauaucugcaaaguggacggaauugucuucaaccagugugauucugagagccucccucaacccaucgacguggccuggauggaugugggccacucccauaagaucauuaugcgcgaacacaaaacaaaguggguccaggagucuagcuccaaggacuuuguuugcuauaaagaggggaccggaccguguagcgaaucugaggaaaagacaugcaaaaccuccggcagcugcagaggggacaugcaguucuguaagguggcuggaugcgagcacggcgaagaggccucugaggcuaaaugucggugcucccuggugcauaagccuggcgaagucgugguuagcuacgggggaaugcgcgugagacccaaauguuacggcuuuucccggaugauggccacgcuugaggucaauccucccgaacagcgcaucgggcaaugcaccggaugucaccuggagugcauuaacggcggggugagacucaucacacugaccucugaacuuaagagcgcgacaguuugugccucccauuucugcucuagcgcuaccuccggcaagaaaagcacggagauucaguuucacucuggaucccucgugggcaaggccgcuauccacgucaaaggggcccugguggauggaacagaguucaccuucgaaggcagcuguauguuucccgacgggugcgaugcggucgacugcacauucugucgggaguuucuuaagaauccucagugcuauccggccaaaaaguggcuguucaucauuaucgugauucuccugggauacgcuggccuuaugcugcucaccaacguucugaaggccaucgggguguggggcucuugggucauggcucccgugaaacugauguuugccauuaucaagaaacucaugcgcuccguuagcuguaugaugggaaagcugauggauagaggccggcaagugauccaugaagagauuggggaaaauagagagggaaaccaggacgauguccgcaucgagauggcccggccuagacgcgugcggcacuggauguauucucccgugauucuuaccauccuggcuauuggccucgcggaagggugcgacgagaugguucaugccgauagcaaacugguccuuuguagacagggauccggcaauaugaaggaaugcgugacaacggggcgcgcucugcucccugccgugaaccccggccaggaggccugucugcacuucaccgcuccgggaagcccugacucuaagugccugaaaaucaaggucaaacggauuaaucucaaguguaaaaaguccagcuccuacuuugugcccgaugccagaucucgcugcacaagcguucggagaugucgcugggcgggcgacugccaauccgggugcccuucucauuucaccagcaacuccuuuucugacgauugggcuggaaagauggaccgggccggccugggguucagcggauguuccgauggcugcgggggcgccgcuuguggaugcuuuaaugccgcucccagcuguaucuucuggagaaaauggguggagaacccucacggcaucauuuggaaggucucucccugcgccgcgugggugccguccgccguuaucgaacuuacaaugccuagcggggaggugcggaccuuucaccccaugucuggcauucccacgcaggucuucaaaggaguguccguuacauaucuggggagcgacauggaagugucuggacucaccgaucugugugagaucgaggaacugaaguccaaaaagcuggcucucgccccuugcaaccaggcuggcaugggcgucguggggaaagugggagagauucaguguagcuccgaagagagcgcccgcaccaucaagaaggacggcugcaucuggaaugcggaucuggucgggauugaacugagaguugacgaugccguguguuacucuaaaaucacaagcguggaggcugucgccaacuauuccgcuauuccgaccacaaucggaggccuccgguucgaaagaucucaugacagccaagggaagauuuccggaucuccccuggauaucacggccauccgcggcagcuuuuccgugaauuaccggggccuuagacugucucucagcgagauuaccgccacaugcaccggggagguuacaaacguguccggaugcuacagcuguaugaccggcgcuaaagucucuaucaagcugcacuccagcaaaaauucuacggcgcaugugcgcugcagaggggacgaaaccgccuucuccguucuggagggagugcacagcuauacagucucccuuucuuuugaucacgcugugguugacgaacagugucagcucaacugcggcgggcaugagagccaggugacccugaagggaaaucugauuuuccucgacgucccuaaguuuguggauggcuccuacaugcaaacauaucacagcucugugcccaccggcgccaacaucccuucccccacggacuggcugaaugcccuuuucgggaacggacugagccgguggauucucggcgucaucgggguucugcugggagugcuugcucucuuuuuccugaucaugucucuguuuaaacucggcacaaaacagguguuccgcagcagaaccaagcuggccuga

SEQ ID NO: 14756 - RNA, 3222 nt, Artificial Sequence
  derived and/or modified CDS sequence (opt5) from SFTSV(JS2014-18)__KR230781.1__GP
augaugaaggugaucugguucagcucccugauuugccucgucauccaguguggcggggacaccggacccauuaucugcgccggcccuauucacucuaacaaaagcgcugauaucccgcaucugcuuggguacuccgagaagaucugucaaauugacagacugauccacguuucuagcuggcuccggaaucauucccaguuucagggauaugugggccagcgcgggggaagaucucaagugagcuacuaucccgccgaaaacuccuacagccgguggucuggccugcuuuccccuugcgaugcggacuggcugggcaugcucgucgugaaaaaggcuaaagggagcgauaugauuguucccggaccuucuuauaagggcaagguguucuuugagcgccccacauucgacggguacgucggauggggcuguggguccggaaaaagcagaacggaaucuggcgagcugugcuccagcgauuccggcaccucuagcgggcugcucccuuccgaccgggugcuguggaucggagauguugccugucagccgacaacccccauuccugaagagacauuucuugagcuuaagagcuucucucaguccgaauuucccgacgugugcaaaaucgauggcauugucuucaaucagugugagggggaaagccucccucaacccuuugacguggccuggauggaugugggacacucucauaagaucaucaugcgcgagcacaaaaccaaguggguccaggagagcuccucuaaggacuucguuugcuauaaagaaggcacagggccguguagcgaguccgaagagaagaccugcaaaacgagcggaucuugcagaggcgacaugcaguuuuguaagguggcuggcugcgaacacggggaggaggccuccgaagcuaaaugucggugcagccuggugcauaagccuggagaggucgugguuucuuacggcgggaugcgcgugagacccaaauguuacggauucucccggaugauggccacccuugaagucaacccucccgagcagcgcauuggccaaugcacagggugucaccuggaaugcaucaauggcggagugagacucauuacccugacaagcgagcugaaguccgcgaccguuugugccucucauuuuugcagcuccgcuacgucuggcaagaaaagcacagagauccaguuccacuccgggagccucgugggaaagaccgccauucacgucaaaggcgcucugguggaugggacagaguucaccuuugaaggaucuuguauguuccccgacggcugcgaugccgucgacugcaccuuuugucgggaguuccuuaagaacccucagugcuauccggcgaaaaaguggcuguuuaucaucauugugauccuccugggguacgccggccuuaugcugcucacaaauguucugaaggcuauuggaguguggggcuccugggucaucgcccccgugaaacugguuuucgcuauuaucaagaaacucaugcgcgccgugagcugucugauggggaagcugauggauagaggacggcaagucauccaugaagaaauuggcgagaacagagaggggaaucaggacgaugugcgcaucgaaauggcccggccuagacgcgugcggcacuggauguauucucccguuauucugacgauccucgcuauuggacuggcggagggcugcgacgaaaugguccaugccgauuccaaacuugugagcuguagacaggggucuggcaacaugaaggagugcgugaccacaggacgcgcucugcucccugccgucaaucccggccaggaggccugucugcacuuuaccgcuccggggagcccugacuccaagugccugaaaaucaaggugaaacggauuaaccucaaguguaaaaagucuagcuccuacuucguucccgaugccagaagccgcugcacauccgugcggagaugucgcugggcgggagacugccaaucuggcugcccuccccauuuuaccagcaauuccuucucugacgauugggcugggaagauggaccgggccggacugggcuuuagcggguguuccgauggcugcggaggcgccgcuugugggugcuucaacgccgcuccuucuuguaucuuuuggagaaaaugggucgaaaauccccacggaaucauuuggaaggugagcccgugcgccgcguggguuccuuccgccgugaucgagcuuacgaugcccagcggcgaaguccggacauuccaccccaugucugggauuccuacccagguguucaaaggaguuuccgugaccuaucugggcagcgacauggaggucucuggccucacagaucugugugaaaucgaggagcugaaguccaaaaagcuggcucucgccccgugcaaccaggcugggaugggaguggugggcaaagucggggaaauucaguguagcucugaggaauccgcccgcaccaucaagaaggacggaugcaucuggaacgcggaucugguuggcauugagcugagaguggacgaugccguguguuacagcaaaaucacauccgucgaagcuguggccaauuauagcgcuauucccacgaccaucgggggacuccgguuugagagaucucaugacagccaaggcaagauuuccggcucuccucuggauaucacagccauccgcgggagcuucuccguuaacuaccggggacuuagacugucucucagcgagauuaccgccacaugcaccggcgaagugacgaaugucuccgggugcuacucuuguaugaccggagcuaaagugagcaucaagcugcacuccagcaaaaacucuacagcgcauguucgcugcaagggcgacgagaccgccuuuuccgugcuggaagggguccacagcuauucugugucccuuagcuucgaucacgcuguuguggacgagcagugucagcucaauugcggaggccaugaaucccaggucacacugagaggcaaccugauuuuucucgacgugcccaaguucguggaugggucuuacaugcaaaccuaucacagcacggucccuacaggagccaauauccccuccccuaccgacuggcugaacgcccuuuuuggcaaugggcugagccgguggauucucggaguuaucggcgugcugcuugggggacuugcucucuucuuucugaucaugucucuguucaaacucggcacaaaacagguguuucgcuccagaaccaagcuggccuga

SEQ ID NO: 14757 - RNA, 3222 nt, Artificial Sequence
  derived and/or modified CDS sequence (opt5) from SFTSV(JS2014-31)__KR230782.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuccuggagcuuaaguccuuuagccagucugaguuccccgacaucugcaaaauugauggaaucguguuuaaucagugugaaggcgaaagccugccucaacccuucgacgucgccuggauggauguggggcacucccauaagaucauuaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcaucagacccaaauguuacggguuuucccggaugauggccacccuggaaguuaaccagccugagcaacgccuuggacagugcacgggcugucaccuggaaugcauuaaugggggcgugagacucaucacccugacaucugagcuuaagagcgcgaccgucugugccucccauuucugcucuagcgcuacauccggaaagaaaagcaccgagauucaguuccacucuggcucccucguggggaagacggccauccacguuaaaggagcucugguggauggcacagaauuuaccuucgaggggagcuguauguuucccgacggaugcgaugccgucgacugcacauucugucgggaauuucuuaagaacccccaaugcuauccugcgaaaaaguggcuguucaucauuaucgugauucuccugggcuacgccgggcuuaugcugcucaccaauguccugaaggcuaucggcauuuggggaucuugggugaucgccccgguuaaacugauguuugcuaucauuaagaaacucaugcgcaccguguccugucugaugagaaagcugauggaucggggcagacaggucauccaugaggaaauuggggagaaccgcgagggaaaucaggacgaugugcggaucgaaauggccagaccccgccggguuagacacuggauguauagcccugugauucugacaauccucgccauuggccuggcugagucuugcgacgaaaugguccaugcggauagcaaacuuguguccugucgccaggggagcggaaacaugaaggagugcgugacgaccggccgggcccugcuccccgcuguuaauccugggcaagaggccugucugcacuucacagcccccggcucuccggacuccaagugccugaaaaucaaggucaaaagaaucaaccucaaguguaaaaagagcuccucuuacuuugugccugaugcucgcagccggugcaccuccgugagacgcugucggugggccggagacugccagucuggcugucccccucauuucacaagcaauuccuuuucugacgauugggcggggaagauggacagagcuggacugggcuucagcgggugcuccgauggaugcggcggggccgccuguggcugcuuuaacgcugcccccagcuguauuuucuggcggaaaugggucgaaaauccucacggaaucauuuggaaggugucucccugcgcugccuggguuccguccgcggugaucgagcuuaccaugccuagcggcgaaguccgcacguuccaccccaugucugggauucccacacagguguuuaaaggaguuuccgugaccuaucugggcagcgacauggaggucucugggcucaccgaucugugugaaaucgaggagcugaaguccaaaaagcucgcccuugcuccuugcaaccaggccggaaugggcgugguuggcaaagugggggaaauccaauguagcuccgaggaaagcgcuagaacaauuaagaaggacggaugcaucuggaacgccgaucuggucggcauugagcugcggguggacgaugcgguguguuacucuaaaaucaccagcgucgaagccguugcuaauuauuccgccauuccgacaacgaucgggggacucagauucgagcgcucucaugacagccagggcaagaucuccgggucuccccuggauauuaccgcuauccggggcagcuuuuccgugaacuacagaggacuucgccugucucucagcgagauuacagcuaccugcacaggcgaagugaccaaugucuccgggugcuacagcuguaugacgggagccaaagugucuaucaagcugcacuccagcaaaaacucuaccgcccauguuagaugcaagggcgacgagacagcguucuccgugcuggaagggguccacagcuauaccgugucccuuucuuuugaucacgccguuguggacgagcagugucagcucaauugcggaggccaugaaagccaagucacacugaaggggaaccugauuuuccucgacgugccuaaauuuguugauggauccuacaugcagaccuaucacagcacggugcccacaggcgcuaauaucccuucucccaccgacuggcugaacgcccuuuucggcaaugggcugucccgguggauccucggagucauuggcgugcugcugggggugcuugcccucuuuuuccugaucaugagccuguuuaagcucggaacaaaacaggucuuccgcucuagaaccaagcuggcuuga

SEQ ID NO: 14758 - RNA, 3222 nt, Artificial Sequence
  derived and/or modified CDS sequence (opt5) from SFTSV(JS2014-33)__KR230783.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuccuggagcuuaaguccuuuagccagucugaguuccccgacaucugcaaaauugauggaaucguguuuaaucagugugaaggcgaaagccugccucaacccuucgacgucgccuggauggauguggggcacucccauaagaucauuaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcguuagacccaaauguuacggguuuucccggaugauggccacccuggaagugaaccagccugagcaacgcaucggacagugcacgggcugucaccuugaaugcauuaaugggggcgucagacugaucacccucacaucugagcuuaagagcgcgaccgugugugccucccauuucugcucuagcgcuacauccggaaagaaaagcaccgagauucaguuccacucuggcucccugguugggaagacggccauccacgugaaaggagcucucgucgauggcacagaauuuaccuucgaggggaacuguauguuucccgacggaugcgaugccguggacugcacauucugucgggaauuucugaagaauccccaaugcuauccugcgaaaaaguggcuuuucaucauuaucgucauucugcucggcuacgccgggcugaugcuucugaccaacgugcucaaggcuaucggcauuuggggaagcuggguuaucgccccggugaaacugaucuuugcuauuaucaagaaacugaugcgcgccgucggcugucucauggggaagcugauggauagaggaagacaggugauucaugaggaaaucggcgagaaucgggaggggaaccaggacgauguucgcauugaaauggcccggcccagacgcgugcggcacuggauguauucuccugucauccuuaccauucuggcuaucggacucgcggaguccugcgacgaaauggugcaugccgauagcaaacuggugucuuguagacagggcgggggcaauaugaaggagugcguuacaacgggacgcgcucugcugcccgccgucaacccuggccaagaggccugucuccacuucaccgcucccgggagcccggacuccaagugccugaaaaucaaggugaaacggauuaaucugaaguguaaaaagucuagcuccuacuuugugccugaugccagaagccgcugcacauccguccggagaugucgcugggcgggagacugccagucuggcugucccccucauuucaccagcaacuccuuuucugacgauugggcugggaagauggaccgggccggacucggcuucagcgggugcuccgauggcugcggaggcgccgcuugugggugcuuuaaugccgcucccucuuguaucuucuggagaaaauggguggaaaacccucacggaauuaucuggaagguuagccccugcgccgcgugggugccguccgccgucauugagcugacaaugccuagcggcgaagugcggaccuuccaccccaugucugggauccccacgcagguuuuuaaaggaguguccgucacauaucuuggcagcgacauggaggugucuggccugaccgaucucugugaaaucgaggagcugaaguccaaaaagcuggcucuugccccuugcaaccaggcugggaugggaguugugggcaaagucggggaaauucaauguagcucugaggaauccgcccgcaccaucaagaaggacggaugcauuuggaaugcggaucucgugggcaucgagcugagaguggacgaugccgucuguuacagcaaaauuacauccguugaagcuguggccaacuauagcgcuaucccgaccacaaucgggggacugcgguucgagagaucucaugacagccagggcaagauuuccggcucuccccucgauaucacggccauucgcgggagcuuuuccgugaauuaccggggacugagacuuucucugagcgagaucaccgccacaugcaccggcgaagucacaaacguguccgggugcuacucuuguaugaccggagcuaaaguuagcauuaagcuccacuccagcaaaaauucuacggcgcaugugcgcugcaagggcgacgagaccgccuucuccguccuggaaggggugcacagcuauacaguuucucuguccuuugaucacgcuguggucgacgagcagugucagcuuaacugcggaggccaugaaagccaagugacccucaagggcaaucugaucuuccuggacguuccuaaauuuguggauggguccuacaugcagacauaucacucugccguccccaccggagccaacaucccuagccccacggacuggcucaaugcucuguucggcaacgggcuuuccagauggauucugggagugaucggcgugcuccuugggggacuggcccuguuuuucaugauuaugagccucuuuaagcugggcacaaaacaggcguuccggucucgcaccaagcuggcuuga

SEQ ID NO: 14759 - RNA, 3222 nt, Artificial Sequence
  derived and/or modified CDS sequence (opt5) from SFTSV(JS2014-39)__KR230784.1__GP
augaugaaggugaucugguucagcucccugaccugcuuugucauucaguguucuggcgacagcgggcccaucauuugcgccggaccuauccacuccaacaaaucugcugauauuccgcaucuccugggcuacagcgagaagaucugucaaaucgacagacuuauucacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugaucguucccgggccuagcuauaagggaaagguguuuuucgagcgccccacauuugacggcuacgucggguggggauguggcucugggaaauccagaacggaaagcggagagcucugcuccucugauagcggcaccuccagcggccugcugccuucugaccgggugcucuggauuggggauguugccugucagccgaugacacccaucccugaagagaccuuccuggagcuuaaguccuuuagccagucugaguuccccgacauuugcaaaaucgauggaauuguguuuaaucagugugaaggcgaaagccugccucaacccuucgacgucgccuggauggauguggggcacucccauaagaucaucaugcgcgagcacaaaacaaagugggugcaggagucuagcuccaaggacuuugucugcuauaaagaaggaaccggcccguguagcgagucugaagagaagacaugcaaaaccuccgggagcugcagaggagacaugcaguucuguaagguugcuggcugcgaacacggcgaggagacgucugaagccaaaugucggugcucccucgugcauaagccuggggagguggucgugagcuacggaggcaugcgcauuagacccaaauguuacggguuuucccggaugauggcuacccuggaaguuaaccagccugagcaacgccuuggacagugcacaggcugucaccuggaaugcaucaaugggggcgugagacucauuacccugacaucugagcuuaagagcgccaccgucugugcgucccauuucugcucuagcgccacguccggaaagaaaagcacagagauccaguuccacucuggcucccucguggggaagaccgcuauucacguuaaaggagcccugguggauggcacagaauuuaccuucgaggggagcuguauguuucccgacggaugcgaugcugucgacugcaccuucugucgggaauuucuuaagaacccccaaugcuauccugccaaaaaguggcuguucaucaucauugugauccuccugggcuacgcggggcuuaugcugcucacaaauguccugaaggccauuggcaucuggggaucuugggugauugcuccgguuaaacugauguuugccaucaucaagaaacucaugcgcacgguguccugucugaugagaaagcugauggaucggggcagacaggucauucaugaggaaaucggggagaaccgcgagggaaaucaggacgaugugcggauugaaauggcuagaccccgccggguuagacacuggauguauagcccugugauccugaccauucucgccaucggccuggccgagucuugcgacgaaaugguccaugcugauagcaaacuuguguccugucgccaggggagcggaaacaugaaggagugcgugacaaccggccgggcgcugcuccccgccguuaauccugggcaagaggcuugucugcacuucacagcccccggcucuccggacuccaagugccugaaaauuaaggucaaaagaaucaaccucaaguguaaaaagagcuccucuuacuuugugccugaugcccgcagccggugcaccuccgugagacgcugucggugggcuggagacugccagucuggcugucccccucauuucacgagcaauuccuuuucugacgauugggccgggaagauggacagagcgggacugggcuucagcgggugcuccgauggaugcggcggggcugccuguggcugcuuuaacgccgcucccagcuguaucuucuggcggaaaugggucgaaaauccucacggaauuaucuggaaggugucucccugcgccgcuuggguuccguccgccgugauugagcuuacaaugccuagcggcgaaguccgcaccuuccaccccaugucugggauccccacccagguguuuaaaggaguuuccgugacauaucugggcagcgacauggaggucucugggcucaccgaucugugugaaauugaggagcugaaguccaaaaagcuggcgcucgccccuugcaaccaggcuggaaugggcgugguuggcaaagugggggaaauccaauguagcuccgaggaaagcgccagaacaaucaagaaggacggaugcauuuggaacgcugaucuggucggcaucgagcugcggguggacgaugccguguguuacucuaaaauuacgagcgucgaagcgguugccaauuauuccgcuaucccgaccacaauugggggacucagauucgagcgcucucaugacagccagggcaagaucuccgggucuccccuggauaucagcgccauucggggauccuuuucugugaacuacagaggccuucgccugagccucuccgagaucaccgcuacaugcaccggcgaagugacgaaugucagcgggugcuacucuuguaugaccggagccaaaguguccauuaagcugcacagcucuaaaaacuccacagcccauguuagaugcaagggcgacgagaccgcuuucagcgugcuggaagggguccacuccuauaucgugucucuuagcuuugaucacgcgguuguggacgagcagugucagcucaauugcggaggccaugaaucccaagucacacugaaggggaaccugauuuuccucgacgugccuaaauuuguugauggaagcuacaugcagaccuaucacucuacggugcccacaggcgccaauaucccuucccccaccgacuggcugaacgcucuuuucggcaaugggcugagccgguggauccucggagucauuggcgugcugcuugggggacuugcccucuuuucuaugaucaugagccuguucaagcugggcacaaaacagguguuucgcuccagaaccaagcucgccuga

SEQ ID NO: 14760 - RNA, 3222 nt, Artificial Sequence
  derived and/or modified CDS sequence (opt5) from SFTSV(JS2014-H.longicornis-02)__KR230786.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccuguggaagccuuccuggagcuuaaguccuuuagccagucugaguuccccgacaucugcaaaauugauggaaucgucuuuaaucagugugaaggcgagagccugccucaacccuucgacguggcuuggauggauguggggcacucccauaagaucauuaugcgcgaacacaaaacaaaguggguccaggagucuagcuccaaggacuuuguuugcuauaaagagggaaccggcccguguccugaaagcgaggaaaagacaugcaaaaccucuggguccugcagaggagacaugcaguucuguaagguggccggcugcgagcacggcgaagaggcuagcgaggccaaaugucggugcucucucgugcauaagcccggggaagucgugguuuccuacggaggcaugcgcaucagaccuaaauguuacggguuuagccggaugauggcgacacuggaggugaaccagcccgaacaacgccuuggacagugcaccggcugucaccuggagugcauuaaugggggcgucagacucaucacgcugaccuccgaacugaagucugccacagugugugcuagccauuucugcuccucugccaccagcggaaagaaauccacagagauucaguuccacagcggcucucucguugggaagaccgcuauccacgugaaaggagcccuggucgauggcacggaguuuacauucgaaggguccuguauguuucccgacggaugcgaugcgguggacugcaccuucugucgggaguuucuuaagaacccucaaugcuauccggccaaaaaguggcuguucaucauuaucgucauucuccugggcuacgcugggcuuaugcugcucacaaaugugcugaaggccaucggcauuuggggaagcuggguuaucgcucccgugaaacugauguuugccaucauuaagaaacucaugcgcaccgucucuugucugaugagaaagcugauggaucggggcagacaggugauccaugaagagauuggggaaaaccgcgagggaaaucaggacgauguucggaucgagauggccagaccucgccgggugagacacuggauguauucccccgucauucugaccauccucgcuauuggccuggcggaaagcugcgacgagauggugcaugccgauucuaaacuugugagcugucgccagggguccggaaacaugaaggaaugcguuacaacgggccgggcucugcucccugccgucaaucccgggcaagaggccugucugcacuucaccgcuccgggcagcccugacucuaagugccugaaaaucaaggugaaaagaaucaaccucaaguguaaaaaguccagcuccuacuuugugcccgaugcccgcucucggugcacaagcgucagacgcugucggugggcgggagacugccaguccggcugcccuccccauuucaccucuaauagcuuuuccgacgauugggcugggaagauggacagagccggacugggcuucucuggguguagcgauggaugcggcggggccgcuuguggcugcuuuaacgccgcuccuuccuguauuuucuggcggaaauggguggagaauccccacggaaucauuuggaagguuagcccgugcgccgcgugggugccuucugccgucaucgaacuuacaaugcccuccggcgaggugcgcaccuuccaccccaugagcgggauuccuacgcagguuuuuaaaggagugucugucacauaucugggcuccgacauggaagugagcgggcucaccgaucugugugagaucgaggaacugaagucuaaaaagcucgcucuugccccgugcaaccaggcuggaaugggcguugugggcaaagucggggagauccaauguuccagcgaagaguccgccagaaccauuaagaaggacggaugcaucuggaacgcggaucuggugggcauugaacugcggguggacgaugccgucuguuacagcaaaaucacaucuguugaggcuguggccaauuauagcgcuauucccaccacaaucgggggacucagauucgaacgcucccaugacucucagggcaagaucagcggguccccucuggauauuacggccauccggggaucuuuuagcgugaacuacagaggccuucgccugucccucucugagauuaccgccacaugcaccggcgaggucacaaaugugagcgggugcuacuccuguaugaccggagcuaaaguuagcaucaagcugcacucuuccaaaaacagcacggcgcaugugagaugcaagggcgacgaaaccgccuucucuguccuggagggggugcacuccuauacaguuagccuuuccuuugaucacgcuguggucgacgaacagugucagcucaauugcggaggccaugagucucaagugacccugaaggggaaccugauuuuccucgacguucccaaauuuguggauggaagcuacaugcagacauaucacuccaccgucccuacgggcgccaauauccccagcccuacagacuggcugaacgcccuuuucggcaaugggcugucucgguggauccucggagugauuggcgugcugcuugggggacuugcucucuuuuucaugaucaugucccuguuuaagcugggcaccaaacaggucuuccgcagcagaacaaagcucgccuga

SEQ ID NO: 14761 - RNA, 3222 nt, Artificial Sequence
  derived and/or modified CDS sequence (opt5) from SFTSV(JS2014-H.longicornis-03)__KR230787.1__GP
augaugaaggugaucugguucagcucccugaccugcuuugucauucaguguucuggcgacagcgggcccaucauuugcgccggaccuauccacuccaacaaaucugcugauauuccgcaucuccugggcuacagcgagaagaucugucaaaucgacagacuuauucacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugaucguucccgggccuagcuauaagggaaagguguuuuucgagcgccccacauuugacggcuacgucggguggggauguggcucugggaaauccagaacggaaagcggagagcucugcuccucugauagcggcaccuccagcggccugcugccuucugaccgggugcucuggauuggggauguugccugucagccgaugacacccaucccugaagagaccuuccuggagcuuaaguccuuuagccagucugaguuccccgacauuugcaaaaucgauggaauuguguuuaaucagugugaaggcgaaagccugccucaacccuucgacgucgccuggauggauguggggcacucccauaagaucaucaugcgcgagcacaaaacaaagugggugcaggagucuagcuccaaggacuuugucugcuauaaagaaggaaccggcccguguagcgagucugaagagaagacaugcaaaaccuccgggagcugcagaggagacaugcaguucuguaagguugcuggcugcgaacacggcgaggaggccucugaagcuaaaugucggugcucccucgugcauaagccuggggagguggucgugagcuacggaggcaugcgcauuagacccaaauguuacggguuuucccggaugauggccacgcuggaaguuaaccagccugagcaacgcaucggacagugcaccggcugucaccuugaaugcauuaaugggggcgugagacugaucacacucaccucugagcucaagagcgcgacagucugugccucccauuucugcucuagcgcuaccuccggaaagaaaagcacggagauucaguuccacucuggcucccugguggggaagacagccauccacguuaaaggagcucugguggauggcaccgaauuuacauucgaggggagcuguauguuucccgacggaugcgaugccgucgacugcaccuucugucgggaauuucugaagaacccccaaugcuauccugcgaaaaaguggcuuuucaucauuaucgugauucugcucggcuacgccgggcugaugcuucugaccaauguccucaaggcuaucggcauuuggggaucuugggugaucgccccgguuaaacugauguuugcuaucauuaagaaacugaugcgcacaguguccugucucaugggcaagcugauggauagagggcggcaggucauccaugaggaaauuggagagaacagagagggcaaucaggacgaugugcgcaucgaaauggcccggcccagacgcguucggcacuggauguauagcccugugauucuuacguuccuggccaucgggcucgcugagucuugcgacgaaaugguccaugcggauagcaaacugguguccuguagacagggaagcggcaacaugaaggagugcgugaccacagggcgcgcccuucugcccgcuguuaauccuggccaagaggccugucuccacuuuaccgcccccggaucuccggacuccaagugccugaaaauuaaggucaaacggaucaaccugaaguguaaaaagagcuccucuuacuucgugccugaugcuagaagccgcugcacauccgugcggagaugucgcugggccggcgacugccagucugggugucccccucauuuuaccagcaauuccuucucugacgauugggcgggaaagauggaccgggcuggccucggguuuagcggaugcuccgauggcugcgggggcgccgccuguggaugcuucaacgcugcccccagcuguaucuucuggagaaaaugggucgaaaauccucacggcauuaucuggaaggugucucccugcgcugccuggguuccguccgcggugauugagcugacgaugccuagcggggaaguccggacauuucaccccaugucuggaauccccacccagguguucaaaggcguuuccgugaccuaucuugggagcgacauggaggucucuggacugacagaucucugugaaauugaggagcugaaguccaaaaagcuggcccuugcuccuugcaaccaggccggcaugggcgugguugggaaagugggagaaauccaauguagcuccgaggaaagcgcucgcaccaucaagaaggacggcugcauuuggaacgccgaucucgucgggaucgagcugagaguggacgaugcgguguguuacucuaaaauuacaagcgucgaagccguugcuaauuauuccgccaucccgacgaccauuggaggccugcgguuugagagaucucaugacagccaggggaagaucuccggaucuccccucgauaucacagcuauucgcggcagcuucuccgugaacuaccggggccugagacuuucucugagcgagaucaccgccacaugcaccggggaagugacgaaugucuccggaugcuacagcuguaugaccggcgccaaagugucuauuaagcuccacuccagcaaaaacucuacagcucauguucgcugcaagggggacgagaccgcguuuuccgugcuggaaggaguccacagcuauacagugucccugucuuucgaucacgccguuguggacgagcagugucagcuuaauugcggcgggcaugaaagccaagucacccucaagggaaaccugaucuuucuggacgugccuaaauucguugauggcuccuacaugcagacguaucacagcacagugcccaccggcgcuaauauuccuucucccacagacuggcucaacgcccuguuugggaauggacuuuccagauggauccugggcgucaucggggugcuccugggaggccuggcccuuuucuuuaugauuaugagccucuucaagcuggggaccaaacagguguuucggucucgcaccaagcuggcuuga

SEQ ID NO: 14762 - RNA, 3222 nt, Artificial Sequence
  derived and/or modified CDS sequence (opt5) from SFTSV(JS2014-Hedgehog-02)__KR230789.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuccuggagcuuaaguccuuuagccagucugaguuccccgacaucugcaaaauugauggaaucguguuuaaucagugugaaggcgaaagccugccucaacccuucgacgucgccuggauggauguggggcacucccauaagaucauuaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcaucagacccaaauguuacggguuuucccggaugauggccacccuggaaguuaaccagccugagcaacgcauuggacagugcacgggcugucaccuugaaugcaucaaugggggcgugagacugauuacccucacaucugagcuuaagagcgcgaccgucugugccucccauuucugcucuagcgcuacauccggaaagaaaagcaccgagauccaguuccacucuggcucccugguggggaagacggccauccacguuaaaggagcucucguggauggcacagaauuuaccuucgaggggagcuguauguuucccgacggaugcgaugccgucgacugcacauucugucgggaauuucugaagaacccccaaugcuauccugcgaaaaaguggcuuuucauuaucauugugauccugcucggcuacgccgggcugaugcuucugaccaauguccucaaggcuauuggcaucuggggaucuugggugaucgccccgguuaaacugauguuugcuauuaucaagaaacugaugcgcaccguguccugucucaugggcaagcugauggauagagggcggcaggucauucaugaggaaaucggagagaacagagagggcaaucaggacgaugugcgcauugaaauggcccggcccagacgcguucggcacuggauguauagcccugugauccuuacaauucuggccaucgggcucgcugagucuugcgacgaaaugguccaugcggauagcaaacugguguccuguagacagggaagcggcaacaugaaggagugcgugacgaccgggcgcgcccuucugcccgcuguuaauccuggccaagaggccugucuccacuucacagcccccggaucuccggacuccaagugccugaaaaucaaggucaaacggauuaaccugaaguguaaaaagagcuccucuuacuuugugccugaugcuagaagccgcugcaccuccgugcggagaugucgcugggccggcgacugccagucugggugucccccucauuucacaagcaauuccuuuucugacgauugggcgggaaagauggaccgggcuggccucggguucagcggaugcuccgauggcugcgggggcgccgccuguggaugcuuuaacgcugcccccagcuguaucuucuggagaaaaugggucgaaaauccucacggcauuaucuggaaggugucucccugcgcugccuggguuccguccgcggugauugagcugaccaugccuagcggggaaguccggacguuccaccccaugucuggaauccccacacagguguuuaaaggcguuuccgugaccuaucuugggagcgacauggaggucucuggacugaccgaucucugugaaaucgaggagcugaaguccaaaaagcuggcccuugcuccuugcaaccaggccggcaugggcgugguugggaaagugggagaaauucaauguagcuccgaggaaagcgcucgcacaaucaagaaggacggcugcauuuggaacgccgaucucgucgggaucgagcugagaguggacgaugcgguguguuacucuaaaauuaccagcgucgaagccguugcuaauuauuccgccaucccgacaacgaucggaggccugcgguucgagagaucucaugacagccaggggaagauuuccggaucuccccucgauaucaccgcuauucgcggcagcuuuuccgugaacuaccggggccugagacuuucucugagcgagaucacagcuaccugcacaggggaagugaccaaugucuccggaugcuacagcuguaugacgggcgccaaagugucuauuaagcuccacuccagcaaaaacucuaccgcccauguucgcugcaagggggacgagacagcguucuccgugcuggaaggaguccacagcuauaccgugucccugucuuuugaucacgccguuguggacgagcagugucagcuuaauugcggcgggcaugaaagccaagucacacucaagggaaaccugaucuuccuggacgugccuaaauuuguugauggcuccuacaugcagaccuaucacagcacggugcccacaggcgcuaauaucccuucucccaccgacuggcucaacgcccuguucgggaauggacuuuccagauggauucugggcgucaucggggugcuccugggaggccuggcccuguuuuucaugauuaugagccucuuuaagcuggggacaaaacagguguuccggucucgcaccaagcuggcuuga

SEQ ID NO: 14763 - RNA, 3222 nt, Artificial Sequence
  derived and/or modified CDS sequence (opt5) from SFTSV(KACNH)__KU507558.1__GP
augaugaaggugaucugguucagcucccugauuugccucgucauccaguguucuggcgacagcgggcccauuaucugcgccggaccuauucacuccaacaaaucugcuagcaucccgcaucugcuuggcuacuccgagaagaucugucaaauugauagacugauccacguuucuagcuggcuccggaaucauucccaguuucagggguaugugggacagcgcggcgggagaagccaagugucuuacuaucccgccgaaaacuccuacagccgguggucuggacugcuuuccccuugcgacgcggauuggcugggcaugcucgucgugaaaaaggcuaaaggcagcgacaugauuguucccgggccuucuuauaagggaaagguguucuuugagcgccccaccuucgauggcuacgucggguggggauguggcuccgggaaaagcagaacagaauccggagagcugugcucuagcgacuccggcacgagcucuggccugcucccuuccgaucgggugcuguggaucggggacguugccugucagccgaugacccccauuccugaagagacauuucuugagcuuaagagcuucucucagagcgaauuucccgauaucugcaaaauugacggaaucguguucaaucagugugagggcgaaucccucccucaacccuuugaugucgccuggauggacguggggcacucucauaagaucauuaugcgcgagcacaaaaccaagugggugcaggagagcuccagcaaggauuucgucugcuauaaagaaggaacaggcccguguucugaguccgaagagaaggcuugcaaaaccagcgggucuugcagaggagacaugcaguuuuguaagguugccggcugcgaacacggcgaggaggcuuccgacgccaaaugucggugcagccuggugcauaagccuggggaaguggucguguccuacggaggcaugcgcguuagacccaaauguuacggguucucucggaugauggcgacacuugaggugaacccucccgaacagcgcaucggacaaugcaccggcugucaccuggagugcauuaaugggggcgucagacucaucacgcugaccagcgaacugaaguccgccacagugugugcuucucauuuuugcagcuccgccaccagcggaaagaaaucuacagagauucaguuccacuccggcagccucguugggaagaccgcuauccacgugaaaggagcccuggucgauggcacggaguucacauuugaagggucuuguauguuccccgacggaugcgaugcgguggacugcaccuuuugucgggaguuccuuaagaacccucagugcuauccggccaaaaaguggcuguuuauccucauugucauccugcuuggcuacgcugggcugaugcucauuacaaaugugcugaaggccaucggcguuuggggauccugggugauugcucccgucaaacugauguucgccaucaucaagaaacucaugcgcaccgugagcugucugaugggcaagcugauggauagagggcggcaaguuauucaugaagagaucggagaaaacggcgaggggaaucaggacgaugugagaauugagauggcccgcccucggagaguccgccacuggauguauucucccgugauccugaccauucucgcuaucggacuggcggaaggcugcgacgagauggugcaugccgauagcaaacuuguuuccugucggcaggggagcggcaacaugaaggaaugcgucacaacgggcagagcucugcucccugccgugaaucccggacaggaggccugucugcacuuuaccgcuccggggucuccugacuccaagugccugaaaauuaaggugaaacgcaucaaccucaaguguaaaaagagcuccucuuacuucguccccgaugcccggagcagaugcacauccgugcgccgguguagaugggcgggagacugccaaucuggcugcccuccccauuuuaccagcaauuccuucucugacgauugggcugggaagauggaccgcgccggacugggcuuuagcggguguuccgauggcugcggaggcgccgcuugugggugcuucaacgccgcuccuagcuguaucuuuuggcggaaauggguugagaauccccacggaauuaucuggaaggugucuccgugcgccgcgugggucccuuccgccgugauugaacuuacaaugcccagcggcgagguuagaaccuuccaccccaugucugggaucccuacacagguguucaaaggagucuccgugacguaucugggcagcgacauggaaguuucuggccucaccgaucugugugagauugaggaacugaaguccaaaaagcuggcucucgccccgugcaaccaggcugggaugggaguggucggcaaagugggggagauccaguguagcuccgaagagagcgcccggaccaucaagaaggacggaugcauuuggaacgcggaucuggugggcaucgaacugcgcgucgacgaugccguuuguuacucuaaaauuacaagcguggaggcuguggccaauuauuccgcuauccccaccacaauugggggacucagauuugaacggucucaugacagccaaggcaagaucuccggcucuccucuggauaucacggccauuagagggagcuucuccgucaacuaccgcggacuucggcugucucucagcgagaucaccgccacaugcaccggcgaggugacaaauguuuccgggugcuacagcuguaugaccggagcuaaagugucuauuaagcugcacuccagcaaaaacucuacggcgcaugucagaugcaagggcgacgaaaccgccuuuuccgugcuggaggggguucacagcuauacagugucccuuucuuucgaucacgcugucguggacgaacagugucagcucaauugcggaggccaugagagccagguuacccugaagggcaaccugaucuuucucgacgugcccaaauucgucgauggguccuacaugcaaacauaucacagcaccgugccuacgggagccaauauucccucuccuacagacuggcugaacgcccuuuuuggcaaugggcugucccgcuggauccucggagugaucggcguccugcuugggggacuugcucucuucuuucugauuaugagccuguucaagcucggcaccaaacagguuuuuagaucucggacaaagcuggccuga

SEQ ID NO: 14764 - RNA, 3222 nt, Artificial Sequence
  derived and/or modified CDS sequence (opt5) from SFTSV(KACNH2)__KU507559.1__GP
augaugaaggugaucugguucagcucccugauuugccucgucauccaguguucuggcgacaccgggcccauuaucugcgccggaccuauucacagcaacaaauccgcuaauaucccgcaucugcuuggcuacucugagaagaucugucaaauugauagacugauccacguuagcuccuggcuccggaaccauucucaguuucagggguaugugggacagcgcggcgggagaagccaaguguccuacuaucccgccgaaaauagcuacucucggugguccggacugcuuagcccuugcgacgcggauuggcugggcaugcucgucgugaaaaaggcuaaaggcucugacaugauuguucccgggccuuccuauaagggaaagguguucuuugagcgccccacauucgauggcuacgucggguggggauguggcagcgggaaaucuagaacggaauccggagagcugugcagcuccgacucuggcaccagcuccggccugcucccuagcaaccgggugcuguggaucggggauguugccugucagccgaugacacccauuccugaagagaccuuucuugagcugaagucuuucucccagagcgaauuucccgacaucugcaaaauugauggaaucguguucaaucagugugagucugaaagccucccucaacccuuugacgucgccuggauggaugugggccacucccauaagaucauuaugcgcgagcacaaaacaaagugggugcaggagucuagcuccaaggacuucgucugcuauaaagaagggaccggaccguguagcgagucugaagagagaacaugcaagaccuccggcagcugccgcggggauaugcaguuuuguaaaguugcuggaugcgaacacggcgaggaggccucugaagcuaagugucggugcucccuggugcauaaaccuggcgagguggucgugagcuacgggggaaugagaguucggcccaaguguuacggcuucucccgcaugauggccacgcuugaagugaacccucccgagcagagaaucgggcaaugcaccggaugucacauugaaugcaucaauggcgggguccggcugauuacacucaccucugagcugaaaagcgcgacagugugugccucccauuuuugcucuagcgcuaccuccggcaaaaagagcacggagauccaguuccacucuggaucccugguuggcaaggccgcuauccacgugaagggggcccucgucgacggaacagaauuuaccuuugagggcagcuguauguuccccgacgggugcgaugcgguggacugcacauuuugucgcgaguuccugaaaaacccucagugcuauccggccaagaaauggcuuuuuauuaucauugucauccugcucggauacgcuggccugaugcuucugaccaaugugcucaaggccauugggguuuggggcucuugggugaucgcucccgucaagcugauguucgccaucauuaaaaagcugaugagauccgugagcugucucaugggaaaacugauggaucggggcagacaaguuauccaugaagaaauuggggagaaccgcgagggaaaucaggacgaugugcggaucgaaauggccagaccucgccgggucagacacuggauguauucucccgugauucuuaccauccuggcuauuggccucgcggaggggugcgacgaaauggugcaugccgauagcaagcugguuuccugucgccagggaggcgggaacaugaaagagugcgucacaacgggccgggcccuucugccugcugugaaucccggacaggaggccugucuccacuuuaccgcuccgggcagcccugacucuaagugccugaagaucaaagugaagagaaucaaccugaaauguaagaaauccagcuccuacuucguccccgaugcccgcucucggugcacaagcgugagacgcugucggugggcgggggacugccaauccggaugcccuucucauuuuaccagcaauuccuucucugaugacugggcuggcaagauggacagagccgggcucggauuuagcggcuguuccgaugggugcggcggagccgcuuguggcugcuucaacgccgcucccagcuguauuuucuggcggaaguggguugaaaacccucacgggaucauuuggaaagugucucccugcgccgcgugggucccguccgccgugaucgagcugacaaugccuagcggagaaguucgcaccuuccaccccaugucuggcauucccacacagguguucaagggggucuccgugacguaucuuggaagcgacauggagguuucuggccugaccgaucucugugaaaucgaggagcugaaauccaagaaacuggcucuugccccuugcaaucaggcuggcauggggguggucggaaaggugggcgaaauccaguguagcuccgaggaaagcgccagaaccauuaaaaaggacgggugcaucuggaacgcggaucucgugggaauugagcugcgggucgacgaugccguuuguuacucuaagaucacaagcguggaagcuguggccaauuauuccgcuauuccgaccacaaucggcgggcugagauuugagcgcucucaugacagccaaggaaaaaucuccggcucuccccucgauauuacggccauccggggcagcuucuccgucaacuacagagggcugcgccuuucucugagcgagauuaccgccacaugcaccggagaagugacaaauguuuccggcugcuacagcuguaugaccggggcuaaggugucuaucaaacuccacuccagcaagaacucuacggcgcaugucagaugcaaaggagacgagaccgccuuuuccgugcuggaaggcauucacagcuauacaguuucccugucuuucgaucacgcuguggucgacgagcagugucagcuuaauugcgggggacaugaaagccaggugacccucaagggcaaccugaucuuucuggauguuccuaaguucguggacggcuccuacaugcaaacauaucacagcucuguccccaccggggccaauaucccuucccccacggacuggcucaacgcccuguuuggaaauggccuuagccgguggauucugggggugaucggagugcuccugggcgggcuggcucuuuucuuucucauuaugucucuguucaaacugggaacaaagcaggucuuucgcagcagaaccaaacucgccuga

SEQ ID NO: 14765 - RNA, 3222 nt, Artificial Sequence
  derived and/or modified CDS sequence (opt5) from SFTSV(KACNH3)__KP663744.1__GP
augaugaaggugaucugguucagcucccugauuugccucgucauccaguguucuggcgacaccgggcccauuaucugcgccggaccuauucacagcaacaaauccgcuaauaucccgcaucugcuuggcuacucugagaagaucugucaaauugauagacugauccacguuagcuccuggcuccggaaccauucucaguuucagggguaugugggacagcgcggcgggagaagccaaguguccuacuaucccgccgaaaauagcuacucucggugguccggacugcuuagcccuugcgacgcggauuggcugggcaugcucgucgugaaaaaggcuaaaggcucugacaugauuguucccgggccuuccuauaagggaaagguguucuuugagcgccccacauucgauggcuacgucggguggggauguggcagcgggaaaucuagaacggaauccggagagcugugcagcuccgacucuggcaccagcuccggccugcucccuagcgaucgggugcuguggaucggggacguugccugucagccgaugacacccauuccugaagagaccuuucuugagcugaagucuuucucccagagcgaauuucccgauaucugcaaaauugacggaaucguguucaaccagugugagucugaaagccucccucaacccuuugaugucgccuggauggacgugggccacucccauaagaucauuaugcgcgagcacaaaacaaagugggugcaggagucuagcuccaaggauuucgucugcuauaaagaagggaccggaccguguagcgagucugaagagaagacaugcaaaaccuccggcagcugcagaggggacaugcaguuuuguaagguugcuggaugcgaacacggcgaggaggccucuggcgcuaaaugucggugcucccuggugcauaagccuggggaaguggucgugagcuacggaggcaugcgcguuagacccaaauguuacggguucucccggaugauggccacgcuugaggugaauccucccgaacagcgcaucggacaaugcaccggcugucaccuggagugcauuaacgggggcgucagacucaucacacugaccucugaacuuaagagcgcgacagugugugccucccauuuuugcucuagcgcuaccuccggaaagaaaagcacggagauucaguuccacucuggcucccucguugggaagacagccauccacgugaaaggagcucuggucgacggcaccgaguucacauuugaagggagcuguauguuccccgauggaugcgacgccguggauugcaccuuuugucgggaguuccuuaagaauccucagugcuauccggcgaaaaaguggcuguuuaucauuaucgucauucuccugggcuacgccgggcuuaugcugcucaccaacgugcugaaggcuaucggcguuuggggaucuugggugauugcccccgucaaacugauguucgcuaucaucaagaaacucaugcgcuccgugagcugucugaugggcaagcugauggacagagggcggcaaguuauucaugaagagaucggagaaaauagagagggcaaccaggaugacgugcgcauugagauggcccggccuagacgcguccggcacuggauguauucucccgugauccugacaauucucgccaucgggcuggcugaaggaugcgaugagauggugcaugcggacagcaaacuuguuuccuguaagcagggcagcgggaauaugaaggaaugcgucacgaccggcagagcccugcucccugcugugaaccccggacaggaggccugucugcacuuuacagccccgggcucuccugauuccaaaugccugaagauuaaagugaagcgcaucaaucucaaauguaagaaguccuccucuuacuucguccccgacgcucggagcagaugcaccuccgugcgccgguguagaugggccggggauugccaaucuggaugcccuagccauuuuacauccaacucuuucagcgacgacugggcgggcaaaauggaucgcgcugggcugggauuuuccggcuguagcgacgggugcggcggagccgccuguggcugcuucaaugcugcccccucuuguaucuuuuggcggaaguggguugagaacccucacgggauuaucuggaaagugucccccugcgcugccugggucccgagcgcggugauugaacuuaccaugccuucuggagagguuagaacguuccaccccauguccggcauccccacacagguguucaagggggucagcgugaccuaucugggaucugauauggaaguuuccggccucaccgaccugugugagauugaggaacugaaaagcaagaaacuugcccucgcuccuugcaaccaggccggcauggggguggucggaaaggugggcgagauccaguguuccagcgaagagucugcucggacaaucaagaaagaugggugcauuuggaaugccgaccuggugggaaucgaacugcgcgucgaugacgcgguuuguuacagcaagauuaccuccguggaggccguggcuaacuauucugccaucccgacaacgauuggcgggcucagauuugaacggagccaugauucccaaggaaaaaucucuggcagcccccuggacaucaccgcuauuagaggcuccuucucugucaauuaccgcgggcuucggcugagccucuccgaggugacagcuaccugcacaggagagguuaccaacgugagcggcugcuacucuuguaugacgggggccaaggucuccaucaaacugcacagcucuaagaauagcaccgcccaugugagaugcaagggagaugaaacagcguuuagcguucuggagggcgugcacuccuauaccgucucucuuagcuucgaccacgccgugguugaugaacagugucagcucaacugcgggggacaugagucccaggugacacugaaaggcaaucugauuuuucucgacgucccuaaguucguggacggcagcuacaugcaaaccuaucacucuuccgugcccacgggggcuaacaucccuagccccacagauuggcugaaugcccuuuuuggaaacggccugucucgcuggauucucggggucaucggaguucugcugggcgggcuugcccucuucuuucugaucaugagccuguucaaacucggaaccaaacagguguuuagaucccggacaaagcuggcuuga

SEQ ID NO: 14766 - RNA, 3222 nt, Artificial Sequence
  derived and/or modified CDS sequence (opt5) from SFTSV(KADGH)__KU507548.1__GP
augaugaaggugaucugguucagcucccugauuugccucgucauccaguguucuggcgacaccgggcccauuaucugcgccggaccuauucacagcaacaaauccgcuaauaucccgcaucugcuuggcuacucugagaagaucugucaaauugauagacugauccacguuagcuccuggcuccggaaccauucucaguuucagggguaugugggacagcgcggcgggagaagccaaguguccuacuaucccgccgaaaauagcuacucucggugguccggacugcuuagcccuugcgacgcggauuggcugggcaugcucgucgugaaaaaggcuaaaggcucugacaugauuguucccgggccuuccuauaagggaaagguguucuuugagcgccccacauucgauggcuacgucggguggggauguggcagcgggaaaucuagaacggaauccggagagcugugcagcuccgacucuggcaccagcuccggccugcucccuagcgaucgggugcuguggaucggggacguugccugucagccgaugacacccauuccugaagagaccuuucuugagcugaagucuuucucccagagcgaauuucccgauaucugcaaaauugacggaaucguguucaaccagugugagucugaaagccucgcccaaccuuuugaugucgcuuggauggacgugggccacucccauaagaucauuaugcgcgagcacaaaacaaagugggugcaggagucuagcuccaaggauuucgucugcuauaaagaagggaccggacccuguagcgagucugaagagaagacaugcaaaaccuccggcagcugcagaggggacaugcaguuuuguaagguugccggaugcgaacacggcgaggagacgucuguggcuaaaugucggugcucccuggugcauaagccgggcgaagucgugguuagcuacgggggaaugcgcgugagaccuaaauguuacggcuucucccggaugauggccacccuugaggucaaucccccugaacagcgcaucgggcaaugcacaggaugucaccuggagugcauuucuggcggggugagacucaucacccugacaagcgaacugaaguccgcgaccguuugugccucucauuuuugcagcuccgcuacgagcggcaagaaaucuacagagauucaguuccacuccggaagccucgugggcaaggccgcuauccacgucaaaggggugcuggucgacggaaccgaguucacauuugaaggcucuuguauguuccccgaugggugcgacgccguggauugcaccuuuugucgggaguuccuuaagaacccccagugcuauccugcgaaaaaguggcuguuuaucauuaucguuauucuccugggauacgccggccuuaugcugcucaccaaugugcugaaggcuaucggggucuggggcuccugggugauugccccgguuaaacugauguucgcuaucaucaagaaacucaugcgcagcgugucuugucugaugggaaagcugauggacagaggccggcaagucauucaugaagagaucggggaaaacagagagggaaaucaggaugacgugcgcauugagauggcccggcccagacgcgugcggcacuggauguauagcccuguuauccugacaauucucgccaucggccuggcugaagggugcgaugagaugguccaugcggacuccaaacuugugagcuguagacagggaucuggcaacaugaaggaaugcgugacgaccgggcgcgcccugcuccccgcugucaauccuggccaggaggccugucugcacuuuacagcccccggauccccggauagcaagugccugaaaauuaaggugaaacggaucaaccucaaguguaaaaaguccucuagcuacuucguuccugacgcuagaucccgcugcaccucugugcggagaugucgcugggccggcgauugccaaagcgggugccccucccauuuuacaucuaauagcuucuccgacgacugggcgggaaagauggaucgggcuggccugggguuuagcggauguucugacggcugcgggggcgccgccuguggaugcuucaacgcugccccuuccuguaucuuuuggagaaaaugggucgagaauccccacggcauuaucuggaaggugagcccuugcgcugccuggguucccucugcggugauugaacuuaccaugccguccggggagguccggacguuccacccuaugagcggaauccccacacagguguucaaaggcguuucugugaccuaucugggguccgauauggaagucagcggacucaccgaccugugugagauugaggaacugaaguccaaaaagcucgcccuugcucccugcaaccaggccggcaugggcgugguggggaaagucggagagauccaguguagcucugaagagagcgcucgcacaaucaagaaggauggcugcauuuggaacgccgaccugguugggaucgaacugagaguggaugacgcgguguguuacuccaaaauuaccucugucgaggccguggcuaauuauagcgccaucccuacaacgauuggaggccuccgguuugaaagaucccaugauucucaagggaagaucagcggauccccgcuggacaucaccgcuauucgcggcucuuucagcguuaacuaccggggccuuagacugucccucagcgagaucacagcuaccugcacaggggaggugaccaaugucucuggaugcuacuccuguaugacgggcgccaaagugagcauucgccugcacucuuccaagaacagcaccgcccauguuagaugcaaagaagaugagacagcguuuuccgugcuggaagggguccacucuuauaccgugagccuuuccuucgaccacgccguuguggaugagcagugucagcucaauugcggaggccaugaaagccaggucacacugaaggggaaccugaucuuucucgacgugcccaaguucguggacggaucuuacaugcaaaccuaucacuccagcgucccuacgggcgcuaauauucccucuccuacagauuggcugaacgcccuuuuuggcaaugggcugagccgguggauccucggaguuaucggcgugcugcuugggggacuugcccucuucuuucugauuaugucccuguucaaacucggcaccaaacagguguuucgcucuagaacaaagcuggcuuga

SEQ ID NO: 14767 - RNA, 3222 nt, Artificial Sequence
  derived and/or modified CDS sequence (opt5) from SFTSV(KAGBH)__KU507560.1__GP
augaugaaggugaucugguucagcucccugauuugccucgucauccaguguucuggcgacaccgggcccauuaucugcgccggaccuauucacagcaacaaauccgcuaauaucccgcaucugcuuggcuacucugagaagaucugucaaauugauagacugauccacguuagcuccuggcuccggaaccauucucaguuucagggguaugugggacagcgcggcgggagaagccaaguguccuacuuccccgccgaaaauagcuauucucggugguccggacugcuuagcccuugcgacgcggauuggcugggcaugcucgucgugaaaaaggcuaaaggcucugacaugauuguucccgggccuuccuacaagggaaagguguuuuucgagcgccccacauuugauggcuaugucggguggggauguggcagcgggaaaucuagaacggaauccggagagcugugcagcuccgacucuggcaccagcuccggccugcucccuagcgaucgggugcuguggaucggggacguugccugucagccgaugacacccauuccugaagagaccuuccuugagcugaagucuuuuucccagagcgaguuccccgauaucugcaaaauugacggaaucguguuuaaccagugugaaucugaaagccucccucaacccuucgaugucgccuggauggacgugggccacucccauaagaucauuaugcgcgagcacaaaacaaagugggugcaggagucuagcuccaaggauuuugucugcuacaaagaagggaccggaccguguagcgagucugaagagaagacaugcaaaaccuccggcagcugcagaggggacaugcaguucuguaagguugcuggaugcgaacacggcgaggaggccucugaagcuaaaugucggugcucccuggugcauaagccuggcgagguggucgugagcuaugggggaaugcgcguuagacccaaauguuacggcuuuucccggaugauggccacgcuugaagugaauccucccgagcagcgcaucgggcaaugcaccggaugucaccuggaaugcauuaacggcggggucagacucaucacacugaccucugagcuuaagagcgcgacagugugugccucccauuucugcucuagcgcuaccuccggcaagaaaagcacggagauucaguuccacucuggaucccucguuggcaagacagccauccacgugaaaggggcucuggucgacggaaccgaauuuacauucgagggcagcuguauguuucccgaugggugcgacgccguggauugcaccuucugucgggaauuucuuaagaauccucagugcuacccggcgaaaaaguggcuguucaucauuaucgucauucuccugggauaugccggccuuaugcugcucaccaacgugcugaaggcuaucgggguuuggggcucuugggugauugcccccgucaaacugauguuugcuaucaucaagaaacucauucgcuccgugagcugucugaugggaaagcugauggacagaggccggcaaguuauccaugaggaaauuggggagaauagagagggaaaccaggaugacgugcgcaucgaaauggcccggccuagacgcguccggcacuggauguacucucccgugauucugacaauccucgccauuggccuggcugaggggugcgaugaaauggugcaugcggacagcaaacuuguuuccuguaagcagggaagcggcaauaugaaggagugcgucacgaccgggagagcccugcucccugcugugaaccccggccaggaggccugucugcacuucacagccccgggaucuccugauuccaaaugccugaagaucaaagugaagcgcaucaaucucaaauguaagaaguccuccucuuauuuuguccccgacgcucggagcagaugcaccuccgugcgccgguguagaugggccggcgauugccaaucugggugcccuagccauuucacauccaacucuuuuagcgacgacugggcgggaaaaauggaucgcgcuggccugggguucuccggauguagcgacggcugcgggggcgccgccuguggaugcuuuaaugcugcccccucuuguauuuucuggcggaaguggguugaaaacccucacggcaucauuuggaaagugucccccugcgcugccugggucccgagcgcggugaucgagcuuaccaugccuucuggggaaguuagaacguuccaccccauguccggcauucccacacagguguuuaagggagucagcgugaccuaccuggggucugauauggagguuuccggacucaccgaccugugugaaaucgaggagcugaaaagcaagaaacuugcccucgcuccuugcaaccaggccggcaugggcguggucgggaaggugggagaaauccaguguuccagcgaggaaucugcucggacaauuaagaaagauggcugcaucuggaaugccgaccugguggggauugagcugcgcgucgaugacgcgguuuguuauagcaagaucaccuccguggaagccguggcuaacuacucugccauuccgacaacgaucggaggccucagauucgagcggagccaugauucccaagggaaaaucucuggaagcccccuggacauuaccgcuaucagaggcuccuuuucugucaauuaucgcggccuucggcugagccucuccgagauuacagcuaccugcacaggggaagugaccaacguuagcggaugcuacucuuguaugacgggcgccaagguguccaucaaacugcacagcucuaagaauagcaccgcccaugucagaugcaagggggaugagacagcguucagcgugcuggaaggaguucacuccuacaccgugucucuuagcuuugaccacgccgucguggaugagcagugucagcucaacugcggcgggcaugaaucccagguuacacugaaaggaaaucugauuuuccucgacgugccuaaguuugucgacggcagcuauaugcaaaccuaccacucuuccgugcccacgggcgcuaacaucccuagccccacagauuggcugaaugcccuuuucgggaacggacugucucgcuggauccucggcgugauugggguccugcugggaggccuugcccucuuuuuccugaucaugagccuguuuaaacucgggaccaagcagguuuucagaucccggacaaaacuggcuuga

SEQ ID NO: 14768 - RNA, 3222 nt, Artificial Sequence
  derived and/or modified CDS sequence (opt5) from SFTSV(KAGBH3)__KU507561.1__GP
augaugaaggugaucugguucagcucccugauuugccucgucauccaguguucuggcgacaccgggcccauuaucugcgccggaccuauucacagcaacaaauccgcuaauaucccgcaucugcuuggcuacucugagaagaucugucaaauugauagacugauccacguuagcuccuggcuccggaaccauucucaguuucagggguaugugggacagcgcggcgggagaagccaaguguccuacuuccccgccgaaaauagcuauucucggugguccggacugcuuagcccuugcgacgcggauuggcugggcaugcucgucgugaaaaaggcuaaaggcucugacaugauuguucccgggccuuccuacaagggaaagguguuuuucgagcgccccacauuugauggcuaugucggguggggauguggcagcgggaaaucuagaacggaauccggagagcugugcagcuccgacucuggcaccagcuccggccugcucccuagcaaccgggugcuguggaucggggauguugccugucagccgaugacacccauuccugaagagaccuuccuugagcugaagucuuuuucccagagcgaguuccccgacaucugcaaaauugauggaaucguguuuaaucagugugaaucugaaagccucccucaacccuucgacgucgccuggauggaugugggccacucccauaagaucauuaugcgcgagcacaaaacaaagugggugcaggagucuagcuccaaggacuuugucugcuacaaagaagggaccggaccguguagcgagucugaagagaagacaugcaaaaccuccggcagcugcagaggggauaugcaguucuguaagguugcuggaugcgaacacggcgaggagacgucugaagccaaaugucggugcucccuggugcauaagccuggcgagguggucgugagcuaugggggaaugcgcguuagacccaaauguuacggcuuuucccggaugauggcuacccuugaagugaacccucccgagcagcgcaucgggcaaugcacaggaugucaccuggaaugcauuaauggcggggucagaaucauuacccucacaucugagcucaagagcgccaccgugugugcgucccauuucugcucuagcgccacguccggcaagaaaagcacagagauccaguuccacucuggaucccugguuggcaagaccgcuauccacgugaaaggggcccuggucgacggaacagaauuuaccuucgagggcagcuguauguuucccgacgggugcgaugcuguggacugcaccuucugucgggaauuucugaagaacccucagugcuacccggccaaaaaguggcuuuucauuaucauugucauccugcucggauaugcgggccugaugcuucugacaaaugugcucaaggccauugggguuuggggcucuugggugaucgcucccgucaaacugauguuugccaucauuaagaaacugaugcgcuccgugagcugucucaugggaaagcugauggauagaggccggcaaguuauccaugaggaaauuggggagaacagagagggaaaucaggacgaugugcgcaucgaaauggcucggccuagacgcguccggcacuggauguacucucccgugauucuuacgauccuggccauuggccucgccgaggggugcgacgaaauggugcaugcugauagcaaacugguucuuuguaagcagggauccggcaacaugaaggagugcgucaccacagggagagcgcugcucccugccgugaaucccggccaggaggcuugucugcacuucaccgccccgggaagcccugacucuaaaugccugaagaucaaagugaagcgcaucaaccucaaauguaagaaguccagcuccuauuuuguccccgaugcccggucuagaugcacaagcgugcgccgguguagaugggcuggcgacugccaauccgggugcccuucucauuucaccagcaauuccuuuucugaugacugggccggaaaaauggaccgcgcgggccugggguucagcggauguuccgauggcugcgggggcgcugccuguggaugcuuuaacgccgcucccagcuguauuuucuggcggaaguggguugaaaacccucacggcaucauuuggaaagugucucccugcgccgcuugggucccguccgccgugaucgagcuuacgaugccuagcggggaaguuagaacauuccaccccaugucuggcauucccacccagguguuuaagggagucuccgugaccuaccuggggagcgacauggagguuucuggacucacagaucugugugaaaucgaggagcugaaauccaagaaacuugcgcucgccccuugcaaucaggcuggcaugggcguggucgggaaggugggagaaauccaguguagcuccgaggaaagcgcccggaccauuaagaaagacggcugcaucuggaacgcugaucugguggggauugagcugcgcgucgacgaugccguuuguuauucuaagaucacaagcguggaagcgguggccaauuacuccgcuauuccgacgaccaucggaggccucagauucgagcggucucaugacagccaagggaaaaucuccggaucuccccuggauauuacagccaucagaggcagcuuuuccgucaacuaucgcggccuucggcugucucucagcgagauuaccgcuacaugcaccggggaagugacgaauguuuccggaugcuacagcuguaugaccggcgccaaggugucuaucaaacugcacuccagcaagaacucuacagcccaugucagaugcaagggggacgagaccgcuuucuccgugcuggaaggaguucacagcuacgcggugucccuuucuuuugaucacgccgucguggacgagcagugucagcucaauugcggcgggcaugaaagccagguuacacugaaaggaaaccugauuuuccucgaugugccuaaguuugucgacggcuccuauaugcaaaccuaccacagcucugugcccacgggcgcuaauaucccuucccccacagacuggcugaacgcccuuuucgggaauggacugagccgcuggauccucggcgugauugggguccugcugggaggccuugcccucuuuuuccugaucaugucucuguuuaaacucgggaccaagcagguuuucagaagccggacaaaacuggcuuga

SEQ ID NO: 14769 - RNA, 3222 nt, Artificial Sequence
  derived and/or modified CDS sequence (opt5) from SFTSV(KAGBH4)__KU507562.1__GP
augaugaaggugaucugguucagcucccugauuugccucgucauccaguguucuggcgacaccgggcccauuaucugcgccggaccuauucacagcaacaaauccgcuaauaucccgcaucugcuuggcuacucugagaagaucugucaaauugauagacugauccacguuagcuccuggcuccggaaccauucucaguuucagggguaugugggacagcgcggcgggagaagccaaguguccuacuuccccgccgaaaauagcuauucucggugguccggacugcuuagcccuugcgacgcggauuggcugggcaugcucgucgugaaaaaggcuaaaggcucugacaugauuguucccgggccuuccuacaagggaaagguguuuuucgagcgccccacauuugauggcuaugucggguggggauguggcagcgggaaaucuagaacggaauccggagagcugugcagcuccgacucuggcaccagcuccggccugcucccuagcgaucgggugcuguggaucggggacguugccugucagccgaugacacccauuccugaagagaccuuccuugagcugaagucuuuuucccagagcgaguuccccgauaucugcaaaauugacggaaucguguuuaaccagugugaaucugaaagccucccucaacccuucgaugucgccuggauggacgugggccacucccauaagaucauuaugcgcgagcacaaaacaaagugggugcaggagucuagcuccaaggauuuugucugcuacaaagaagggaccggaccguguagcgagucugaagagaagacaugcaaaaccuccggcagcugcagaggggacaugcaguucuguaagguugcuggaugcgaacacggcgaggaggccucugaagcuaaaugucggugcucccuggugcauaagccuggcgagguggucgugagcuaugggggaaugcgcguuagacccaaauguuacggcuuuucccggaugauggccacgcuugaagugaauccucccgagcagcgcaucgggcaaugcaccggaugucaccuggaaugcauuaacggcggggucagacucaucacacugaccucugagcuuaagagcgcgacagugugugccucccauuucugcucuagcgcuaccuccggcaagaaaagcacggagauucaguuccacucuggaucccucguuggcaagacagccauccacgugaaaggggcucuggucgacggaaccgaauuuacauucgagggcagcuguauguuucccgaugggugcgacgccguggauugcaccuucugucgggaauuucuuaagaauccucagugcuacccggcgaaaaaguggcuguucaucauuaucgucauucuccugggauaugccggccuuaugcugcucaccaacgugcugaaggcuaucgggguuuggggcucuugggugauugcccccgucaaacugauguuugcuaucaucaagaaacucaugcgcuccgugagcugucugaugggaaagcugauggacagaggccggcaaguuauucaugaggaaaucggggagaauagagagggaaaccaggaugacgugcgcauugaaauggcccggccuagacgcguccggcacuggauguacucucccgugauccugacaauucucgccaucggccuggcugaggggugcgaugaaauggugcaugcggacagcaaacuuguuuccuguaagcagggaagcggcaauaugaaggagugcgucacgaccgggagagcccugcucccugcugugaaccccggccaggaggccugucugcacuucacagccccgggaucuccugauuccaaaugccugaagauuaaagugaagcgcaucaaucucaaauguaagaaguccuccucuuauuuuguccccgacgcucggagcagaugcaccuccgugcgccgguguagaugggccggcgauugccaaucugggugcccuagccauuucacauccaacucuuuuagcgacgacugggcgggaaaaauggaucgcgcuggccugggguucuccggauguagcgacggcugcgggggcgccgccuguggaugcuuuaaugcugcccccucuuguaucuucuggcggaaguggguugaaaacccucacggcauuaucuggaaagugucccccugcgcugccugggucccgagcgcggugauugagcuuaccaugccuucuggggaaguuagaacguuccaccccauguccggaauccccacacagguguuuaagggcgucagcgugaccuaccuggggucugauauggagguuuccggacucaccgaccugugugaaauugaggagcugaaaagcaagaaacuugcccucgcuccuugcaaccaggccggcaugggcguggucgggaaggugggagaaauccaguguuccagcgaggaaucugcucggacaaucaagaaagauggcugcauuuggaaugccgaccugguggggaucgagcugcgcgucgaugacgcgguuuguuauagcaagauuaccuccguggaagccguggcuaacuacucugccaucccgacaacgauuggaggccucagauucgagcggagccaugauucccaagggaaaaucucuggaagcccccuggacaucaccgcuauuagaggcuccuuuucugucaauuaucgcggccuucggcugagccucuccgagaucacagcuaccugcacaggggaagugaccaacguuagcggaugcuacucuuguaugacgggcgccaagguguccauuaaacugcacagcucuaagaauagcaccgcccaugucagaugcaagggggaugagacagcguucagcgugcuggaaggaguucacuccuacaccgugucucuuagcuuugaccacgccgucguggaugagcagugucagcucaacugcggcgggcaugaaucccagguuacacugaaaggaaaucugaucuuccucgacgugccuaaguuugucgacggcagcuauaugcaaaccuaccacucuuccgugcccacgggcgcuaacauuccuagccccacagauuggcugaaugcccuuuucgggaacggacugucucgcuggauccucggcgugaucgggguccugcugggaggccuugcccucuuuuuccugauuaugagccuguuuaaacucgggaccaagcagguuuucagaucccggacaaaacuggcuuga

SEQ ID NO: 14770 - RNA, 3222 nt, Artificial Sequence
  derived and/or modified CDS sequence (opt5) from SFTSV(KAGBH5)__KP663738.1__GP
augaugaaggugaucugguucagcucccugauuugccucgucauccaguguucuggcgacaccgggcccauuaucugcgccggaccuauucacagcaacaaauccgcuaauaucccgcaucugcuuggcuacucugagaagaucugucagauugauagacugauccacguuagcuccuggcuccggaaccauucucaguuucagggguaugugggacagcgcggcgggagaagccaaguguccuacuuccccgccgaaaauagcuauucucggugguccggacugcuuagcccuugcgacgcggauuggcugggcaugcucgucgugaaaaaggcuaaaggcucugacaugauuguucccgggccucuguacaagggaaagguguuuuucgagcgccccacauuugauggcuaugucggguggggauguggcuccgggaaaagcagaacggaaucuggagagcugugcuccagcgacuccggcaccucuagcggccuccugccuuccgaucgggugcuuuggaucggggacguugccugucagccgaugacacccauuccugaagagaccuuccuggagcucaagagcuuuucucaguccgaguuccccgauaucugcaaaauugacggaaucguguuuaaccagugugaaagcgaaucucugccucaacccuucgaugucgccuggauggacgugggccacagccauaagaucauuaugcgcgagcacaaaacaaagugggugcaggaguccucuagcaaggauuuugucugcuacaaagaagggaccggaccguguuccgagagcgaagagaagacaugcaaaaccucuggcuccugcagaggggacaugcaguucuguaagguugcuggaugcgaacacggcgaggagacgagcgaagccaaaugucggugcucucuugugcauaagccuggcgagguggucguguccuaugggggaaugcgcguuagacccaaauguuacggcuuuagccggaugauggcuacccuggaagugaauccucccgagcagcgcaucgggcaaugcacaggaugucaccucgaaugcauuaacggcggggucagacugaucacccugacauccgagcucaagucugccaccgugugugcgagccauuucugcuccucugccacgagcggcaagaaauccacagagauucaguuccacagcggaucucugguuggcaagaccgcuauccacgugaaaggggcccuugucgacggaacagaauuuaccuucgagggccgguguauguuucccgaugggugcgacgcuguggauugcaccuucugucgcgaauuucugaagaauccucagugcuacccggccaaaaaguggcuguucaucauuaucgucauucuccuuggauaugcgggccugaugcuccugacaaacgugcugaaggccguugggguguggggcuccugggucaucgcucccgugaaacucauguuugccauuaucaagaaacugaugagaagcguuucuugucuuaugggaaagcugauggaccggggcagacaagugauccaugaggaaauuggggagaaucgcgagggaaaccaggaugacguccggaucgaaauggcuagaccucgccgggugagacacuggauguacucccccgugauucucgccauccuggccauuggccuugcugaggggugcgaugaaaugguucaugcggacagcaaacuggucucuuguaagcagggaagcggcaauaugaaggagugcgugacgaccgggcgcgcccuccugccugcugugaaccccggccaggaggccugucugcacuucacagccccgggauccccugauagcaaaugccucaagaucaaagucaagcggauuaaucugaaauguaagaagucuuccagcuauuuugugcccgacgcuagaucccgcugcaccucuguucggagaugucgcugggccggcgauugccaaagcgggugcccuucccauuucacaucuaacagcuuuuccgacgacugggcgggaaaaauggaucgggcuggccuuggguucucuggauguagcgacggcugcgggggcgccgccuguggaugcuuuaaugcugcccccuccuguaucuucuggagaaaguggguggaaaacccucacggcaucauuuggaaagucagccccugcgcugccugggugccgucugcgguuaucgagcugaccaugccuuccggggaagugcggacguuccaccccaugagcggcauucccacacaggucuuuaagggagugucuguuaccuaccucggguccgauauggaggugagcggacugaccgaccugugugaaaucgaggagcuuaaaucuaagaaacucgcccuggcuccuugcaaccaggccggcaugggcgucguggggaaggugggagaaauucaguguuccagcgaggaauccgcucgcacaaucaagaaagauggcugcaucuggaaugccgaccuggucgggauugagcucagaguugaugacgcgguguguuauagcaagaucaccucuguggaagccgucgcuaacuacagcgccauuccgacaacgaucggaggccugcgguucgagagaucccaugauucucaagggaaaauuagcggaucuccccuugacaucaccgcuauccgcggcuccuuuagcgugaauuaucggggccugagacucucccugucugagauuacagcuaccugcacaggggaaguuaccaacgugagcggaugcuacuccuguaugacgggcgccaaggucagcaucaaacugcacucuuccaagaauagcaccgcccaugugcgcugcaagggggaugagacagcguucucuguucuugaaggagugcacuccuacaccgucagccucuccuuugaccacgccgugguugaugagcagugucagcugaacugcggcgggcaugaaucucaggugacacugaaaggaaaucucauuuuccuggacgucccuaaguuuguggacggcagcuauaugcaaaccuaccacuccagcgugcccacgggcgcuaacaucccuucucccacagauuggcuuaaugcccuguucgggaacggacucuccagauggauucugggcgucaucgggguucugcuuggaggccucgcccuguuuuuccugaucaugagccucuuuaaacuggggaccaagcaaguguuccggucucgcacaaaacuugcuuga

SEQ ID NO: 14771 - RNA, 3222 nt, Artificial Sequence
  derived and/or modified CDS sequence (opt5) from SFTSV(KAGBH6)__KP663741.1__GP
augaucaaggugauuugguucagcucccugaucugccucgucauucaguguucuggcgacaccgggcccaucauuugcgccggaccuauccacagcaacaaauccgcuaauaucccgcaucugcuuggcuacucugagaagauuugucaaaucgauagacugauucacguuagcuccuggcuccggaaccauucucaguuucagggguaugugggacagcgcggcgggagaagccaaguguccuacuuccccgccgaaaauagcuauucucggugguccggacugcuuagcccuugcgacgcggauuggcugggcaugcucgucgugaaaaaggcuaaaggcucugacaugaucguucccgggccuuccuacaagggaaagguguuuuucgagcgccccacauuugauggcuaugucggguggggauguggcagcgggaaaucuagaacggaauccggagagcugugcagcuccgacucuggcaccagcuccggccugcucccuagcgaucgggugcuguggauuggggacguugccugucagccgaugacacccaucccugaagagaccuuccuugagcugaagucuuuuucccagagcgaguuccccgauauuugcaaaaucgacggaaucguguuuaaccagugugaaucugaaagccucccucaacccuucgaugucgccuggauggacgugggccacucccauaagauuaucaugcgcgagcacaaaacaaagugggugcaggagucuagcuccaaggauuuugucugcuacaaagaagggaccggaccguguagcgagucugaagagaagacaugcaaaaccuccggcagcugcagaggggacaugcaguucuguaagguugcuggaugcgaacacggcgaggaggccucugaagcuaaaugucggugcucccuggugcauaagccuggcgagguggucgugagcuaugggggaaugcgcguuagacccaaauguuacggcuuuucccggaugauggccacgcuugaagugaauccucccgagcagcgcauugggcaaugcaccggaugucaccuggaaugcaucaacggcggggucagacucauuacacugaccucugagcuuaagagcgcgacagugugugccucccauuucugcucuagcgcuaccuccggcaagaaaagcacggagauccaguuccacucuggaucccucguuggcaagacagccauccacgugaaaggggcucuggucgacggaaccgaauuuacauucgagggcagcuguauguuucccgaugggugcgacgccguggauugcaccuucugucgggaauuucuuaagaauccucagugcuacccggcgaaaaaguggcuguucauuaucauugucauccuccugggauaugccggccuuaugcugcucaccaacgugcugaaggcuauugggguuuggggcucuugggugaucgcccccgucaaacugauguuugcuaucauuaagaaacucauccgcuccgugagcugucugaugggaaagcugauggacagaggccggcaaguuauucaugaggaaaucggggagaauagagagggaaaccaggaugacgugcgcauugaaauggcccggccuagacgcguccggcacuggauguacucucccgugauccugacaauucucgccaucggccuggcugaggggugcgaugaaauggugcaugcggacagcaaacuuguuuccuguaagcagggaagcggcaauaugaaggagugcgucacgaccgggagagcccugcucccugcugugaaccccggccaggaggccugucugcacuucacagccccgggaucuccugauuccaaaugccugaagaucaaagugaagcgcauuaaucucaaauguaaaaagagcuccucuuauuuuguccccgacgcucggagcagaugcaccuccgugcgccgguguagaugggccggcgauugccaaucugggugcccuagccauuucacauccaacucuuuuagcgacgacugggcgggaaagauggaucgcgcuggccugggguucuccggauguagcgacggcugcgggggcgccgccuguggaugcuuuaaugcugcccccucuuguaucuucuggcggaaguggguugaaaacccucacggcauuaucuggaaagugucccccugcgcugccugggucccgagcgcggugauugagcuuaccaugccuucuggggaaguuagaacguuccaccccauguccggaauccccacacagguguuuaagggcgucagcgugaccuaccuggggucugauauggagguuuccggacucaccgaccugugugaaaucgaggagcugaaaagcaagaaacuugcccucgcuccuugcaaccaggccggcaugggcguggucgggaaggugggagaaauucaguguuccagcgaggaaucugcucggacaaucaagaaagauggcugcauuuggaaugccgaccugguggggaucgagcugcgcgucgaugacgcgguuuguuauagcaagauuaccuccguggaagccguggcuaacuacucugccaucccgacaacgaucggaggccucagauucgagcggagccaugauucccaagggaaaauuucuggaagcccccuggacaucaccgcuauuagaggcuccuuuucugucaauuaucgcggccuucggcugagccucuccgagaucagcgccacaugcaccggggaagugacaaacguuucuggaugcuacuccuguaugaccggcgccaaggugagcauuaaacugcacucuuccaagaauagcacggcucaugucagaugcaagggggaugagaccgcguucuccgugcuggaaggaguucacucuuacacagugagccuuuccuuugaccacgccgucguggaugagcagugucagcucaacugcggcgggcaugaaagccagguuacccugaaaggaaaucugaucuuccucgacgugccuaaguuugucgacggcucuuauaugcaaacauaccacuccagcgugcccaccggcgcuaacaucccuucucccacggauuggcugaaugcccuuuucgggaacggacugagccgcuggauucucggcgugaucgggguccugcugggaggccuugcccucuuuuuccugauuaugucccuguuuaaacucgggacaaagcaggcuuucagaucucggaccaaacuggccuga

SEQ ID NO: 14772 - RNA, 3222 nt, Artificial Sequence
  derived and/or modified CDS sequence (opt5) from SFTSV(KAGNH)__KU507550.1__GP
augaugaaggugaucugguucagcucccugauuugccucgucauccaguguucuggcgacaccgggcccauuaucugcgccggaccuauucacagcaacaaauccgcuaauaucccgcaucugcuuggcuacucugagaagaucugucaaauugauagacugauccacguuagcuccuggcuccggaaccauucucaguuucagggguaugugggacgcagaggcgggcggagccagguguccuacuuccccgccgaaaauagcuauucucgcugguccggacugcuuagcccuugcgacgcggauuggcugggcaugcucgucgugaaaaaggcuaaaggcucugacaugauuguucccgggccuuccuacaagggaaagguguuuuucgagagacccacauuugauggcuaugucggguggggauguggcagcgggaaaucucggacggaauccggagagcugugcagcuccgacucuggcaccagcuccggccugcucccuagcgaucgcgugcuguggaucggggacguugccugucaaccgaugacacccauuccugaagagaccuuccuugagcugaagucuuuuucccagagcgaguuccccgauaucugcaaaauugacggaaucguguuuaaccagugugaaucugaaagccucccucagcccuucgaugucgccuggauggacgugggccacucccauaagaucauuaugagagagcacaaaacaaagugggugcaagagucuagcuccaaggauuuugucugcuacaaagaagggaccggaccguguagcgagucugaagagaagacaugcaaaaccuccggcagcugccggggagacaugcaguucuguaagguugcuggaugcgaacacggcgaggaggccucugaagcuaaaugucgcugcucccuggugcauaagccuggcgagguggucgugagcuaugggggaaugagaguucggcccaaauguuacggcuuuucccgcaugauggccacgcuugaagugaauccucccgagcagagaaucgggcagugcaccggaugucaccuggaaugcauuaacggcgggguccggcucaucacacugaccucugagcuuaagagcgcgacagugugugccucccauuucugcucuagcgcuaccuccggcaagaaaagcacggagauucaauuccacucuggaucccucguuggcaagacagccauccacgugaaaggggcucuggucgacggaaccgaauuuacauucgagggcagcuguauguuucccgaugggugcgacgccguggauugcaccuucugucgcgaauuucuuaagaauccucagugcuacccggcgaaaaaguggcuguucaucauuaucgucauucuccugggauaugccggccuuaugcugcucaccaacgugcugaaggcuaucgggguuuggggcucuugggugauugcccccgucaaacugauguuugcuaucaucaagaaacucauuagauccgugagcugucugaugggaaagcugauggaccggggcagacagguuauccaugaggaaauuggggagaaucgcgagggaaaccaagaugacgugcggaucgaaauggccagaccucgccgggucagacacuggauguacucucccgugauucugacaauccucgccauuggccuggcugaggggugcgaugaaauggugcaugcggacagcaaacuuguuuccuguaagcagggaagcggcaauaugaaggagugcgucacgaccgggcgcgcccugcucccugcugugaaccccggccaggaggccugucugcacuucacagccccgggaucuccugauuccaaaugccugaagaucaaagugaagcggaucaaucucaaauguaagaaguccuccucuuauuuuguccccgacgcuagaagccgcugcaccuccgugcggagaugucgcugggccggcgauugccagucugggugcccuagccauuucacauccaacucuuuuagcgacgacugggcgggaaaaauggaucgggcuggccugggguucuccggauguagcgacggcugcgggggcgccgccuguggaugcuuuaaugcugcccccucuuguauuuucuggagaaaguggguugaaaacccucacggcaucauuuggaaagugucccccugcgcugccugggucccgagcgcggugaucgagcuuaccaugccuucuggggaaguucggacguuccaccccauguccgggauucccacacaaguguuuaagggcgucagcgugaccuaccuggggucugauauggagguuuccggacucaccgaccugugugaaaucgaggagcugaaaagcaagaaacuugcccucgcuccuugcaaccaggccggcaugggcguggucgggaaggugggagaaauccaguguuccagcgaggaaucugcucgcacaauuaagaaagauggcugcaucuggaaugccgaccugguggggauugagcugagagucgaugacgcgguuuguuauagcaagaucaccuccguggaagccguggcuaacuacucugccauuccgacaacgaucggaggccuccgguucgagagaagccaugauucccaggggaaaaucucuggaagcccccuggacauuaccgcuauccgcggcuccuuuucugucaauuaucggggccuuagacugagccucuccgagauuacagcuaccugcacaggggaagugaccaacguuagcggaugcuacucuuguaugacgggcgccaagaucuccauuaaacugcacagcucuaagaauagcaccgcccaugugcgcugcaagggggaugagacagcguucagcguccuggaaggagugcacuccuacaccguuucucuuagcuuugaccacgccguggucgaugagcaaugucagcucaacugcggcgggcaugaaucccaggugacacugaaaggaaaucugaucuuccucgacguuccuaaguuuguggacggcagcuauaugcagaccuaccacucuuccguccccacgggcgcuaacaucccuagccccacagauuggcugaaugcccuuuucgggaacggacugucuagauggauucucggcgugaucggggugcugcugggaggccuugcccucuuuuuccugauuaugagccuguuuaaacucgggaccaaucaagucuuccggucccgcacaaagcuggcuuga

SEQ ID NO: 14773 - RNA, 3222 nt, Artificial Sequence
  derived and/or modified CDS sequence (opt5) from SFTSV(KAGNH4)__KU507551.1__GP
augaugaaggugaucugguucagcucccugauuugccucgucauccaguguucuggcgacaccgggcccauuaucugcgccggaccuauucacagcaacaaguccgcuaauaucccgcaucugcuuggcuacucugagaagaucugucaaauugauagacugauccacguuagcuccuggcuccggaaccauucucaguuucagggguaugugggacagcgcggcgggagaagccaaguguccuacuuccccgccgaaaauagcuauucucggugguccggacugcuuagcccuugcgacgcggauuggcugggcaugcucgucgugaaaaaggcuaaaggcucugacaugauuguucccgggccuuccuacaagggaaagguguuuuucgagcgccccacauuugauggcuaugucggguggggauguggcagcgggaaaucuagaacggaauccggagagcugugcagcuccgacucuggcaccagcuccggccugcucccuagcgaucgggugcuguggaucggggacguugccugucagccgaugacacccauuccugaagagaccuuccuugagcugaagucuuuuucccagagcgaguuccccgauaucugcaaaauugacggaaucguguuuaaccagugugagucugaaagccucccucaacccuucgaugucgccuggauggacgugggccacucccauaagaucauuaugcgcgagcacaaaacaaagugggugcaggagucuagcuccaaggauuuugucugcuacaaagaagggaccggaccguguagcgagucugaagagaagacaugcaaaaccuccggcagcugcagaggggacaugcaguucuguaagguugcuggaugcgaacacggcgaggaggccucugaagcuaaaugucggugcucccuggugcauaagccuggcgagguggucgugagcuaugggggaaugcgcaucagacccaaauguuacggcuuuucccggaugauggccacgcuugaaguuaauccucccgagcagcgcauugggcaaugcaccggaugucaccuggaaugcaucaacggcggggugagacucauuacacugaccucugagcuuaagagcgcgacagucugugccucccauuucugcucuagcgcuaccuccggcaagaaaagcacggagauccaguuccacucuggaucccucgugggcaagacagccauccacguuaaaggggcucugguggacggaaccgaauuuacauucgagggcagcuguauguuucccgaugggugcgacgccgucgauugcaccuucugucgggaauuucuuaagaauccucagugcuacccggcgaaaaaguggcuguucauuaucauugugauccuccugggauaugccggccuuaugcugcucaccaacguccugaaggcuauugggguguggggcucuuggguuaucgcccccgugaaacugauguuugcuaucauuaagaaacucaugcgcuccgucagcugucugaugggaaagcugauggacagaggccggcaagugauccaugaggaaauuggggagaauagagagggaaaccaggaugacguucgcaucgaaauggcccggccuagacgcgugcggcacuggauguacucucccgucauucugacaauccucgccauuggccuggcugggggaugcgaugagauggugcaugcggacagcaaacuuguguccuguagacagggcagcgggaauaugaaggaaugcguuacgaccggccgcgcccugcucccugcugucaaccccggacaggaggccugucugcacuucacagccccgggcucuccugauuccaagugccugaaaauccgggugaagagaaucaaucucaaauguaagaaaagcuccucuuauuuugugcccgacgcucgcagccggugcaccuccgucagacgcugucggugggccggggauugccaaucuggaugcccuagccauuucacauccaacucuuuuagcgacgacugggcgggcaagauggauagagcugggcugggauucuccggcuguagcgacgggugcggcggagccgccuguggcugcuuuaaugcugcccccucuuguauuuucuggcggaaguggguggagaacccucacgggaucauuuggaaaguuucccccugcgcugccugggugccgagcgcggucaucgaacuuaccaugccuucuggagaggugcgcacguuccaccccauguccggcauucccacacagguuuuuaagggggugagcgucaccuaccugggaucugauauggaaguguccggccucaccgaccugugugagaucgaagaacugaaaagcagaaaacuugcccucgcuccuugcaaccaggccggcauggggguugugggaaaggucggcgagauccaguguuccagcgaagagucugcucggacaauuaagaaagaugggugcaucuggaaugccgaccuggugggaauugaacugagaguggaugacgcggucuguuauagcaagaucaccuccguugaggccguggcuaacuacucugccauuccgacaacgaucggcgggcuccgcuucgaacggagccaugauucccaaggaaagaucucuggcagcccccuggacauuaccgcuaucagaggcuccuuuucugugaauuaucgcgggcuuagacugagccucuccgagauuacagcuaccugcacaggagaggucaccaacgugagcggcugcuacucuuguaugacgggggccaaaguuuccaucaagcugcacagcucuaaaaauuccaccgcccaugugcggugcaagggagaugaaacagcguucagcguccuggagggcgugcacuccuacaccguuucucuuagcuuugaccacgccguggucgaugaacagugucagcucaacugcgggggacaugagucccaggugacacugaaaggcaaucugauuuuccucgacguuccuaaguuuguggacggcagcuauaugcaaaccuaccacucuuccguccccacgggggcuaacaucccuagccccacagauuggcugaaugcccuuuucggaaacggccugucucgcuggauccucggggugauuggagugcugcugggcgggcuugcccucuuucugcugaucaugagccucuucaagcugggaaccaaacaggucuuuagaucccggacaaaacuugcuuga

SEQ ID NO: 14774 - RNA, 3222 nt, Artificial Sequence
  derived and/or modified CDS sequence (opt5) from SFTSV(KAGWH2)__KU507564.1__GP
augaugaaggugaucugguucagcucccugauuugccucgucauccaguguggcggggacaccggacccauuaucugcgccggcccuauucacucuaacaaaagcgcugggaucccgcaucugcuuggauacuccgagaagaucugucaaauugauagacugauccacguuucuagcuggcuccggaaucauucccaguuucagggcuauguggggcagcgcggaggcagaucucaagugagcuacuaucccgccgaaaacuccuacagccgguggucuggccugcuuuccccuugcgacgcggauuggcuggggaugcucgucgugaaaaaggcuaaaggaagcgacaugauuguucccggcccuucuuauaaggggaagguguucuuugagcgccccacauucgauggauacgucggcuggggguguggauccggcaaaagcagaacggaaucuggcgagcugugcuccagcgacuccgggaccucuagcggacugcucccuuccgaucgggugcuguggaucggcgacguugccugucagccgaugacacccauuccugaagagaccuuucuugagcuuaagagcuucucucaguccgaauuucccgaugugugcaaaaucgacgggauugucuucaaucagugugagggagaaagccucccucaacccuuugauguggccuggauggacgugggccacucucauaagaucaucaugcgcgagcacaaaacaaaguggguccaggagagcuccucuaaggauuucguuugcuauaaagaagggaccggaccguguagcgaguccgaagagaagacaugcaaaaccagcggcucuugcagaggcgacaugcaguuuuguaagguggcugggugcgaacacggagaggaggccuccgaagcuaaaugucggugcagccuggugcauaagccuggcgaggucgugguuucuuacgggggaaugcgcgugagacccaaauguuacggcuucucccggaugauggccacgcuugaagucaacccucccgagcagcgcauugggcaaugcaccggcugucaccuggaaugcaucaauggaggcgugagacucauuacacugaccagcgagcugaaguccgcgacaguuugugccucucauuuuugcagcuccgcuaccucugggaagaaaagcacggagauccaguuccacuccggaagccucgugggcaagacagccauucacgucaaaggggcucugguggacggaaccgaguucacauuugaaggcucuuguauguuccccgaugggugcgacgccgucgauugcaccuuuugucgggaguuccuuaagaacccucagugcuauccggcgaaaaaguggcuguuuaucaucauugugauccuccugggcuacgccggacuuaugcugcucaccaauguucugaaggcuauuggcguguggggguccugggucaucgcccccgugaaacugguuuucgcuauuaucaagaaacucaugcgcgccgugagcugucugaugggaaagcugauggacagaggccggcaagucauccaugaagaaauuggggagaacagagagggaaaucaggaugacgugcgcaucgaaauggcccggccuagacgcgugcggcacuggauguauucucccguuauucugacaauccucgcuauuggccuggcggaggggugcgaugaaaugguccaugccgacuccaaacuugugagcuguagacagggcucuggaaacaugaaggagugcgugacgaccggccgcgcucugcucccugccgucaaucccgggcaggaggccugucugcacuuuacagcuccgggaagcccugauuccaagugccugaaaaucaaggugaaacggauuaaccucaaguguaaaaagagcagcuccuacuucguucccgacgccagaagccgcugcaccuccgugcggagaugucgcugggcgggcgauugccaaucugggugcccuccccauuuuacaagcaauuccuucucugacgacugggcuggaaagauggaucgggccggccugggguuuagcggcuguuccgacggaugcggcggggccgcuuguggaugcuucaacgccgcuccuucuuguaucuuuuggagaaaaugggucgaaaauccccacggcaucauuuggaaggugagcccgugcgccgcguggguuccuuccgccgugaucgagcuuaccaugcccagcggggaaguccggacguuccaccccaugucuggcauuccuacacagguguucaaaggaguuuccgugaccuaucugggcagcgauauggaggucucugggcucaccgaccugugugaaaucgaggagcugaaguccaaaaagcucgcucuugccccgugcaaccaggcuggaaugggcgugguggggaaagucggagaaauucaguguagcucugaggaauccgcccgcacaaucaagaaggauggcugcaucuggaacgcggaccugguugggauugagcugagaguggaugacgccguguguuacagcaaaaucaccuccgucgaagcuguggccaauuauagcgcuauucccacaacgaucggaggccuccgguuugagagaucucaugauagccaaggcaagauuuccgggucuccucuggacaucaccgccauccgcggaucuuucuccguuaacuaccggggccuuagacugucucucagcgagauuacagcuaccugcacaggggaagugaccaaugucuccggaugcuacucuuguaugacgggcgccaaagugagcaucaagcugcacuccagcaaaaacucuaccgcgcauguucgcugcaagggggaugagacagccuuuuccgugcuggaaggaguccacagcuauucugugucccuuagcuucgaccacgcuguuguggaugagcagugucagcucaauugcggcggccaugaaucccaggucacccugagagggaaccugauuuuucucgacgugcccaaguucguggacggaucuuacaugcaaacauaucacagcaccgucccuacgggcgccaauauccccuccccuacagauuggcugaacgcccuuuuugggaauggacugagccgguggauucucggcguuaucggggugcugcugggaggccuugcucucuucuuucugaucaugucucuguucaaacucggcaccaaacagguguuucgcuccagaacaaagcuggccuga

SEQ ID NO: 14775 - RNA, 3222 nt, Artificial Sequence
  derived and/or modified CDS sequence (opt5) from SFTSV(KAGWH3)__KP663735.1__GP
augaugaaggugaucugguucagcucccugauuugccucgucauccaguguucuggcgacaccgggcccauuaucugcgccggaccuauucacagcaacaaauccgcuaauaucccgcaucugcuuggcuacucugagaagaucugucaaauugauagacugauccacguuagcuccuggcuccggaaccauucucaguuucagggguaugugggacagcgcggcgggagaagccaaguguccuacuuccccgccgaaaauagcuauucucggugguccggacugcuuagcccuugcgacgcggauuggcugggcaugcucauugucaaaaaggcuaaaggcucugacaugaucgugcccgggccuuccuacaagggaaagguuuucuucgagcgccccacauuugauggcuaugugggguggggauguggcagcgggaaaucuagaacggaauccggagagcugugcagcuccgacucuggcaccagcuccggccugcucccuagcgaucggguccuguggauuggggacguggccugucagccgaugacacccaucccugaagagaccuuccuugagcugaagucuuuuucccagagcgaauuucccgauauuugcaaaaucgacggaaucguuuuuaaccagugugagucugaaagccucccucaacccuucgauguggccuggauggacgucggccacucccauaagauuaucaugcgcgagcacaaaacaaagugggugcaggagucuagcuccaaggauuuugugugcuacaaagaagggaccggaccguguagcgagucugaagagaagacaugcaaaaccuccggcagcugcagaggggacaugcaguucuguaaggucgcuggaugcgaacacggcgaggaggccucugaagcuaaaugucggugcucccugguucauaagccuggcgaggugguggucagcuaugggggaaugcgcgugagacccaaauguuacggcuuuucccggaugauggccacgcuugaaguuaauccucccgagcagcgcauugggcaaugcaccggaugucaccuggaaugcaucaacggcggggugagacucauuacacugaccucugagcuuaagagcgcgacagucugugccucccauuucugcucuagcgcuaccuccggcaagaaaagcacggagauccaguuccacucuggaucccucgugggcaagacagccauccacguuaaaggggcucugguggacggaaccgaauuuacauucgagggcagcuguauguuucccgaugggugcgacgccgucgauugcaccuucugucgggaauuucuuaagaauccucagugcuacccggcgaaaaaguggcuguucauuaucauugugauccuccugggauaugccggccuuaugcugcucaccaacguccugaaggcuauugggguguggggcucuuggguuaucgcccccgugaaacugauguuugcuaucauuaagaaacucaugcgcuccgucagcugucugaugggaaagcugauggacagaggccggcaagugauccaugaggaaauuggggagguuagagagggaaaucaggaugacgugcgcaucgaaauggcccggccuagacgcguccggcacuggauguacucucccgugauucugacaauccucgccauuggccuggcugaggggugcgaugaaauggugcaugcggacagcaaacuuguuuccuguaagcagggaagcggcaacaugaaggagugcgucacgaccgggagagcccugcucccugcugugaaucccggccaggaggccugucugcacuucacagccccgggaucuccugauuccaaaugccugaagaucaaagugaagcgcaucaaccucaaauguaaaaagagcuccucuuauuuuguccccgacgcucggagcagaugcaccuccgugcgccgguguagaugggccggcgauugccaaucugggugcccuagccauuucacauccaauucuuuuagcgacgacugggcgggaaagauggaucgcgcuggccugggguucuccggauguagcgacggcugcgggggcgccgccuguggaugcuuuaacgcugcccccucuuguauuuucuggcggaaguggguugaaaauccucacggcaucauuuggaaagugucccccugcgcugccugggucccgagcgcggugaucgagcuuaccaugccuucuggggaaguuagaacguuccaccccauguccggcauucccacacagguguuuaagggagucagcgugaccuaccuggggucugauauggagguuuccggacucaccgaccugugugaaaucgaggagcugaaaagcaagaaacuugcccucgcuccuugcaaccaggccggcaugggcguggucgggaaggugggagaaauccaguguuccagcgaggaaucugcucggacaauuaagaaagauggcugcaucuggaacgccgaccugguggggauugagcugcgcgucgaugacgcgguuuguuauagcaagaucaccuccguggaagccguggcuaauuacucugccauuccgacaacgaucggaggccucagauucgagcggagccaugauucccaagggaaaaucucuggaagcccccuggacauuaccgcuaucagaggcuccuuuucugucaacuaucgcggccuucggcugagccucuccgagauuacagcuaccugcacaggggaagugaccaauguuagcggaugcuacucuuguaugacgggcgccaagguguccaucaaacugcacagcucuaagaacuccaccgcccaugucagaugcaagggggaugagacagcguucagcgugcuggaaggaguucacuccuacaccgugucucuuagcuuugaccacgccgucguggaugagcagugucagcucaauugcggcgggcaugaaucccagguuacacugaaaggaaaccugauuuuccucgacgugccuaaguuugucgacggcagcuauaugcaaaccuaccacucuuccgugcccacgggcgcuaauaucccuagccccacagauuggcugaacgcccuuuucgggaauggacugucucgcuggauccucggcgugauugggguccugcugggaggccuugcccucuuuuuccugaucaugagccuguuuagacucgggaccaaacagguuuuccggucccgcacaaagcuggcuuga

SEQ ID NO: 14776 - RNA, 3222 nt, Artificial Sequence
  derived and/or modified CDS sequence (opt5) from SFTSV(KAICH)__KU507565.1__GP
augaugaaggugaucugguucagcucccugauuugccucgucauccaguguggcggggacaccucucccauuaucugcgccggaccuauucacagcaacaaauccgcugauaucccgcaucugcuuggcuacucugagaagaucugucaaauugacagacugauccacguuagcuccuggcuccggaaucauucucaguuucagggguaugugggacagcgcggcgggagaagccaaguguccuacuaucccgccgaaaacagcuacucucggugguccggacugcuuagcccuugcgaugcggacuggcugggcaugcucgucgugaaaaaggcuaaaggcucugauaugauuguucccgggccuuccuauaagggaaagguguucuuugagcgccccacauucgacggcuacgucggguggggauguggcagcgggaaaucuagaacggaauccggagagcugugcagcuccgauucuggcaccagcuccggccugcucccuagcgaccgggugcuguggaucggggauguugccugucagccgaugacacccauuccugaagagaccuuucuugagcugaagucuuucucccagagcgaauuucccgacaucugcaaaauugauggaaucguguucaaucagugugagggcgaaucucucccucaacccuuugacgucgccuggauggauguggggcacagccauaagaucauuaugcgcgagcacaaaacaaagugggugcaggaguccucuagcaaggacuucgucugcuauaaagaaggaaccggcccguguuccgagagcgaagagaagacaugcaaaaccucuggguccugcagaggagacaugcaguuuuguaagguugcuggcugcgaacacggcgaggaggccagcgaagcuaaaugucggugcucucuggugcauaagccuggggagguggucguguccuacggaggcaugcgcguuagacccaaauguuacggguucagccggaugauggccacgcuugaagugaaccagccugagcaacgcaucggacagugcaccggcugucaccuggaaugcauuuccgggggcgucagacucaucacacugaccucugagcuuaagagcgcgacagugugugccucccauuuuugcucuagcgcuaccuccggaaagaaaagcacggagauucaguuccacucuggcucccucguugggaagacagccauccacgugaaaggagcucuggucgauggcaccgaguucacauuugaagggagcuguauguuccccgacggaugcgaugccguggacugcaccuuuugucgggaguuccuuaagaauccccaaugcuauccugcgaaaaaguggcuguuuaucauuaucgucauucuccugggcuacgccgggcuuaugcugcucaccaacgugcugaaggcuaucggcguuuggggaucuugggugauugccccggucaaacugguguucgcuaucaucaagaaacucaugcgcgccguuuccugucugaugggcaagcugauggauagagggagacaggugauucaugaagaaaucggagagaaucgggagggcaaccaggacgauguccgcauugaaauggcccggcccagacgcgugcggcacuggauguauagcccugugauccugacaauucucgcuaucgggcuggcggagggaugcgacgaaaugguucaugccgauucuaaacuugucagcuguagacagggcuccgggaauaugaaggagugcgugacgaccggccgcgcucugcuccccgccgugaacccuggacaagaggccugucugcacuuuacagcucccggcagcccggacucuaagugccugaaaauuaaggucaaacggaucaaucucaaguguaaaaaguccagcuccuacuucgugccugaugccagaucucgcugcaccagcguucggagaugucgcugggcgggggacugccaguccggaugucccccucauuuuacaucuaacagcuucuccgacgauugggcuggcaagauggaccgggccgggcugggauuuucuggcugcagcgaugggugcggcggagccgcuuguggcugcuucaaugccgcucccuccuguaucuuuuggagaaaauggguggaaaacccucacgggauuaucuggaaggucagccccugcgccgcgugggugccgucugccguuauugagcuuaccaugccuuccggagaagugcggacguuccaccccaugagcggcauccccacacaggucuucaaaggggugucuguuaccuaucugggauccgacauggaggugagcggccucaccgaucugugugaaauggaggagcugaagucuaaaaagcucgcucuugccccuugcaaucaggcuggcaugggggucgugggaaaagugggcgaaauucaauguuccagcgaggaauccgcccgcacaaucaagaaggacgggugcaucuggaacgcggaucuggucggaauugagcugagaguugacgaugccguguguuacagcaaaaucaccucuguggaagcugucacaaacuauagcgccauuccgacgaccaucggcgggcuccgguuugagagaucccaugacucucagggaaagauuagcggcucuccccuggauaucacagcuauccgcggcuccuucagcgugaauuaccgggggcuuagacugucccucucugagauuaccgccacaugcaccggagaaguuacgaacgugagcggcugcuacuccuguaugaccggggccaaagucagcaucaagcugcacucuuccaaaaauagcacagcucaugugcgcugcaagggagacgagaccgcguuuucuguucuggaaggcgugcacuccuauagcgucucccuuucuuucgaucacgccgugguugacgagcagugucagcucaacugcgggggacaugaaagcaaggugacacugagaggcaaucugauuuuucucgacgucccuaaauucguggauggcuccuacaugcaaaccuaucacagcacggugcccacaggggcuaacaucccuucucccaccgacuggcugaaugcccuuuuuggaaacggccugucccggugguuccucggggucauuggaguucugcugggcgggcuugcccucuuuuuccugaucaugagccuguuuaagcucggaacaaaacagguguuccgcucuagaagcaagcuggcuuga

SEQ ID NO: 14777 - RNA, 3222 nt, Artificial Sequence
  derived and/or modified CDS sequence (opt5) from SFTSV(KAJJH)__KU507566.1__GP
augaugaaggugaucugguucagcucccugauuugccucgucauccaguguucuggcgacaccgggcccauuaucugcgccggaccuauucacagcaacaaauccgcuaauaucccgcaucugcuuggcuacucugagaagaucugucaaauugauagacugauccacguuagcuccuggcuccggaaccauucucaguuucagggguaugugggacagcgcggcgggagaagccaaguguccuacuaucccgccgaaaauagcuacucucggugguccggacugcuuagcccuugcgacgcggauuggcugggcaugcucgucgugaaaaaggcuaaaggcucugacaugauuguucccgggccuuccuauaagggaaagguguucuuugagcgccccacauucgauggcuacgucggguggggauguggcagcgggaaaucuagaacggaauccggagagcugugcagcuccgacucuggcaccagcuccggccugcucccuagcaaccgggugcuguggaucggggauguugccugucagccgaugacacccauuccugaagagaccuuucuugagcugaagucuuucucccagagcgaauuucccgacaucugcaaaauugauggaaucguguucaaucagugugagucugaaagccucccucaacccuuugacgucgccuggauggaugugggccacucccauaagaucauuaugcgcgagcacaaaacaaagugggugcaggagucuagcuccaaggacuucgucugcuauaaagaagggaccggaccguguagcgagucugaagagagaacaugcaagaccuccggcagcugccgcggggauaugcaguuuuguaaaguugcuggaugcgaacacggcgaggaggccucugaagcuaagugucggugcucccuggugcauaaaccuggcgagguggucgugagcuacgggggaaugagaguucggcccaaguguuacggcuucucccgcaugauggccacgcuugaagugaacccucccgagcagagaaucgggcaaugcaccggaugucacauugaaugcaucaauggcgggguccggcugauuacacucaccucugagcugaaaagcgcgacagugugugccucccauuuuugcucuagcgcuaccuccggcaaaaagagcacggagauccaguuccacucuggaucccugguuggcaaggccgcuauccacgugaagggggcccucgucgacggaacagaauuuaccuuugagggcagcuguauguuccccgacgggugcgaugcgguggacugcacauuuugucgcgaguuccugaaaaacccucagugcuauccggccaagaaauggcuuuuuauuaucauugucauccugcucggauacgcuggccugaugcuucugaccaaugugcucaaggccauugggguuuggggcucuugggugaucgcucccgucaagcugauguucgccaucauuaaaaagcugaugagauccgugagcugucucaugggaaaacugauggaucggggcagacaaguuauccaugaagaaauuggggagaaccgcgagggaaaucaggacgaugugcggaucgaaauggccagaccucgccgggucagacacuggauguauucucccgugauucuuaccauccuggcuauuggccucgcggaggggugcgacgaaauggugcaugccgauagcaagcugguuuccugucgccagggaggcgggaacaugaaagagugcgucacaacgggccgggcccuucugccugcugugaaucccggacaggaggccugucuccacuuuaccgcuccgggcagcccugacucuaagugccugaagaucaaagugaagagaaucaaccugaaauguaagaaauccagcuccuacuucguccccgaugcccgcucucggugcacaagcgugagacgcugucggugggcgggggacugccaauccggaugcccuucucauuuuaccagcaauuccuucucugaugacugggcuggcaagauggacagagccgggcucggauuuagcggcuguuccgaugggugcggcggagccgcuuguggcugcuucaacgccgcucccagcuguauuuucuggcggaaguggguugaaaacccucacgggaucauuuggaaagugucucccugcgccgcgugggucccguccgccgugaucgagcugacaaugccuagcggagaaguucgcaccuuccaccccaugucuggcauucccacacagguguucaagggggucuccgugacguaucuuggaagcgacauggagguuucuggccugaccgaucucugugaaaucgaggagcugaaauccaagaaacuggcucuugccccuugcaaucaggcuggcauggggguggucggaaaggugggcgaaauccaguguagcuccgaggaaagcgccagaaccauuaaaaaggacgggugcaucuggaacgcggaucucgugggaauugagcugcgggucgacgaugccguuuguuacucuaagaucacaagcguggaagcuguggccaauuauuccgcuauuccgaccacaaucggcgggcugagauuugagcgcucucaugacagccaaggaaaaaucuccggcucuccccucgauauuacggccauccggggcagcuucuccgucaacuacagagggcugcgccuuucucugagcgagauuaccgccacaugcaccggagaagugacaaauguuuccggcugcuacagcuguaugaccggggcuaaggugucuaucaaacuccacuccagcaagaacucuacggcgcaugucagaugcaaaggagacgagaccgccuuuuccgugcuggaaggcguucacagcuauacagugucccugucuuucgaucacgcugucguggacgagcagugucagcuuaauugcgggggacaugaaagccagguuacccucaagggcaaccugauuuuucuggaugugccuaaguucgucgacggcuccuacaugcaaacauaucacagcucugugcccaccggggccaauaucccuucccccacggacuggcucaacgcccuguuuggaaauggccuuagccgguggauccugggggugauuggaguccuccugggcgggcuggcucuuuucuuucucaucaugucucuguucaaacugggaacaaagcagguuuuucgcagcagaaccaaacucgccuga

SEQ ID NO: 14778 - RNA, 3222 nt, Artificial Sequence
  derived and/or modified CDS sequence (opt5) from SFTSV(KAJNH2)__KU507552.1__GP
augaugaaggugaucugguucagcucccugauuugccucgucauccaguguucuggcgacaccgggcccauuaucugcgccggaccuauucacagcaacaaguccgcuaauaucccgcaucugcuuggcuacucugagaagaucugucaaauugauagacugauccacguuagcuccuggcuccggaaccauucucaguuucagggguaugugggacagcgcggcgggagaagccaaguguccuacuaucccgccgaaaauagcuacucucggugguccggacugcuuagcccuugcgacgcggauuggcugggcaugcucguccugaaaaaggcuaaagagucugacaugauugugcccggcccuuccuauaaggggaagguuuucuuugaacgccccacauucgauggauacgugggcuggggguguggaagcggcaaaucuagaacggaguccggggaacugugcagcuccgacucuggaaccagcuccggccuccugccuagcgaucggguccuuuggaucggcgacguggccugucagccgaugacacccauuccugaggagaccuuucuggaacucaagucuuucucccagagcgaguuucccgauaucugcaaaauugacgggaucguuuucaaccagugugaaucugagagccugccucaacccuuugauguggccuggauggacgucggacacucccauaagaucauuaugcgcgagcacaaaacaaagugggugcaggaaucuagcuccaaggauuucgugugcuauaaagagggcaccgggccguguagcgaaucugaggaaaagacaugcaaaaccuccggaagcugcagaggcgacaugcaguuuuguaaggucgcugggugcgagcacggagaggaagccucugaggcuaaaugucggugcucccuuguucauaagccuggcgaagugguggucagcuacggcgggaugcgcgugagacccaaauguuacggauucucccggaugauggccacgcuggagguuaauccucccgaacagcgcaucggccaaugcaccgggugucaccucgagugcauuaacggaggcgugagacugaucacacugaccucugagcucaagagcgcgacagucugugccucccauuuuugcucuagcgcuaccuccgggaagaaaagcacggaaauucaguuccacucuggcucccuggugggaaaggccgcuauccacguuaaaggcgcccuuguggacgggacagaguucaccuuugaaggaagcuguauguuccccgauggcugcgacgcggucgauugcacauuuugucgggaguuccugaagaauccucagugcuauccggccaaaaaguggcucuuuaucauuaucgugauucugcuuggguacgcuggacugaugcuccugaccaacguccugaaggccaucggcgugugggggucuuggguuauugcucccgugaaacucauguucgccaucaucaagaaacugaugcgcuccgucagcugucuuaugggcaagcugauggacagaggacggcaagugauucaugaagagaucggcgagaauagagaagggaaccgcgaugacguucggauugagauggccagaccucgccgggugagacacuggauguauucucccgucauccucaccauucuggcuaucggacuugcggaaggcugcgaugagauggugcaugccgacagcaaacugguguccugucgccaggggagcggaaauaugaaggagugcguuacaacgggccgggcucuccugccugccgucaaccccgggcaggaagccugucugcacuuuaccgcuccgggcucuccugauuccaagugccucaaaauuaaggugaaaagaaucaaucugaaguguaaaaagagcuccucuuacuucgugcccgacgcccgcagccggugcacauccgucagacgcugucggugggcgggagauugccagucuggcugcccuagccauuuuaccuccaacucuuucagcgacgacugggcugggaagauggauagagccggacuuggcuuuuccggguguagcgacggaugcggcggggccgcuuguggcugcuucaaugccgcucccucuuguaucuuuuggcggaaauggguggagaacccucacggaauuaucuggaagguuucccccugcgccgcgugggugccgagcgccgucauugaacugacaaugccuucuggcgaggugcgcaccuuccaccccauguccgggauccccacgcaaguuuucaaaggagugagcgucacauaucucggcucugauauggaaguguccgggcugaccgaccugugugagauugaggaacuuaagagcaaaaagcucgcucuggccccuugcaaccaggcuggaaugggcguugugggcaaagucggggagauccaguguuccagcgaagagucugccagaaccaucaagaaggauggaugcauuuggaaugcggaccuggugggcaucgaacuccggguggaugacgccgucuguuacagcaaaauuacauccguugaggcuguggccaacuauucugcuaucccgaccacaauugggggacugagauuugagcgcagccaugauucccagggcaagaucucugggagcccccuugacaucacggccauucggggauccuucucugugaauuacagaggccugcgccucagccuguccgaaaucaccgccacaugcaccggcgaggucacaaacgugagcgggugcuacucuuguaugaccggagcuaaaguuuccauuaagcugcacagcucuaaaaauuccacggcgcaugugagaugcaagggcgaugaaaccgccuuuagcguccuugagggggugcacuccuauacaguuucucucagcuucgaccacgcuguggucgaugaacaaugucagcugaacugcggaggccaugagucccaggugacccugaaggggaaucucaucuuucuggacguuccuaaauucguggacggaagcuacaugcagacauaucacucuuccguccccaccggcgccaacauuccuagccccacggauuggcuuaaugcccuguuuggcaacgggcucucucgguggauccugggagugaucggcgugcugcuugggggacucgcucuguucuuucugauuaugagccucuucaagcugggcacaaaacaagucuuucgcuccagagccaaacuugcguga

SEQ ID NO: 14779 - RNA, 3222 nt, Artificial Sequence
  derived and/or modified CDS sequence (opt5) from SFTSV(ZL13-32)__KU361342.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuccuggagcuuaaguccuuuagccagucugaguuccccgacaucugcaaaauugauggaaucguguuuaaucagugugaaggcgaaagccugccucaacccuucgacgucgccuggauggauguggggcacucccauaagaucauuaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcguuagacccaaauguuacggguuuucccggaugauggccacccuggaagugaaccagccugagcaacgcaucggacagugcacgggcugucaccuugaaugcauuaaugggggcgucagacugaucacccucacaucugagcuuaagagcgcgaccgugugugccucccauuucugcucuagcgcuacauccggaaagaaaagcaccgagauucaguuccacucuggcucccugguugggaagacggccauccacgugaaaggagcucucgucgauggcacagaauuuaccuucgaggggagcuguauguuucccgacggaugcgaugccguggacugcacauucugucgggaauuucugaagaacccccaaugcuauccugcgaaaaaguggcuuuucaucauuaucgucauucugcucggcuacgccgggcugaugcuucugaccaaugugcucaaggcuaucggcauuuggggaucuuggguuaucgccccggugaaacugaucuuugcuauuaucaagaaacugaugcgcaccgucuccugucucaugggcaagcugauggauagagggagacaggugauucaugaggaaaucggagagaaccgggagggcaaucaggacgauguucgcauugaaauggcccggcccagacgcgugcggcacuggauguauagcccugucauccuuacaauucuggccaucgggcucgcugagucuugcgacgaaauggugcaugcggauagcaaacugguguccuguagacagggaagcggcaacaugaaggagugcguuacgaccgggcgcgcccuucugcccgcugucaauccuggccaagaggccugucuccacuucacagcccccggaucuccggacuccaagugccugaaaaucaaggugaaacggauuaaccugaaguguaaaaagagcuccucuuacuuugugccugaugcuagaagccgcugcaccuccguccggagaugucgcugggccggcgacugccagucugggugucccccucauuucacaagcaauuccuuuucugacgauugggcgggaaagauggaccgggcuggccucggguucagcggaugcuccgauggcugcgggggcgccgccuguggaugcuuuaacgcugcccccagcuguaucuucuggagaaaauggguggaaaauccucacggcauuaucuggaagguuucucccugcgcugccugggugccguccgcggucauugagcugaccaugccuagcggggaagugcggacguuccaccccaugucuggaauccccacacagguuuuuaaaggcguguccgucaccuaucuugggagcgacauggaggugucuggacugaccgaucucugugaaaucgaggagcugaaguccaaaaagcuggcccuugcuccuugcaaccaggccggcaugggcguuguggggaaagucggagaaauucaauguagcuccgaggaaagcgcucgcacaaucaagaaggacggcugcauuuggaacgccgaucucguggggaucgagcugagaguggacgaugcggucuguuacucuaaaauuaccagcguugaagccguggcuaauuauuccgccaucccgacaacgaucggaggccugcgguucgagagaucucaugacagccaggggaagauuuccggaucuccccucgauaucaccgcuauucgcggcagcuuuuccgugaacuaccggggccugagacuuucucugagcgagaucacagcuaccugcacaggggaagucaccaauguguccggaugcuacagcuguaugacgggcgccaaaguuucuauuaagcuccacuccagcaaaaacucuaccgcccaugugcgcugcaagggggacgagacagcguucuccguccuggaaggagugcacagcuauaccguuucccugucuuuugaucacgccguggucgacgagcagugucagcuuaauugcggcgggcaugaaagccaagugacacucaagggaaaccugaucuuccuggacguuccuaaauuuguggauggcuccuacaugcagaccuaucacagcacgguccccacaggcgcuaauaucccuucucccaccgacuggcucaacgcccuguucgggaauggacuuuccagauggauucugggcgugaucggggugcuccugggaggccuggcccuguuuuucaugauuaugagccucuuuaagcuggggacaaaacaggucuuccggucucgcaccaagcuggcuuga

SEQ ID NO: 14780 - RNA, 3222 nt, Artificial Sequence
  derived and/or modified CDS sequence (opt5) from SFTSV(AHL/China/2011)__JQ670930.1__GP
augaugaaggugaucugguucagcucccugauuugccucgucauccaguguucuggcgacaccgggcccauuaucugcgccggaccuauucacagcaacaaauccgcugauaucccgcaucugcuuggcuacucugagaagaucugucaaauugacagacugauccacguuagcuccuggcuccggaaucauucucaguuucagggguaugugggacagcgcggcgggagaagccaaguguccuacuaucccgccgaaaacagcuacucucggugguccggacugcuuagcccuugcgaugcggacuggcugggcaugcucgucgugaaaaaggcuaaaggcucugauaugauuguucccgggccuuccuauaagggaaagguguucuuugagcgccccacauucgacggcuacgucggguggggauguggcagcgggaaaucuagaacggaauccggagagcugugcagcuccgauucuggcaccagcuccggccugcucccuagcgaccgggugcuguggaucggggauguugccugucagccgaugacacccauuccugaagagaccuuucuugagcugaagucuuucucccagagcgaauuucccgacaucugcaaaauugauggaaucguguucaaucagugugagggcgaaucucucccucaacccuuugacgucgccuggauggauguggggcacagccauaagaucauuaugcgcgagcacaaaacaaagugggugcaggaguccucuagcaaggacuucgucugcuauaaagaaggaaccggcccguguuccgagagcgaagagaagacaugcaaaaccucuggguccugcagaggagacaugcaguuuuguaagguugcuggcugcgaacacggcgaggaggccagcgaagcuaaaugucggugcucucuggugcauaagccuggggagguggucguguccuacggaggcaugcgcaucagacccaaauguuacggguucagccggaugauggccacgcuugaaguuaacccucccgagcagcgcauuggacaaugcaccggcugucaccuggaaugcaucaaugggggcgugagacucauuacacugaccuccgagcugaagucugcgacagucugugccagccauuuuugcuccucugcuaccagcggaaagaaaaacacggagauccaguuccacuccggcagccucguggggaagacagccauccacguuaaaggagcucugguggauggcaccgacuucacauuugaagggucuuguauguuccccgauggaugcgacgccgucgauugcaccuuuugucgggaguuccuuaagaauccucagugcuauccggcgaaaaaguggcuguuuauuaucauugugauccuccugggcuacgccgggcuuaugcugcucaccaacguccugaaggcuauuggcguguggggauccuggguuaucgcccccgugaaacugauguucgcuaucaugaagaaacucaugcgcagcgucucuugucugaugggcaagcugauggacagagggcggcaagugauucaugaagagaucggagaaaauagagagggcaaccaggaugacguucgcauugagauggcccggccuagacgcgugcggcacuggauguauucccccgucauccugacaauucucgccacggggcuggcugaaggaugcgaugagauggugcaugcggacagcaaacuugugucuuguagacagggcagcgggaauaugaaggaaugcguuaccacaggccgcgcccugcucccugcugucaaccccggacaggaggccugucugcacuuuaccgccccgggcuccccugauagcaagugccugaaaaucaaggugaaacggauuaaucucaaguguaaaaagucuuccagcuacuucgugcccgacgcuagaucccgcugcacaucuguccggagaugucgcugggccggggacugccaaagcggaugcccuccccauuuuaccuccaacucuuucagcgaugacugggcgggcaagauggaucgggcugggcugggauuuuccggcuguucugacgggugcggcggagccgccuguggcugcuucaaugcugccccuagcuguaucuuuuggagaaaauggguggagaacccccacgggaucauuuggaagguuuccccgugcgcugccugggugccuagcgcggucaucgaacuuacgaugcccucuggagaggugcggacauuccaccccauguccggcauuccuacccagguuuucaaaggggugagcgucaccuaucugggaucugauauggaaguguccggccucacagaccugugugagaucgaggaacuuaagagcaaaaagcucgcccuugcuccgugcaaccaggccggcauggggguugugggaaaagucggcgagauucaguguucuuccgaagagagcgcucgcaccaucaagaaggaugggugcaucuggaaugccgaccuggugggaauugaacugagaguggaugacgcggucuguuacuccaaaaucacaagcguugaggccguggcuaacuauucugccauucccacgaccaucggcgggcuccgguuugaaagaagccaugauucccaaggaaagauuucuggcagcccucuggacaucacagcuauccgcggcuccuucucugugaauuaccgggggcuuagacugagccucuccgagauuaccgccacaugcaccggagaggucacgaacgugucuggcugcuacagcuguaugaccggggccaaaguuuccgugaagcugcacagcucuaaaaauuccacagcucauguccgcugcaagggagaugaaaccgcguuuagcgugcuggagggcguucacucuuauacagugucccuuagcuucgaccacgccgucguggacgaacagugucagcucaacugcgggggacaugagucccagguuacccugaagggcaaucugaucuuucucgaugugcccaaauucgucgacggcucuuacaugcaaacguaucacagcacagugccuaccggggcuaacauucccuccccuacagauuggcugaaugcccuuuuuggaaacggccugagcagauggauccucggggugauuggaguccugcugggcgggcuugcccucuucuuucugaucaugucucuguucaagcucggaaccaaacagguuuuucggucccgcaccaagcuggcuuga

SEQ ID NO: 14781 - RNA, 3222 nt, Artificial Sequence
  derived and/or modified CDS sequence (opt5) from SFTSV(AH-YTY/China/05/2012)__KR017849.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuccuggagcuuaaguccuuuagccagucugaauuucccgacaucugcaaaauugauggaaucguguuuaaucagugugagggcgaaagccugccucaacccuucgacgucgccuggauggauguggggcacucccauaagaucauuaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcguuagacccaaauguuacggguuuucccggaugauggccacccuggaagugaaccagccugagcaacgcaucggacagugcacgggcugucaccuugaaugcauuaaugggggcgucagacugaucacccucacaucugagcuuaagagcgcgaccgugugugccucccauuucugcucuagcgcuacauccggaaagaaaagcaccgagauucaguuccacucuggcucccugguugggaagacggccauccacgugaaaggagcucucgucgauggcacagaauuuaccuucgaggggagcuguauguuucccgacggaugcgaugccguggacugcacauucugucgggaauuucugaagaacccccaaugcuauccugcgaaaaaguggcuuuucaucauuaucgucauucugcucggcuacgccgggcugaugcuucugaccaaugugcucaaggcuaucggcauuuggggaucuuggguuaucgccccggugaaacugaucuuugcuauuaucaagaaacugaugcgcgccgucuccugucucaugggcaagcugauggauagagggagacaggugauucaugaggaaaucggagagaaccgggagggcaaucaggacgauguucgcauugaaauggcccggcccagacgcgugcggcacuggauguauagcccugucauccuuaccauucuggcuaucgggcucgcggagucuugcgacgaaauggugcaugccgauagcaaacugguguccuguagacagggaagcggcaacaugaaggagugcguuacaacggggcgcgcucugcugcccgccgucaauccuggccaagaggccugucuccacuucaccgcucccggaucuccggacuccaagugccugaaaaucaaggugaaacggauuaaccugaaguguaaaaagagcuccucuuacuuugugccugaugccagaagccgcugcacauccguccggagaugucgcugggcgggcgacugccagucugggugucccccucauuucaccagcaauuccuuuucugacgauugggcuggaaagauggaccgggccggccucggguucagcggaugcuccgauggcugcgggggcgccgcuuguggaugcuuuaacgccgcucccagcuguaucuucuggagaaaauggguggaaaauccucacggcauuaucuggaagguuucucccugcgccgcgugggugccguccgccgucauugagcugacaaugccuagcggggaagugcggaccuuccaccccaugucuggaauccccacgcagguuuuuaaaggcguguccgucacauaucuugggagcgacauggaggugucuggacugaccgaucucugugaaaucgaggagcugaaguccaaaaagcuggcucuugccccuugcaaccaggcuggcaugggcguuguggggaaagucggagaaauucaauguagcuccgaggaaagcgcccgcaccaucaagaaggacggcugcauuuggaacgcggaucucguggggaucgagcugagaguggacgaugccgucuguuacucuaaaauuacaagcguugaagcuguggccaauuauuccgcuaucccgaccacaaucggaggccugcgguucgagagaucucaugacagccaggggaagauuuccggaucuccccucgauaucacggccauucgcggcagcuuuuccgugaacuaccggggccugagacuuucucugagcgagaucaccgccacaugcaccggggaagucacaaauguguccggaugcuacagcuguaugaccggcgcuaaaguuucuauuaagcuccacuccagcaaaaacucuacggcgcaugugcgcugcaagggggacgagaccgccuucuccguccuggaaggagugcacagcuauacaguuucccugucuuuugaucacgcuguggucgacgagcagugucagcuuaauugcggcgggcaugaaagccaagugacccucaagggaaaccugaucuuccuggacguuccuaaauuuguggauggcuccuacaugcagacauaucacagcaccguccccacgggcgccaauaucccuucucccacagacuggcucaacgcccuguucgggaauggacuuuccagauggauucugggcgugaucggggugcuccugggaggccuggcucuuuucuucaugauuaugagccucuuuaagcuggggaccaaacaggucuuccggucucgcacaaagcuggccuga

SEQ ID NO: 14782 - RNA, 3222 nt, Artificial Sequence
  derived and/or modified CDS sequence (opt5) from SFTSV(AHZ/China/2011)__JQ670931.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcauucuggucgugaaaaaggcuaaaggcuccgauaugaucguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggauuggggauguugccugucagccgaugacccccaucccugaagagacauuccuggagcuuaaguccuuuagccagucugaguuccccgacauuugcaaaaucgauggaaucguguuuaaucagugugaaggcgaaagccugccucaacccuucgacgucgccuggauggauguggggcacucccauaagauuaucaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagauugcuggcugcgaacacggcgaggaggccucugaagcuaaaugucggugcucccucguucauaagccuggggaggugguggucagcuacggaggcaugcgcgugagacccaaauguuacggguuuucccggaugauggccacccuggaaguuaaccagccugagcaacgcaucggacagugcacgggcugucaccuugaaugcauuaaugggggcgugagacugaucacccucacaucugagcugaaguccgcgaccgucugugccucccauuucugcucuagcgcuacauccggaaagaaaagcaccgagauccaguuccacucuggcucccugguggggaagacggccauucacguuaaaggagcucucguggauggcacagaauuuaccuucgaggggagcuguauguuucccgacggaugcgaugccgucgacugcacauucugucgggaauuucugaagaacccccaaugcuauccugcgaaaaaguggcuuuucaucauuaucgugauucugcucggcuacgccgggcugaugcuucugaccaauguccucaaggcuaucggcaucuggggaucuugggugauugccccgguuaaacugaucuuugcuauuaucaagaaacugaugcgcaccguguccugucucaugggcaagcugauggauagagggcggcaggucauucaugaggaaaucggagagaacagagagggcaaucaggacgaugugcgcauugaaauggcccggcccagacgcguucggcacuggauguauagcccugugauccuuacaauccuggccauugggcucgcugagucuugcgacgaaaugguccaugcggauagcaaacugguguccuguagacagggaagcggcaacaugaaggagugcgugacgaccgggcgcgcccuucugcccgcuguuaauccuggccaagaggccugucuccacuucacagcccccggaucuccggacuccaagugccugaaaaucaaggucaaauggauuaaccugaaguguaaaaagagcuccucuuacuuugugccugaugcucggagcagaugcaccuccgugcgccgguguagaugggccggcgacugccagucugggugucccccucauuucacaagcaauuccuuuucugacgauugggcgggaaagauggaccgcgcuggccucggguucagcggaugcuccgauggcugcgggggcgccgccuguggaugcuuuaacgcugcccccagcuguaucuucuggcggaaaugggucgaaaauccucacggcauuaucuggaaggugucucccugcgcugccuggguuccguccgcggugaucgagcugagcaugccuucuggggaagucagaaccuuccaccccauguccggcauucccacacagguguuuaaaggaguuagcgugacguaucuugggucugacauggaggucuccggacugaccggccucugugaaaucgaggagcuuaagagcaaaaagcuggcccuggcuccuugcaaccaggccggcaugggggugguuggaaaagugggcgaaauucaauguuccagcgaggaaucugcucggaccaucaagaaggaugggugcauuuggaacgccgaccucgucggaaucgagcugcgcguggaugacgcgguguguuacagcaaaaucacauccgucgaaucuguugccaauuauagcgcuauuccgaccacaaucggcgggcugagauucgagcggucccaugauucucagggaaagauuagcggcagcccccucgacaucacggccauuagaggcucuuuuagcgugaacuaccgcgggcugcggcuuucccugagcgagaucaccgcuacaugcaccggagaagugacaaaugucucuggcugcuacuccuguaugaccggggccaaagugagcaucaagcuccacucuuccaaaaacagcacggcccauguuagaugcaagggagaugagaccgcuuucuccgugcuggaaggcguccacucuuauacagugagccuguccuuugaccacgcgguuguggaugagcagugucagcuuaauugcgggggacaugaaagccaagucacccucaagggcaaccugauuuuccuggacgugccuaaauuuguugacggcucuuacaugcagacauaucacuccaccgugcccacgggggccaauaucccuagccccacagauuggcucaacgcucuguucggaaauggccuuucucgcuggauucuggggcucaucggaguccugcugggcgggcuugcccucuuuuucaugauuaugagccuguuuaagcugggaaccaaacagguguucagaucccggacaaagcucgccuga

SEQ ID NO: 14783 - RNA, 3222 nt, Artificial Sequence
  derived and/or modified CDS sequence (opt5) from SFTSV(DS02/CHN/2013)__KR698332.1__GP
augaugaaggugaucugguucagcucccugauuugccucgucauccaguguucuggcgacaccgggcccauuaucugcgccggaccuauucacagcaacaaauccgcuaauaucccgcaucugcuuggcuacucugagaagaucugucaaauugauagacugauccacguuagcuccuggcuccggaaccauucucaguuucagggguaugugggacagcgcggcgggagaagccaaguguccuacuaucccgccgaaaauagcuacucucggugguccggacugcuuagcccuugcgacgcggauuggcugggcaugcucgucgugaaaaaggcuaaaggcucugacaugauuguucccgggccuuccuauaagggaaagguguucuuugagcgccccacauucgauggcuacgucggguggggauguggcagcgggaaaucuagaacggaauccggagagcugugcagcuccgacucuggcaccagcuccggccugcucccuagcgaucgggugcuguggaucggggacguugccugucagccgaugacacccauuccugaagagaccuuucuugagcugaagucuuucucccagagcgaauuucccgauaucugcaaaauugacggaaucguguucaaccagugugagucugaaagccucccucaacccuuugaugucgccuggauggacgugggccacucccauaagaucauuaugcgcgagcacaaaacaaagugggugcaggagucuagcuccaaggauuucgucugcuauaaagaagggaccggaccguguagcgagucugaagagaagacaugcaaaaccuccggcagcugcagaggggacaugcaguuuuguaagguugcuggaugcgaacacggcgaggaggccucugaagcuaaaugucggugcucccuggugcauaagccuggcgagguggucgugagcuacgggggaaugcgcguuagacccaaauguuacggcuucucccggaugauggccacgcuugaagugaauccucccgagcagcgcaucgggcaaugcaccggaugucaccuggaaugcauuaacggcggggucagacucgugacacugaccucugagcuuaagagcgcgacaguuugugccucccauuuuugcucuagcgcuaccuccggcaagaaaagcacggagauccaguuccacucuggaucccucgugggcaaggccgcuauucacgucaaaggggcccugguggacggaacagaguucaccuuugaaggcagcuguauguuccccgaugggugcgacgcggucgauugcacauuuugucgggaguuccuuaagaaucugcagugcuauccugccaaaaaguggcucuuuaucaucauugugauccugcuuggauacgcuggccugaugcuccugaccaacguucugaaggccauugggguguggggcucuugggucaucgcuccggugaaacucauguucgccauuaucaagaaacugaugcgcuccguuagcugucuuaugggaaagcugauggacagaggccggcaagugauccaugaagaaauuggggagaauagagagggaaaccaggaugacguccgcaucgaaauggugcggcccagacgcgugcggcacuggauguauucuccuguuauucucaccauccuggccauuggccuuacagaggggugcgaugaaaugguccaugcugacagcaaacugguguccuguagacagggaagcggcaauaugaaggagugcgugacgaccgggcgcgcgcuccugcccgccgucaacccuggccaggaggcuugucugcacuuuacagcccccggaucuccggauuccaagugccucaaaaucaaggugaaacggauuaaucugaaguguaaaaagagcuccucuuacuucguuccugacgccagaagccgcugcaccuccgugcggagaugucgcugggcuggcgauugccaaucugggugccccagccauuuuacauccaacucuuucagcgacgacugggccggaaagauggaucgggcgggccuuggguuuuccggauguagcgacggcugcgggggcgcugccuguggaugcuucaaugccgcuccuucuuguaucuuuuggagaaaaugggucgaaaacccccacggcaucauuuggaagguguccccuugcgccgcuuggguucccagcgccgugaucgagcugaccaugccgucuggggaaguccggacguuccacccuauguccggcauucccacacagguguucaaaggaguuagcgugaccuaucucgggucugauauggaggucuccggacugaccgaccugugugaaaucgaggagcuuaagagcaaaaagcucgcgcuggcccccugcaaccaggcuggcaugggcgugguggggaaagucggagaaauucaguguuccagcgaggaaucugcccgcacaaucaagaaggauggcugcaucuggaaugcugaccugguugggauugagcucagaguggaugacgccguguguuacagcaaaaucaccuccgucgaagcgguggccaacuauucugcuauuccuacaacgaucggaggccugcgguuugagagaagccaugauucccaagggaagauuucuggaagcccgcuugacaucaccgccauccgcggcuccuucucuguuaauuaccggggccugagacucagccuguccgagauuacagcuaccugcacaggggaagugaccaacgucagcggaugcuacucuuguaugacgggcgccaaaguguccaucaagcugcacagcucuaaaaauuccaccgcccauguucgcugcaagggggaugagacagcuuuuagcgugcuugaaggaguccacuccuauaccgugucucucagcuucgaccacgcgguuguggaugagcagugucagcugaacugcggcgggcaugaaucccaggucacacugaagggaaaucucauuuuucuggacgugcccaaauucguggacggcagcuacaugcaaaccuaucacucuuccgucccuacgggcgccaacauccccagcccuacagauuggcuuaaugcucuguuugggaacggacucucuagauggauucugggcguuaucggggugcugcuuggaggccucgcccuguucuuucugaucaugagccucuucaagcuggggaccaaacagguguuucggucccgcacaaagcuggccuga

SEQ ID NO: 14784 - RNA, 3222 nt, Artificial Sequence
  derived and/or modified CDS sequence (opt5) from SFTSV(DS03/CHN/2013)__KR698333.1__GP
augaugaaggugaucugguucagcucccugauuuaccucgucauccagugcucuggcgacagcgggcccauuaucugugccggaccuauucacuccaacaaaucugcuaauaucccgcaucugcuuggcuauagcgagaagaucugccaaauugauagacugauccacguuuccucuuggcuccggaaccauagccaguuucagggguacgugggacagcgcggcgggagaucccaagugagcuauuaccccgccgaaaauucuuauucccgguggagcggacugcuuucuccuugugacgcggauuggcugggcaugcucgucgugaaaaaggcuaaaggcuccgacaugauuguucccgggccuagcuacaagggaaagguguucuuugagcgccccaccuucgauggcuaugucggguggggaugcggcucugggaaauccagaacagaaagcggagagcuguguuccucugacagcggcacguccagcggccugcucccuucugaucgggugcuguggaucggggacguugccugccagccgaugacccccauuccugaagagacauuucuugagcugaaguccuucagccagucugaauuucccgauaucuguaaaauugacggaaucguguucaaccagugcgagcgcgaaagccucccucaacccuuugaugucgccuggauggacgugggccacucccauaagaucauuaugagagagcacaaaaccaagugggugcaggagucuagcuccaaggauuucgucuguuacaaagaagggacaggaccgugcagcgagucugaagagaagaccuguaaaacauccggcagcugccgcggggacaugcaguuuugcaagguugcuggaugugaacacggcgaggaggccucugaagcuaaaugccgguguucccuggugcauaagccuggcgagguggucgugagcuacgggggaaugagaguucggcccaaaugcuauggcuucucccgcaugauggccacccuugaagugaauccucccgagcagagaaucgggcaauguacgggaugccaccuggaauguauuaacggcgggguccggcucaucacccugacaucugagcuuaagagcgcgaccgugugcgccucccauuuuuguucuagcgcuacauccggcaagaaaagcaccgagauucaguuccacucuggaucccucguuggccgcacggccauccacgugaagggggcucuggucgacggaacagaguucaccuuugaaggcagcugcauguuccccgaugggugugacgccguggauugcacauuuugcagagaguuccuuaaaaauccucaguguuacccggcgaagaaauggcuguuuaucauuaucgucauucuccugggauaugccggccuuaugcugcucaccaacgugcugaaggcuaucgggguuuggggcucuugggugauugcccccgucaagcugauguucgcuaucaucaaaaagcucaugcgguccgugagcugccugaugggaaaacuuauggacagaggccgccaaguuauucaugaagaaaucggggagaaucgggagggaaaccaggaugacauuagaaucgaaauggcccgcccucggagagugcgccacuggauguacucucccgucauucugaccauccucgccgugggccuggcugaggggugugaugaaauggugcaugcggacagcaagcugguuuccugcaaacagggaagcggcaauaugaaggagugugucacaacggggcgggcccugcucccugcugugaaccccggccaggaggccugccugcacuuuaccgccccgggaucuccugauuccaagugucugaaaauuaaggugaaaagaaucaaucucaagugcaaaaagagcuccucuuauuucguccccgacgcucgcagccgguguacauccgugagacgcugccggugggccggcgauugucaaucugggugcccuagccauuuuaccuccaacucuuucagcgacgacugggcgggaaagauggauagagcuggccugggguuuuccggaugcagcgacggcugugggggcgccgccugcggauguuucaaugcugcccccucuugcaucuuuuggcggaaauggguugaaaacccucacggcauuaucuggaaggugucccccugugcugccugggucccgagcgcggugauugagcuuacaaugccuucuggggaaguucgcaccuuccaccccauguccggaauccccacacagguguucaaaggcgucagcgugacguaccuggggucugauauggagguuuccggacucaccgaccugugcgaaauugaggagcuuaagagcaaaaagcuggcccucgcuccuuguaaccaggccggcaugggcguggucgggaaagugggagaaauccagugcuccagcgaggaaucugcuagaaccaucaagaaggauggcuguauuuggaaugccgaccugguggggaucgagcugcgggucgaugacgcgguuugcuauagcaaaauuacauccguggaagccguggcuaacuacucugccaucccgaccacaauuggaggccucagauuugagcgcagccaugauucccaagggaagaucucuggaagcccccuggacaucacggcuauucggggcuccuucucugucaauuacagaggccuucgccugagccucuccgagaucaccgccacauguaccggggaagugacaaacguuagcggaugcuauucuugcaugaccggcgccaaaguguccauuaagcugcacagcucuaaaaauuccacggcucaugucagauguaagggggaugagaccgcguuuagcgugcuggaaggaguucacuccuacacagugucucuuagcuucgaccacgccgucguggaugagcagugccagcucaacuguggcgggcaugaaucccagguuacccugaagggaaaucugaucuuucucgacgugccuaaauucgucgacggcagcuauaugcaaacauaccacucuuccgugcccaccggcgcuaacauuccuagccccacggauuggcugaaugcccuuuuugggaacggacugucucgguggauccucggcgugaucgggguccugcugggaggccuugcccucuucuuucugauuaugagccuguucaagcucgggacaaaacagguuuuucgcuccagaaccaagcuggcuuga

SEQ ID NO: 14785 - RNA, 3222 nt, Artificial Sequence
  derived and/or modified CDS sequence (opt5) from SFTSV(DS04/CHN/2013)__KR698334.1__GP
augaugaaggugaucugguucagcucccugauuugccucgucauccaguguucuggcgacaccgggcccauuaucugcgccggaccuauucacagcaacaaauccgcuaauaucccgcaucugcuuggcuacucugagaagaucugucaaauugauagacugauccacguuagcuccuggcuccggaaccauucucaguuucagggguaugugggacagcgcggcgggagaagccaaguguccuacuaucccgccgaaaauagcuacucucggugguccggacugcuuagcccuugcgacgcggauuggcugggcaugcucgucgugaaaaaggcuaaaggcucugacaugauuguucccgggccuuccuauaagggaaagguguucuuugagcgccccacauucgauggcuacgucggguggggauguggcagcgggaaaucuagaacggaauccggagagcugugcagcuccgacucuggcaccagcuccggccugcucccuagcgaucgggugcuguggaucggggacguugccugucagccgaugacacccauuccugaagagaccuuucuugagcugaagucuuucucccagagcgaauuucccgauaucugcaaaauugacggaaucguguucaaccagugugagucugaaagccucccucaacccuuugaugucgccuggauggacgugggccacucccauaagaucauuaugcgcgagcacaaaacaaagugggugcaggagucuagcuccaaggauuucgucugcuauaaagaagggaccggaccguguagcgagucugaagagaagacaugcaaaaccuccggcagcugcagaggggacaugcaguuuuguaagguugcuggaugcgaacacggcgaggaggccucugaagcuaaaugucggugcucccuggugcauaagccuggcgagguggucgugagcuacgggggaaugcgcguuagacccaaauguuacggcuucucccggaugauggccacgcuugaagugaauccucccgagcagcgcaucgggcaaugcaccggaugucaccuggaaugcauuaacggcggggucagacucaucacacugaccucugagcuuaagagcgcgacagugugugccucccauuuuugcucuagcgcuaccuccggcaagaaaagcacggagauucaguuccacucuggaucccucguuggcaaggccgcuauccacgugaaaggggcccuggucgacggaacagaguucaccuuugaaggcagcuguauguuccccgaugggugcgacgcgguggauugcacauuuugucgggaguuccuuaagaauccucagugcuauccggccaaaaaguggcuguuuaucauuaucgucauucuccugggauacgcuggccuuaugcugcucaccaacgugcugaaggccaucgggguuuggggcucuugggugauugcucccgucaaacugauguucgccaucaucaagaaacucaugcgcuccgugagcugucugaugggaaagcugauggacagaggccggcaaguuauucaugaagaaaucggggagaauagagagggaaaccaggaugacgugcgcauugaaaugguccggccuagacgcgugcggcacuggauguauucucccgugauccugaccauucucgccaucggccugacagaggggugcgaugaaaugguucaugcugacagcaaacuugucuccuguagacagggaagcggcaauaugaaggagugcgugacgaccgggcgcgcgcugcucccugccgugaaccccggccaggaggcuugucugcacuuuacagccccgggaucuccugauuccaagugccugaaaauuaaggucaaacggaucaaucucaaguguaaaaagagcuccucuuacuucgugcccgacgccagaagccgcugcaccuccguucggagaugucgcugggcuggcgauugccaaucugggugcccuagccauuuuacauccaacucuuucagcgacgacugggccggaaagauggaucgggcgggccugggguuuuccggauguagcgacggcugcgggggcgcugccuguggaugcuucaaugccgcucccucuuguaucuuuuggagaaaauggguggaaaacccucacggcauuaucuggaaggucucccccugcgccgcuugggugccgagcgccguuauugagcuuaccaugccuucuggggaagugcggacguuccgccccauguccggaauccccacacaggucuucaaaggcgugagcguuaccuaucuggggucugauauggagguguccggacucaccgaccugugugaaauugaggagcuuaagagcaaaaagcuggcgcucgccccuugcaaccaggcuggcaugggcgucguggggaaagugggagaaauccaguguuccagcgaggaaucugccagaacaaucaagaaggauggcugcauuuggaaugcugaccuggucgggaucgagcugcggguugaugacgccguguguuacagcaaaauuaccuccguggaagcggucgugaacuauucugccaucccgacaacgauuggaggccucagauuugagcgcagccacgauucccaagggaagaucucuggaagcccccuggacaucaccgcuauucggggcuccuucucuguuaauuacagaggccuucgccugagccucuccgagaucacagcuaccugcacaggggaagugaccaacgucagcggaugcuacucuuguaugacgggcgccaaaguguccauuaagcugcauagcucuaaaaauuccaccgcccacguuagaugcaagggggaugagacagccuuuagcgugcuggaaggaguccauuccuauaccgugucucuuagcuucgaccacgcuguuguggaugagcagugucagcucaacugcggcgggcacgaaucccaggucacacugaagggaaaucugaucuuucucgacgugccuaaauucguggacggcagcuacaugcaaaccuaucauucuuccguccccacgggcgcgaacauuccuagccccacagauuggcugaaugcccuuuuugggaacggacugucucgguggauccucggcguuaucggggugcugcugggaggccuugcucucuucuuucugauuaugagccuguucaagcucgggaccaaacagguguuucgcuccagaacaaagcuggccuga

SEQ ID NO: 14786 - RNA, 3222 nt, Artificial Sequence
  derived and/or modified CDS sequence (opt5) from SFTSV(DS05/CHN/2013)__KR698335.1__GP
augaugaaggugaucugguucagcucccugauuugccucgucauccaguguucuggcgacaccgggcccauuaucugcgccggaccuauucacagcaacaaauccgcuaauaucccgcaucugcuuggcuacucugagaagaucugucaaauugauagacugauccacguuagcuccuggcuccggaaccauucucaguuucagggguaugugggacagcgcggcgggagaagccaaguguccuacuaucccgccgaaaauagcuacucucggugguccggacugcuuagcccuugcgacgcggauuggcugggcaugcucgucgugaaaaaggcuaaaggcucugacaugauuguucccgggccuuccuauaagggaaagguguucuuugagcgccccacauucgauggcuacgucggguggggauguggcagcgggaaaucuagaacggaauccggagagcugugcagcuccgacucuggcaccagcuccggccugcucccuagcgaucgggugcuguggaucggggacguugccugucagccgaugacacccauuccugaagagaccuuucuugagcugaagucuuucucccagagcgaauuucccgauaucugcaaaauugacggaaucguguucaaccagugugagucugaaagccucccucaacccuuugaugucgccuggauggacgugggccacucccauaagaucauuaugcgcgagcacaaaacaaagugggugcaggagucuagcuccaaggauuucgucugcuauaaagaagggaccggaccguguagcgagucugaagagaagacaugcaaaaccuccggcagcugcagaggggacaugcaguuuuguaagguugcuggaugcgaacacggcgaggaggccucugaagcuaaaugucggugcucccuggugcauaagccuggcgagguggucgugagcuacgggggaaugcgcguuagacccaaaugucacggcuucucccggaugauggccacgcuugaagugaauccucccgagcagcgcaucgggcaaugcaccggaugucaucuggaaugcauuaacggcggggucagacucaucacacugaccucugagcuuaagagcgcgacagugugugccucccacuuuugcucuagcgcuaccuccggcaagaaaagcacggagauucaguuccacucuggaucccucguuggcaaggccgcuauccaugugaaaggggcccuggucgacggaacagaguucaccuuugaaggcagcuguauguuccccgaugggugcgacgcgguggauugcacauuuugucgggaguuccuuaagaauccucagugcuacccggccaaaaaguggcuguuuaucauuaucgucauucuccugggauaugcuggccuuaugcugcucaccaacgugcugaaggccaucgggguuuggggcucuugggugauugcucccgucaaacugauguucgccaucaucaagaaacucaugcgcuccgugagcugucugaugggaaagcugauggacagaggccggcaaguuauucacgaagaaaucggggagaauagagagggaaaccaggaugacgugcgcauugaaaugguccggccuagacgcgugcggcauuggauguacucucccgugauccugaccauucucgccaucggccugacagaggggugcgaugaaaugguucacgcugacagcaaacuugucuccuguagacagggaagcggcaauaugaaggagugcgugacgaccgggcgcgcgcugcucccugccgugaaccccggccaggaggcuugucugcauuuuacagccccgggaucuccugauuccaagugccugaaaauuaaggucaaacggaucaaucucaaguguaaaaagagcuccucuuauuucgugcccgacgccagaagccgcugcaccuccguucggagaugucgcugggcuggcgauugccaaucugggugcccuagccacuuuacauccaacucuuucagcgacgacugggccggaaagauggaucgggcgggccugggguuuuccggauguagcgacggcugcgggggcgcugccuguggaugcuucaaugccgcucccucuuguaucuuuuggagaaaauggguggaaaacccucacggcauuaucuggaaggucucccccugcgccgcuugggugccgagcgccguuauugagcuuaccaugccuucuggggaagugcggacguuccaucccauguccggaauccccacacaggucuucaaaggcgugagcguuaccuaccuggggucugauauggagguguccggacucaccgaccugugugaaauugaggagcuuaagagcaaaaagcuggcgcucgccccuugcaaccaggcuggcaugggcgucguggggaaagugggagaaauccaguguuccagcgaggaaucugcccgcacaaucaagaaggauggcugcauuuggaaugcugaccuggucgggaucgagcugagaguugaugacgccguguguuauagcaaaauuaccuccguggaagcggucgccaacuacucugcuaucccgacaacgauuggaggccuccgguuugagagaagccacgauucccaagggaagaucucuggaagcccccuggacaucaccgccauucgcggcuccuucucugugaauuaucggggccuuagacugagccucuccgagaucacagcuaccugcacaggggaaguuaccaacgugagcggaugcuacucuuguaugacgggcgccaaagucuccauuaagcugcauagcucuaaaaauuccaccgcccacgugcgcugcaagggggaugagacagcuuuuagcguucuggaaggagugcacuccuacaccgucucucuuagcuucgaccaugcggugguugaugagcagugucagcucaacugcggcgggcacgaaucccaggugacacugaagggaaaucugaucuuucucgacgucccuaaauucguggacggcagcuauaugcaaaccuaccauucuuccgugcccacgggcgccaacauuccuagccccacagauuggcugaaugcucuuuuugggaacggacugucuagauggauccucggcgucaucgggguucugcugggaggccuugcccucuucuuucugauuaugagccuguucaagcucgggaccaaacagguguuucggucccgcacaaagcuggccuga

SEQ ID NO: 14787 - RNA, 3222 nt, Artificial Sequence
  derived and/or modified CDS sequence (opt5) from SFTSV(HB154/China/2011)__JQ733560.1__GP
augaugaaggugaucugguucagcucccugauuugccucgucauccaguguucuggcgacagcgggcccauuaucugcgccggaccuauucacuccaacaaaucugcuggcaucccgcaucugcuuggguacagcgagaagaucugucaaauugauagacugauccacguuuccucuuggcuccggaaucauagccaguuucagggauaugugggccagcgcgggggaagaucccaagugagcuacuaucccgccgaaaacucuuacucccgguggagcggccugcuuucuccuugcgacgcggauuggcugggcaugcucgucgugaaaaaggcuaaagaguccgacaugauuguucccgggccuagcuauaagggaaagguguucuuugaacgccccaccuucgauggcuacgucggguggggauguggcucugggaaauccagaacagagagcggagaacugugcuccucugacagcggcacguccagcggccugcucccuucugaucgggugcuguggaucggggacguugccugucagccgaugacccccauuccugaggagacauuucuugaacugaaguccuucagccagucugaguuucccgauaucugcaaaauugacggaaucguguucaaucagugugaaggcgagagccucccucaacccuuugaugucgccuggauggacguggggcacucccauaagaucauuaugcgcgagcacaaaaccaagugggugcaggaaucuagcuccaaggauuucgucugcuauaaagagggaacaggcccguguagcgaaucugaggaaaaggcuugcaaaaccuccgggagcugcagaggagacaugcaguuuuguaagguugccggcugcgagcacggcgaggaagcuagcgaggccaaaugucggugcucccuggugcauaagccuggggaaguggucgugagcuacggaggcaugcgcguuagacccaaauguuacggguucucccggaugauggcgacacuugaggugaacccucccgaacagcgcaucggacaaugcaccggcugucaccuggagugcauuaaugggggcgucagacucaucacgcugaccucugagcugcggagcgccacagugugugcuucccauuuuugcucuagcgccaccuccggaaagaagucuacagaaauucacuuccacucuggcucccucguugggaaaaccgcuauccaugugaagggagcccuggucgacggcacggaguucacauuugaagggagcuguauguuccccgauggaugcgacgcgguggauugcaccuuuugucgcgaguuccuuaaaaacccucagugcuauccggccaagaaauggcuguuuaucauuaucgucauucuccugggcuacgcugggcuuaugcugcucacaaaugugcugaaggccaucggcguuuggggaucuugggugauugcucccgucaagcugauguucgccaucaucaaaaagcucaugagaaccguguccugucugguuggcaaacuuauggaccgggggagacaggugauuaacgaagagaucggagagaauggcgaagggaaccaagaugacguccgcauugagauggcccggccuagacgcgugcggcacuggauguauagccccgugauccugaccauucucgcuaucggacuggcggaaggcugcgaugagaugguucaugccgacucuaagcuggucagcuguagacagggguccggcaauaugaaagagugcauuacaacgggacgcgcucugcucccugccgugaaccccggccaggaagccugucugcacuuuaccgcuccggggagcccugauucuaagugccugaagaucaaagugaagcggaucaaucucaaauguaagaaauccagcuccuacuucguccccgacgccagaucucgcugcacaagcgugcggagaugucgcugggcgggagauugccaguccggcugcccuccccauuuuaccucuaacagcuucuccgacgacugggcugggaagauggaucgggccggacugggcuuuucuggguguagcgacggcugcggaggcgccgcuugugggugcuucaaugccgcuccuuccuguaucuuuuggagaaaguggguugagaacccccacggaauuauuuggaaagugagcccgugcgccgcgugggucccuucugccgugaucgaacuuacaaugcccuccggcgagguucggaccuuccaccccaugagcgggauuccuacgcaaguguucaagggagucucugugacauaucugggcuccgauauggaaguuagcggccucaccgaccugugugagaucgaggaacugaaaucuaagaaacuugcucucgccccgugcaaccaggcugggaugggaguggucggcaaggugggggagauccaguguuccagcgaagaguccgcccgcaccauuaaaaaggauggaugcaucuggaaugcggaccuggugggcauugaacugagagucgaugacgccguuuguuacagcaagaucacaucuguggaggcuguggccaacuauagcgcuauucccaccacaaucgggggacuccgguuugagagaucccaugauucucagggcaaaaucagcggcuccccucuggacauuacggccauccgcgggucuuucagcgucaauuaccggggacuuagacugucccucucugaaauuaccgccacaugcaccggcgaggugacaaacguuagcgggugcuacuccuguaugaccggagcuaaggugagcaucaaacugcacucuuccaagaauagcacggcgcauguccgcugcaaaggcgaugaaaccgccuuuucugugcuggaggggguucacuccuauauugugagccuuuccuucgaccacgcugucguggaugaacaaugucagcucaacugcggaggccaugagucucagguuacacugaagggcaaucugaucuuucucgacgugcccaaguucgucgacgggagcuacaugcagaccuaucacuccacagugccuaccggagccaacauccccagcccuacggauuggcugaaugcccuuuuuggcaacgggcugucuagauggauucucggagugaucggcguccugcuugggggacuugcucucuucucccugauuauguuucugcucaaacugggcacaaagcaaguuuuccggagccgcaccaaacuugccuga

SEQ ID NO: 14788 - RNA, 3222 nt, Artificial Sequence
  derived and/or modified CDS sequence (opt5) from SFTSV(HB155/China/2011)__JQ733563.1__GP
augaugaaggugaucugguucagcucccugauuugccucgucauccaguguucuggcgacagcgggcccauuaucugcgccggaccuauucacuccaacaagucugcuggcaucccgcaucugcuuggguacagcgagaagaucugucaaauugauagacugauccacguuuccucuuggcuccggaaucauagccaguuucagggauaugugggccagcgcgggggaagaucccaagugagcuacuaucccgccgaaaacucuuacucccgguggagcggccugcuuucuccuugcgacgcggauuggcugggcaugcucgucgugaaaaaggcuaaagaguccgacaugauuguucccgggccuagcuauaagggaaagguguucuuugaacgccccaccuucgauggcuacgucggguggggauguggcucugggaaauccagaacagagagcggagaacugugcuccucugacagcggcacguccagcggccugcucccuucugaucgggugcuguggaucggggacguugccugucagccgaugacccccauuccugaggagacauuucuugaacugaaguccuucagccagucugaguuucccgauaucugcaaaauugacggaaucguguucaaucagugugaaggcgagagccucccucaacccuuugaugucgccuggauggacguggggcacucccauaagaucauuaugcgcgagcacaaaaccaagugggugcaggaaucuagcuccaaggauuucgucugcuauaaagagggaacaggcccguguagcgaaucugaggaaaaggcuugcaaaaccuccgggagcugcagaggagacaugcaguuuuguaagguugccggcugcgagcacggcgaggaagcuagcgaggccaaaugucggugcucccuggugcauaagccuggggaaguggucgugagcuacggaggcaugcgcguuagacccaaauguuacggguucucccggaugauggcgacacuugaggugaacccucccgaacagcgcaucggacaaugcaccggcugucaccuggagugcauuaaugggggcgucagacucaucacgcugaccucugagcugcggagcgccacagugugugcuucccauuuuugcucuagcgccaccuccggaaagaagucuacagaaauucacuuccacucuggcucccucguugggaaaaccgcuauccaugugaagggagcccuggucgacggcacggaguucacauuugaagggagcuguauguuccccgauggaugcgacgcgguggauugcaccuuuugucgcgaguuccuuaaaaacccucagugcuauccggccaagaaauggcuguuuaucauuaucgucauucuccugggcuacgcugggcuuaugcugcucacaaaugugcugaaggccaucggcguuuggggaucuugggugauugcucccgucaagcugauguucgccaucaucaaaaagcucaugagaaccguguccugucugguuggcaaacuuauggaccgggggagacaggugauucacgaagagaucggagagaacggcgaagggaaucaagaugacguccgcauugagauggcccggccuagacgcgugcggcauuggauguauagccccgugauccugaccauucucgcuaucggacuggcggaaggcugcgaugagaugguucacgccgacucuaagcuggucagcuguagacagggguccggcaacaugaaagagugcauuacaacgggacgcgcucugcucccugccgugaaucccggccaggaagccugucugcauuuuaccgcuccggggagcccugauucuaagugccugaagaucaaagugaagcggaucaaccucaaauguaagaaauccagcuccuacuucguccccgacgccagaucucgcugcacaagcgugcggagaugucgcugggcgggagauugccaguccggcugcccuccccacuuuaccucuaauagcuucuccgacgacugggcugggaagauggaucgggccggacugggcuuuucuggguguagcgacggcugcggaggcgccgcuugugggugcuucaacgccgcuccuuccuguaucuuuuggagaaaguggguugagaauccccacggaauuauuuggaaagugagcccgugcgccgcgugggucccuucugccgugaucgaacuuacaaugcccuccggcgagguucggaccuuccaucccaugagcgggauuccuacgcaaguguucaagggagucucugugacauaucugggcuccgauauggaaguuagcggccucaccgaccugugugagaucgaggaacugaaaucuaagaaacuugcucucgccccgugcaaccaggcugggaugggaguggucggcaaggugggggagauccaguguuccagcgaagaguccgcccgcaccauuaaaaaggauggaugcaucuggaacgcggaccuggugggcauugaacugagagucgaugacgccguuuguuacagcaagaucacaucuguggaggcuguggccaauuauagcgcuauucccaccacaaucgggggacuccgguuugagagaucccacgauucucagggcaaaaucagcggcuccccucuggacauuacggccauccgcgggucuuucagcgucaacuaccggggacuuagacugucccucucugaaauuaccgccacaugcaccggcgaggugacaaauguuagcgggugcuacuccuguaugaccggagcuaaggugagcaucaaacugcauucuuccaagaacagcacggcgcacguccgcugcaaaggcgaugaaaccgccuuuucugugcuggaggggguucacuccuauauugugagccuuuccuucgaccaugcugucguggaugaacaaugucagcucaauugcggaggccacgagucucagguuacacugaagggcaaccugaucuuucucgacgugcccagauucgucgacgggagcuacaugcagaccuaucauuccacagugccuaccggagccaauauccccagcccuacggauuggcugaacgcccuuuuuggcaaugggcugucucgguggauucucggagugaucggcguccugcuugggggacuugcucucuucuuucugauuauguuccugcucaagcugggcacaaaacaaguuuuucgcuccagaaccaaacuugccuga

SEQ ID NO: 14789 - RNA, 3222 nt, Artificial Sequence
  derived and/or modified CDS sequence (opt5) from SFTSV(HB156/China/2011)__JQ733566.1__GP
augaugaaggugaucugguucagcucccugauuugccucgucauccaguguucuggcgacagcgggcccauuaucugcgccggaccuauucacuccaacaaaucugcuggcaucccgcaucugcuuggguacagcgagaagaucugucaaauugauagacugauccacguuuccucuuggcuccggaaucauagccaguuucagggauaugugggccagcgcgggggaagaucccaagugagcuacuaucccgccgaaaacucuuacucccgguggagcggccugcuuucuccuugcgacgcggauuggcugggcaugcucgucgugaaaaaggcuaaagaguccgacaugauuguucccgggccuagcuauaagggaaagguguucuuugaacgccccaccuucgauggcuacgucggguggggauguggcucugggaaauccagaacagagagcggagaacugugcuccucugacagcggcacguccagcggccugcucccuucugaucgggugcuguggaucggggacguugccugucagccgaugacccccauuccugaggagacauuucuugaacugaaguccuucagccagucugaguuucccgauaucugcaaaauugacggaaucguguucaaucagugugaaggcgagagccucccucaacccuuugaugucgccuggauggacguggggcacucccauaagaucauuaugcgcgagcacaaaaccaagugggugcaggaaucuagcuccaaggauuucgucugcuauaaagagggaacaggcccguguagcgaaucugaggaaaaggcuugcaaaaccuccgggagcugcagaggagacaugcaguuuuguaagguugccggcugcgagcacggcgaggaagcuagcgaggccaaaugucggugcucccuggugcauaagccuggggaaguggucgugagcuacggaggcaugcgcguuagacccaaauguuacggguucucccggaugauggcgacacuugaggugaacccucccgaacagcgcaucggacaaugcaccggcugucaccuggagugcauuaaugggggcgucagacucaucacgcugaccucugagcugcggagcgccacagugugugcuucccauuuuugcucuagcgccaccuccggaaagaagucuacagaaauucacuuccacucuggcucccucguugggaaaaccgcuauccaugugaagggagcccuggucgacggcacggaguucacauuugaagggagcuguauguuccccgauggaugcgacgcgguggauugcaccuuuugucgcgaguuccuuaaaaacccucagugcuauccggccaagaaauggcuguuuaucauuaucgucauucuccugggcuacgcugggcuuaugcugcucacaaaugugcugaaggccaucggcguuuggggaucuugggugauugcucccgucaagcugauguucgccaucaucaaaaagcucaugagaaccguguccugucugguuggcaaacuuauggaccgggggagacaggugauucacgaagagaucggagagaacggcgaagggaaucaagaugacguccgcauugagauggcccggccuagacgcgugcggcauuggauguauagccccgugauccugaccauucucgcuaucggacuggcggaaggcugcgaugagaugguucacgccgacucuaagcuggucagcuguagacagggguccggcaacaugaaagagugcauuacaacgggacgcgcucugcucccugccgugaaucccggccaggaagccugucugcauuuuaccgcuccggggagcccugauucuaagugccugaagaucaaagugaagcggaucaaccucaaauguaagaaauccagcuccuacuucguccccgacgccagaucucgcugcacaagcgugcggagaugucgcugggcgggagauugccaguccggcugcccuccccacuuuaccucuaauagcuucuccgacgacugggcugggaagauggaucgggccggacugggcuuuucuggguguagcgacggcugcggaggcgccgcuugugggugcuucaacgccgcuccuuccuguaucuuuuggagaaaguggguugagaauccccacggaauuauuuggaaagugagcccgugcgccgcgugggucccuucugccgugaucgaacuuacaaugcccuccggcgagguucggaccuuccaucccaugagcgggauuccuacgcaaguguucaagggagucucugugacauaucugggcuccgauauggaaguuagcggccucaccgaccugugugagaucgaggaacugaaaucuaagaaacuugcucucgccccgugcaaccaggcugggaugggaguggucggcaaggugggggagauccaguguuccagcgaagaguccgcccgcaccauuaaaaaggauggaugcaucuggaacgcggaccuggugggcauugaacugagagucgaugacgccguuuguuacagcaagaucacaucuguggaggcuguggccaauuauagcgcuauucccaccacaaucgggggacuccgguuugagagaauccacgauucccagggcaaaauuucuggcagcccucuggacaucacggccauucgcggguccuucucugucaacuaccggggacuuagacugagccucuccgaaaucaccgccacaugcaccggcgaggugacaaauguuucugggugcuacagcuguaugaccggagcuaagguguccauuaaacugcauagcucuaagaacuccacggcgcacguccgcugcaaaggcgaugaaaccgccuuuagcgugcuggaggggguucacucuuauaucgugucccuuagcuucgaccaugcugucguggaugaacaaugucagcucaauugcggaggccacgagucccagguuacacugaagggcaaccugaucuuucucgacgugcccaaguucgucgacgggucuuacaugcagaccuaucauagcacagugccuaccggagccaauauucccuccccuacggauuggcugaacgcccuuuuuggcaaugggcugagcagauggauccucggagugauuggcguccugcuugggggacuugcucucuucuuucugaucauguuccugcucaaacugggcacaaagcaaguuuuucggucucgcaccaaacuugccuga

SEQ ID NO: 14790 - RNA, 3222 nt, Artificial Sequence
  derived and/or modified CDS sequence (opt5) from SFTSV(HB2014-04)__KR080475.1__GP
augaugaaggugaucugguuccccagccugauuugcuuugucauccaguguuccggcgacucugggccuauuaucugcgccggaccgauucacagcaacaaauccgcugauaucccccaucuccugggcuacucugagaagaucugucaaauugacagacuuauccacguuagcuccuggcugcggaaucauucucaguuccagggguaugugggacagcgcggcgggagaagccacguguccuacuauccugccgaaaacagcuacucucggugguccggacuccugagccccugcgaugcggacuggcuuggcaugcuggucgugaaaaaggcuaaaggcucugauaugauuguuccugggcccuccuauaagggaaagguguuuuucgagcgcccuaccuuugacggcuacgucggguggggauguggcagcgggaaaucuagaacagaauccggagagcucugcagcuccgauucuggcacgagcuccggccugcugccgagcgaccgggugcucuggaucggggauguugccugucaacccaugaccccuauucccgaagagacauuccuggagcuuaagucuuuuucccagagcgaauuuccugacaucugcaaaauugauggaaucguguuuaaucagugugagggcgaaucucugccccagccguucgacgucgccuggauggauguggggcauagccacaagaucauuaugcgcgagcacaaaaccaagugggugcaagaguccucuagcaaggacuuugucugcuauaaagaaggaacaggcccuuguuccgagagcgaagagaagaccugcaaaacaucuggguccugcagaggagacaugcaguucuguaagguugcuggcugcgaacauggcgaggaggccagcgaagcuaaaugucggugcucucucgugcacaagcccggggagguggucguguccuacggaggcaugcgcguuagaccuaaauguuacggguuuagccggaugauggccacccuggaagugaaccagcccgagcagcgcaucggacaaugcacgggcugucaucuugaaugcauuaaugggggcgucagacugaucacccucacauccgagcugaagucugcgaccgugugugccagccacuucugcuccucugcuacaagcggaaagaaauccaccgagauucaguuccacagcggcucucugguugggaagacggccauccaugugaaaggagcucucgucgauggcacagaauuuaccuucgagggguccuguauguuucccgacggaugcgaugccguggacugcacauucugucgggaauuucugaagaacccucagugcuauccggcgaaaaaguggcuuuucaucauuaucgucauucugcucggcuacgccgggcugaugcuucugaccaaugugcucaaggcuaucggcauuuggggaagcuggguuaucgcccccgugaaacugaucuuugcuauuaucaagaaacugaugcgcaccgucucuugucucaugggcaagcugauggauagagggcggcaagugauucacgaggaaaucggagagaacagagagggcaaucaggacgauguucgcauugaaauggcccggccuagacgcgugcggcauuggauguauucccccgucauccuuacaauucuggccaucgggcucgcugagagcugcgacgaaauggugcacgcggauucuaaacuggugagcuguagacagggauccggcaacaugaaggagugcguuacgaccgggcgcgcccuucugccugcugucaaucccggccaggaggccugucuccauuucacagccccgggaagcccugacucuaagugccugaaaaucaaggugaaacggauuaaccugaaguguaaaaaguccagcuccuacuuugugcccgaugcuagaucucgcugcaccagcguccggagaugucgcugggccggcgacugccaauccgggugcccuccccacuucacaucuaauagcuuuuccgacgauugggcgggaaagauggaccgggcuggccucggguucucuggauguagcgauggcugcgggggcgccgccuguggaugcuuuaacgcugccccuuccuguaucuucuggagaaaauggguggaaaauccccacggcauuaucuggaagguuagcccgugcgcugccugggugccuucugcggucauugagcugaccaugcccuccggggaagugcggacguuccaucccaugagcggaaucccuacacagguuuuuaaaggcgugucugucaccuaucuuggguccgacauggaggugagcggacugaccgaucucugugaaaucgaggagcugaagucuaaaaagcuggcccuugcuccgugcaaccaggccggcaugggcguuguggggaaagucggagaaauucaguguuccagcgaggaauccgcucgcacaaucaagaaggacggcugcauuuggaacgccgaucucguggggaucgagcugagaguggacgaugcggucuguuacagcaaaauuaccucuguugaagccguggcuaauuauagcgccauccccacaacgaucggaggccugcgguucgagagaucccacgacucucaagggaagauuagcggauccccucucgauaucaccgcuauucgcggcucuuuuagcgugaacuaccggggccugagacuuucccugucugagaucacagcuaccugcacaggggaagucaccaaugugagcggaugcuacuccuguaugacgggcgccaaaguuagcauuaagcuccauucuuccaaaaacagcaccgcccacgugcgcugcaagggggacgagacagcguucucuguccuggaaggagugcacuccuauaccguuagccuguccuuugaucaugccguggucgacgagcagugucagcuuaauugcggcgggcacgaaucucaggugacacucaagggaaaccugaucuuccuggacguucccaaauuuguggauggcagcuacaugcaaaccuaucauuccacggucccuacaggcgcuaauauccccagcccuaccgacuggcucaacgcccuguucgggaauggacuuucuagauggauucugggcgugaucggggugcuccugggaggccuggcccuuuucuucaugauuaugucccucuuuaagcuggggacaaaacaggucuuccggagccgcucuaagcuggcuuga

SEQ ID NO: 14791 - RNA, 3222 nt, Artificial Sequence
  derived and/or modified CDS sequence (opt5) from SFTSV(HNXH)__KT254590.1__GP
augaugaaggugaucugguucagcucccugauuugccucgucauccaguguggcggggacaccggacccauuaucugcgccggcccuauucacucuaacaaaagcgcugauaucccgcaucugcuuggguacuccgagaagaucugucaaauugacagacugauccacguuucuagcuggcuccggaaucauucccaguuucagggauaugugggccagcgcgggggaagaucucaagugagcuacuaucccgccgaaaacuccuacagccgguggucuggccugcuuuccccuugcgaugcggacuggcugggcaugcucgucgugaaaaaggcuaaagggagcgauaugauuguucccggaccuucuuauaagggcaagguguucuuugagcgccccacauucgacggguacgucggauggggcuguggguccggaaaaagcagaacggaaucuggcgagcugugcuccagcgauuccggcaccucuagcgggcugcucccuuccgaccgggugcuguggaucggagauguugccugucagccgaugacacccauuccugaagagaccuuucuugagcucaagagcuucucucaguccgaauuucccgacaucugcaaaauugauggcaucguguucaaucagugugagggggaaagccugccucaacccuuugacgucgccuggauggaugugggacacucucauaagaucauuaugcgcgagcacaaaacaaagugggugcaggagagcuccucuaaggacuucgucugcuauaaagaaggcaccgggccguguagcgaguccgaagagaagacaugcaaaaccagcggaucuugcagaggcgacaugcaguuuuguaagguugcuggcugcgaacacggggaggaggccuccgaagcuaaaugucggugcagccuggugcauaagccuggagagguggucgugucuuacggcgggaugcgcguuagacccaaauguuacggauucucccggaugauggccacgcuugaagugagccagccugagcaacgcaucggccagugcaccgggugucaccuggaaugcauuaacggcggagucagacucaucacacugaccuccgagcugaagucugcgacagugugugccagccauuuuugcuccucugcuaccagcggcaagaaauccacggagauucaguuccacagcgggucucucguuggaaagacagccauccacgugaaaggcgcucuggucgaugggaccgaguucacauuugaaggauccuguauguuccccgacggcugcgaugccguggacugcaccuuuugucgggaguuccuuaagaauccccaaugcuauccugcgaaaaaguggcuguuuaucauuaucgucauucuccugggguacgccggccuuaugcugcucaccaacgugcugaaggcuaucggaguuuggggcagcugggugauugccccggucaaacugguguucgcucucaucaagaaacugaugcgcgccguuucuugucuuauggggaagcugauggauagaggaagacaggugauccaugaagaaauuggcgagaaucgggaggggaaccaggacgauguccgcaucgaaauggcccggcccagacgcgugcggcacuggauguauuccccugugauucucacaauccuggcuauuggacuugcggagggcugcgacgaaaugguucaugccgauagcaaacuggucucuuguagacaggggagcggcaauaugaaggagugcgugacgaccggacgcgcucuccugcccgccgugaacccuggccaagaggccugucugcacuuuacagcucccggguccccggacagcaagugccucaaaaucaaggucaaacggauuaaucugaaguguaaaaagucuuccagcuacuucgugccugaugccagaucccgcugcaccucuguucggagaugucgcugggcgggagacugccagagcggcugucccccucauuuuacauccaacucuuucagcgacgauugggcugggaagauggaccgggccggacuuggcuuuuccgggugcucugauggcugcggaggcgccgcuugugggugcuucaaugccgcucccagcuguaucuuuuggagaaaauggguggaaaacccucacggaaucauuuggaaggucucccccugcgccgcgugggugccgagcgccguuaucgagcugaccaugccuucuggcgaagugcggacguuccaccccauguccgggauucccacacaggucuucaaaggagugagcguuaccuaucucggcucugacauggagguguccggccugaccgaucugugugaaaucgaggagcuuaagagcaaaaagcucgcucuggccccuugcaaucaggcugggaugggagucgugggcaaagugggggaaauucaauguucuuccgaggaaagcgcccgcacaaucaagaaggacggaugcaucuggaacgcggaucuggucggcauugagcucagaguugacgaugccguguguuacuccaaaaucaccagcguggaagcugucgccaacuauucugcuauuccgacaacgaucgggggacugcgguuugagagaagccaugacucccagggcaagauuucuggcagcccccuugauaucaccgccauccgcggguccuucucugugaauuaccggggacugagacucagccuguccgagauuacagcuaccugcacaggcgaaguuaccaacgugucugggugcuacagcuguaugacgggagccaaagucuccaucaagcugcacagcucuaaaaauuccaccgcgcaugugcgcugcaagggcgacgagacagccuuuagcguucuugaaggggugcacucuuauuccgucagccucuccuucgaucacgcugugguugacgagcagugucagcugaacugcggaggccaugaaucucaagugacccugagaggcaaucucauuuuucuggacgucccuaaguucguggaugggagcuacaugcagacauaucacuccaccgugcccacgggagccaacaucccuagccccacagacuggcuuaaugcccuguuuggcaacgggcucucucgguggauucugggagucaccggcguucugcuugggggacucgcucuguucuuucugaucaugucccucuucaaacugggcacaaagcagaucuuucgcagcagaaccaaacuugccuga

SEQ ID NO: 14792 - RNA, 3222 nt, Artificial Sequence
  derived and/or modified CDS sequence (opt5) from SFTSV(JS2012-goat01)__KC473538.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuccuggagcuuaaguccuuuagccagucugaguuccccgacaucugcaaaauugauggaaucguguuuaaucagugugaaggcgaaagccugccucaacccuucgacgucgccuggauggauguggggcacucccauaagaucauuaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcaucagacccaaauguuacggguuuucccggaugauggccacccuggaaguuaaccagccugagcaacgccuuggacagugcacgggcugucaccuggaaugcauuaaugggggcgugagacucaucacccugacaucugagcuuaagagcgcgaccgucugugccucccauuucugcucuagcgcuacauccggaaagaaaagcaccgagauucaguuccacucuggcucccucguggggaagacggccauccacguuaaaggagcucugguggauggcacagaauuuaccuucgaggggagcuguauguuucccgacggaugcgaugccgucgacugcacauucugucgggaauuucuuaagaacccccaaugcuauccugcgaaaaaguggcuguucaucauuaucgugauucuccugggcuacgccgggcuuaugcugcucaccaauguccugaaggcuaucggcauuuggggaucuugggugaucgccccgguuaaacugauguuugcuaucauuaagaaacucaugcgcaccguguccugucugaugagaaagcugauggaucggggcagacaggucauccaugaggaaauuggggagaaccgcgagggaaaucaggacgaugugcggaucgaaauggccagaccccgccggguuagacacuggauguauagcccugugauucugacaauccucgccauuggccuggcugagucuugcgacgaaaugguccaugcggauagcaaacuuguguccugucgccaggggagcggaaacaugaaggagugcgugacgaccggccgggcccugcuccccgcuguuaauccugggcaagaggccugucugcacuucacagcccccggcucuccggacuccaagugccugaaaaucaaggucaaaagaaucaaccucaaguguaaaaagagcuccucuuacuuugugccugaugcucgcagccggugcaccuccgugagacgcugucggugggccggagacugccagucuggcugucccccucauuucacaagcaauuccuuuucugacgauugggcggggaagauggacagagcuggacugggcuucagcgggugcuccgauggaugcggcggggccgccuguggcugcuuuaacgcugcccccagcuguauuuucuggcggaaaugggucgaaaauccucacggaaucauuuggaaggugucucccugcgcugccuggguuccguccgcggugaucgagcuuaccaugccuagcggcgaaguccgcacguuccaccccaugucugggauucccacacagguguuuaaaggaguuuccgugaccuaucugggcagcgacauggaggucucugggcucaccgaucugugugaaaucgaggagcugaaguccaaaaagcucgcccuugcuccuugcaaccaggccggaaugggcgugguuggcaaagugggggaaauccaauguagcuccgaggaaagcgcuagaacaauuaagaaggacggaugcaucuggaacgccgaucuggucggcauugagcugcggguggacgaugcgguguguuacucuaaaaucaccagcgucgaagccguugcuaauuauuccgccauuccgacaacgaucgggggacucagauucgagcgcucucuggacagccagggcaagaucuccgggucuccccuugauauuaccgcuauccggggcagcuuuuccgugaacuacagaggacugcgccucucucugagcgagauuacagcuaccugcacaggcgaagugaccaaugucuccgggugcuacagcuguaugacgggagccaaagugucuaucaagcugcauuccagcaaaaacucuaccgcccacguuagaugcaagggcgacgagacagcguucuccgugcuugaagggguccauagcuauaccgugucccucucuuuugaucacgccguuguggacgagcagugucagcugaauugcggaggccacgaaagccaagucacacugaaggggaaccucauuuuccuggacgugccuaaauuuguugauggauccuacaugcagaccuaucauagcacggugcccacaggcgcuaauaucccuucucccaccgacuggcuuaacgcccuguucggcaaugggcucucccgguggauccugggagucauuggcgugcugcuugggggacucgcccuguuuuucaugaucaugagccuguuuaagcucggcacaaaacagguguuccgcucuagaaccaagcuggcuuga

SEQ ID NO: 14793 - RNA, 3222 nt, Artificial Sequence
  derived and/or modified CDS sequence (opt5) from SFTSV(JS2012-tick01)__KC473541.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuccuggagcuuaaguccuuuagccagucugaguuccccgacaucugcaaaauugauggaaucguguuuaaucagugugaaggcgaaagccugccucaacccuucgacgucgccuggauggauguggggcacucccauaagaucauuaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcguuagacccaaauguuacggguuuucccggaugauggccacccuggaagugaaccagccugagcaacgccuuggacagugcacgggcugucaccuggaaugcaucaaugggggcgucagacucauuacccugacaucugagcuuaagagcgcgaccgugugugccucccauuucugcucuagcgcuacauccggaaagaaaagcaccgagauccaguuccacucuggcucccucguugggaagacggccauucacgugaaaggagcucuggucgauggcacagaauuuaccuucgaggggagcuguauguuucccgacggaugcgaugccguggacugcacauucugucgggaauuucuuaagaacccccaaugcuauccugcgaaaaaguggcuguucaucaucauugucauccuccugggcuacgccgggcuuaugcugcucaccaaugugcugaaggcuauuggcaucuggggaucuuggguuauugccccggugaaacugauguuugcuaucaucaagaaacucaugcgcaccgucuccugucugaugagaaagcugauggaucggggcagacaggugauucaugaggaaaucggggagaaccgcgagggaaaucaggacgauguucggauugaaauggccagaccccgccgggugagacacuggauguauagcccugucauccugacaauucucgccaucggccuggcugagucuugcgacgaaauggugcaugcggauagcaaacuuguguccugucgccaggggagcggaaacaugaaggagugcguuacgaccggccgggcccugcuccccgcugucaauccugggcaagaggccugucugcacuucacagcccccggcucuccggacuccaagugccugaaaauuaaggugaaaagaaucaaccucaaguguaaaaagagcuccucuuacuuugugccugaugcucgcagccggugcaccuccgucagacgcugucggugggccggagacugccagucuggcugucccccucauuucacaagcaauuccuuuucugacgauugggcggggaagauggacagagcuggacugggcuucagcgggugcuccgauggaugcggcggggccgccuguggcugcuuuaacgcugcccccagcuguaucuucuggcggaaauggguggaaaauccucacggaauuaucuggaagguuucucccugcgcugccugggugccguccgcggucauugagcuuaccaugccuagcggcgaagugcgcacguuccaccccaugucugggauccccacacagguuuuuaaaggaguguccgucaccuaucugggcagcgacauggaggugucugggcucaccgaucugugugaaauugaggagcugaaguccaaaaagcuggcccucgcuccuugcaaccaggccggaaugggcguugugggcaaagucggggaaauccaauguagcuccgaggaaagcgcuagaacaaucaagaaggacggaugcauuuggaacgccgaucuggugggcaucgagcugcggguggacgaugcggucuguuacucuaaaauuaccagcguugaagccguggcuaauuauuccgccaucccgacaacgauugggggacucagauucgagcgcucucaugacagccagggcaagaucuccgggucuccccuggauaucaccgcuauucggggcagcuuuuccgugaacuacagaggacuucgccugucucucagcgagaucacagcuaccugcacaggcgaagucaccaauguguccgggugcuacagcuguaugacgggagccaaaguuucuauuaagcugcacuccagcaaaaacucuaccgcccaugugagaugcaagggcgacgagacagcguucuccguccuggaaggggugcacagcuauaccguuucccuuucuuuugaucacgccguggucgacgagcagugucagcucaauugcggaggccaugaaagccaagugacacugaaggggaaccugaucuuccucgacguuccuaaauuuguggauggauccuacaugcagaccuaucacagcacgguccccacaggcgcuaauauuccuucucccaccgacuggcugaacgcccuuuucggcaaugggcugucccgguggauccucggagugaucggcgugcugcuugggggacuugcccucuuuuucaugauuaugagccuguuuaagcugggcacaaaacaggucuuccgcucuagaaccaagcucgcuuga

SEQ ID NO: 14794 - RNA, 3222 nt, Artificial Sequence
  derived and/or modified CDS sequence (opt5) from SFTSV(LN2012-14)__KF887436.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuccuggagcuuaaguccuuuagccagucugaguuccccgacaucugcaaaauugauggaaucguguuuaaucagugugaaggcgaaagccugccucaacccuucgacgucgccuggauggauguggggcacucccauaagaucauuaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcguuagacccaaauguuacggguuuucccggaugauggccacccuggaagugaaccagccugagcaacgcaucggacagugcacgggcugucaccuugaaugcauuaaugggggcgucagacugaucacccucacaucugagcuuaagagcgcgaccgugugugccucccauuucugcucuagcgcuacauccggaaagaaaagcaccgagauucaguuccacucuggcucccugguugggaagacggccauccacgugaaaggagcucucgucgauggcacagaauuuaccuucgaggggagcuguauguuucccgacggaugcgaugccguggacugcacauucugucgggaauuucugaagaacccccaaugcuauccugcgaaaaaguggcuuuucaucauuaucgucauucugcucggcuacgccgggcugaugcuucugaccaaugugcucaaggcuaucggcauuuggggaucuuggguuaucgccccggugaaacugaucuuugcuauuaucaagaaacugaugcgcaccgucuccugucucaugggcaagcugauggauagagggagacaggugauucaugaggaaaucggagagaaccgggagggcaaucaggacgauguuuggauugaaauggcccgcccccggagagugcgcuauuggauguacagcccugucauccuuacaauucuggccguggggcucgcugagucuugcgacgaaauggugcacgcggauagcaaacugguuuccugucggcagggaagcggcaacaugaaggagugcgucacgaccgggagagcccuucugcccgcugugaauccuggccaagaggccugucuccauuucacagcccccggaucuccggacuccaagugccugaaaauccgcgugaagcggaucaaccugaaauguaagaaaagcuccucuuauuuugucccugaugcuagaagccgcugcaccuccgugcggagaugucgcugggccggcgacugccagucugggugucccccucacuucacaagcaauuccuuuucugacgauuggguuggaaagauggaccgggcgggccucggguucagcggaugcuccgauggcugcgggggcgcugccuguggaugcuuuaacgccgcucccagcuguauuuucuggagaaaguggguggaaaauccucauggcaucauuuggaaagucucucccugcgccgcuugggugccguccgccguuaucgagcugaccaugccuagcggggaagugcggacguuccaccccaugucuggcauucccacacaggucuuuaagggaguguccguuaccuaccuugggagcgacauggaggugucuggacugaccgaucucugugaaaucgaggagcugaaauccaagaaacuggcgcuugccccuugcaaccaggcuggcaugggcgucguggggaaggugggagaaauccaauguagcuccgaggaaagcgcccgcacaauuaaaaaggacggcugcaucuggaacgcugaucucgucgggauugagcugagaguugacgaugccguguguuauucuaagaucaccagcguggaagcggucgccaauuacuccgcuauuccgacaacgaucggaggccugcgguucgagagaucucacgacagccaggggaaaaucuccggaucuccccucgauauuaccgccauccgcggcagcuuuuccgugaacuaccggggccugagacuuucucugagcgagauuacagcuaccugcacaggggaaguuaccaauguguccggaugcuauagcuguaugacgggcgccaaggucucuaucaaacuccauuccaacaagaauagcaccgcccacgugcgcugcaaaggggacgagacagcuuucucuguucuggaaggagugcauuccuacaccgucagccuguccuuugaucacgcggugguugacgagcagugucagcuuaacugcggcgggcacgaaucucaagugacacucaagggaaaucugauuuuccuggacgucccuaaguuuguggauggcagcuauaugcagaccuaccauuccacggugcccacaggcgccaacaucccuagccccaccgacuggcucaaugcucuguucgggaacggacuuucuagauggauccugggcgucauugggguucuccugggaggccuggcccuguuuuucaugaucaugucccucuuuaaacuggggacaaaacagguguuccggagccgcaccaagcuggccuga

SEQ ID NO: 14795 - RNA, 3222 nt, Artificial Sequence
  derived and/or modified CDS sequence (opt5) from SFTSV(LN2012-34)__KF887437.1__GP
augaugaaggugaucugguucuuuagccugauuugcuucgucauccaguguuccggcgacucugggcccauuaucugcgccggaccuauucacagcaacaaauccgcugauaucccgcaucuccugggcuacucugagaagaucugucaaauugacagacuuauccacguuagcuccuggcugcggaaucauucucaguuucagggguaugugggacagcgcggcgggagaagccaaguguccuacuaucccgccgaaaacagcuacucucggugguccggacuccugagcccuugcgaugcggacuggcuuggcaugcuggucgugaaaaaggcuaaaggcucugauaugauuguucccgggccuuccuauaagggaaagguguucuuugagcgccccaccuucgacggcuacgucggguggggauguggcagcgggaaaucuagaacagaauccggagagcucugcagcuccgauucuggcacgagcuccggccugcugccuagcgaccgggugcucuggaucggggauguugccugucagccgaugacccccauuccugaagagacauuucuggagcuuaagucuuucucccagagcgaauuucccgacaucugcaaaauugauggaaucguguucaaucagugugagggcgaaucucugccucaacccuuugacgucgccuggauggauguggggcacagccauaagaucauuaugcgcgagcacaaaaccaagugggugcaggaguccucuagcaaggacuucgucugcuauaaagaaggaacaggcccguguuccgagagcgaagagaagaccugcaaaacaucuggguccugcagaggagacaugcaguuuuguaagguugcuggcugcgaacacggcgaggaggccagcgaagcuaaaugucggugcucucucgugcauaagccuggggagguggucguguccuacggaggcaugcgcaucagacccaaauguuacggguucagccggaugauggccacccuggaaguuaaccagccugagcaacgcauuggacagugcacgggcugucaccuugaaugcaucaaugggggcgugagacugauuacccucacauccgagcugaagucugcgaccgucugugccagccauuucugcuccucugcuacaagcggaaagaaauccaccgagauccaguuucacagcggcucucugguggggaagacggccauccacguuaaaggagcucucguggauggcacagaguucaccuuugaaggguccuguauguuccccgacggaugcgaugccgucgacugcacauuuugucgggaguuccugaagaacccccaaugcuauccugcgaaaaaguggcuuuuuauuaucauugugauccugcucggcuacgccgggcugaugcuucugaccaauguccucaaggcuauuggcaucuggggaagcugggugaucgccccgguuaaacugauuuucgcuaucauuaagaaacugaugcgcaccgugucuugucucaugggcaagcugauggauagagggcggcaggucauccaugaagaaauuggagagaacagagagggcaaucaggacgaugugcgcaucgaaauggcccggcccagacgcguucggcacuggauguauuccccugugauucuuacaauccuggccaucgggcucgcugagagcugcgacgaaaugguccaugcggauucuaaacuggugagcuguagacagggauccggcaacgugaaggagugcguuacgaccgggcgcgcccuucugcccgcugucaauccuggccaagaggccugucuccacuuuacagcccccggaagcccggacucuaagugccugaaaauucgggugaagagaaucaaccugaaauguaagaaauccagcuccuacuucgugccugaugcucgcucucggugcaccagcgucagacgcugucggugggccggcgacugccaguccgggugucccccucauuuuacaucuaauagcuucuccgacgauugggcgggaaagauggacagagcuggccucggguuuucuggaugcagcgauggcugcgggggcgccgccuguggaugcuucaacgcugcccccuccuguauuuucuggcggaaguggguggaaaauccucacggcaucauuuggaaaguuagccccugcgcugccugggugccgucugcggucaucgagcugaccaugccuuccggggaagugcgcacguuucaccccaugagcggaauccccacacagguuuucaagggcgugucuauuaccuaucuuggguccgacauggaggucagcggacugaccgaucucugugaaaucgaggagcugaaaucuaagaaacuggcccuugcuccuugcaaccaggccggcaugggcgugguugggaaggugggagaaauucaauguuccagcgaggaauccgcuagaacaaucaaaaaggacggcugcauuuggaacgccgaucucgucgggaucgagcugcggguggacgaugcgguguguuacagcaagaucaccucugucgaagccguugcuaauuauagcgccauuccgacaacgaucggaggccugagauuugagcgcucccaugacucucaggggaaaauuagcggaucuccccucgauaucaccgcuauucggggcuccuucagcgugaacuacagaggccugcgccuuucccugucugagaucacagcuaccugcacaggggaagugaccaaugucagcggaugcuacuccuguaugacgggcgccaaggugagcaucaaacuccacucuaacaaaaauuccaccgcccauguuagaugcaagggggacgagacagcguuuagcgugcuggaaggaguccacucuuauaccgugucccugagcuucgaucacgccguuguggacgagcagugucagcuuaacugcggcgggcaugaaucccaagucacacucaagggaaaucugauuuuucuggacgugccuaaguucguugauggcucuuacaugcagaccuaucacagcacggugcccacaggcgcuaacaucccuucccccaccgacuggcucaaugcccuguuugggaacggacuuagccgguggauucugggcgucaucggggugcuccugggaggccuggcccuuuucuuuaugauuaugucucucuucaaacuggggacaaaacagguguuucgcuccagaaccaagcuggcuuga

SEQ ID NO: 14796 - RNA, 3222 nt, Artificial Sequence
  derived and/or modified CDS sequence (opt5) from SFTSV(LN2012-41)__KF887438.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuccuggagcuuaaguccuuuagccagucugaguuccccgacaucugcaaaauugauggaaucguguuuaaucagugugaaggcgaaagccugccucaacccuucgacgucgccuggauggauguggggcacucccauaagaucauuaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcguuagacccaaauguuacggguuuucccggaugauggccacccuggaagugaaccagccugagcaacgcaucggacagugcacgggcugucaccuugaaugcauuaaugggggcgucagacugaucacccucacaucugagcuuaagagcgcgaccgugugugccucccauuucugcucuagcgcuacauccggaaagaaaagcaccgagauucaguuccacucuggcucccugguugggaagacggccauccacgugaaaggagcucucgucgauggcacagaauuuaccuucgaggggagcuguauguuucccgacggaugcgaugccguggacugcacauucugucgggaauuucugaagaacccccaaugcuauccugcgaaaaaguggcuuuucaucauuaucgucauucugcucggcuacgccgggcugaugcuucugaccaaugugcucaaggcuaucggcauuuggggaucuuggguuaucgccccggugaaacugaucuuugcuauuaucaagaaacugaugcgcaccgucuccugucucaugggcaagcugauggauagagggagacaggugauucaugaggaaaucggagagaaccgggagggcaaucaggacgauguucgcauugaaauggcccggcccagacgcgugcggcacuggauguauagcccugucauccuuacaauucuggccaucgggcucgcugagucuugcgacgaaauggugcaugcggauagcaaacugguguccuguagacagggaagcggcaacguuaaggagugcgucacgaccgggcgcgcccuucugcccgcugugaauccuggccaagaggccugucuccacuucacagcccccggaucuccggacuccaagugccugaaaauccgggugaagagaauuaaccugaaauguaagaaaagcuccucuuacuuugucccugaugcucgcagccggugcaccuccgugagacgcugucggugggccggcgacugccagucugggugucccccucauuucacaagcaauuccuuuucugacgauugggcgggaaagauggacagagcuggccucggguucagcggaugcuccgauggcugcgggggcgccgccuguggaugcuuuaacgcugcccccagcuguaucuucuggcggaaguggguugaaaauccucacggcauuaucuggaaagugucucccugcgcugccugggucccguccgcggugauugagcugaccaugccuagcggggaaguucgcacguuccaccccaugucuggaauccccacacagguguuuaagggcgucuccgugaccuaucuugggagcgacauggagguuucuggacugaccgaucucugugaaaucgaggagcugaaauccaagaaacuggcccuugcuccuugcaaccaggccggcaugggcguggucgggaaggugggagaaauucaauguagcuccgaggaaagcgcuagaacaaucaaaaaggacggcugcauuuggaacgccgaucucguggggaucgagcugcgggucgacgaugcgguuuguuacucuaagauuaccagcguggaagccguggucaauuauuccgcuaucccgacaacgaucggaggccugagauucgagcgcucucaugacagccaggggaaaauuuccggaucuccccucgauaucaccgccauucggggcagcuuuuccgugaacuacagaggccugcgccuuucucugagcgagaucacagcuaccugcacaggggaaguuaccaauguguccggaugcuacagcuguaugacgggcgccaaggucucuauuaaacuccacuccaacaagaauagcaccgcccaugugagaugcaaaggggacgagacagcuuucucuguucuggaaggagugcacuccuauaccgucagccuguccuuugaucacgcggugguugacgagcagugucagcuuaacugcggcgggcaugaaucucaagugacacucaagggaaaucugaucuuccuggacgucccuaaguuuguggauggcagcuacaugcagaccuaucacuccacggugcccacaggcgccaacaucccuagccccaccgacuggcucaaugcucuguucgggaacggacuuucucgguggauucugggcgucaucgggguucuccugggaggccuggcccuguuuuucaugauuaugucccucuuuaaacuggggacaaaacagguguuccgcagcagaaccaagcuggccuga

SEQ ID NO: 14797 - RNA, 3222 nt, Artificial Sequence
  derived and/or modified CDS sequence (opt5) from SFTSV(LN2012-58)__KF887440.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuccuggagcuuaaguccuuuagccagucugaguuccccgacaucugcaaaauugauggaaucguguuuaaucagugugagggcgaaagccugccucaacccuucgacgucgccuggauggauguggggcacucccauaagaucauuaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcguuagacccaaauguuacggguuuucccggaugauggccacccuggaagugaaccagccuguccaacgcaucggacagugcacgggcugucaccuugagugcauuaaugggggcgugagacugaucacccucacaucugaacuuaagagcgcgaccguuugugccucccauuucugcucuagcgcuacauccggaaagaaaagcaccgagauucaguuccacucuggcucccugguggggaagacggccauccacgucaaaggagcucucguggauggcacagaguuuaccuucgaagggagcuguauguuucccgacggaugcgaugccgucgacugcacauucugucgggaguuucugaagaacccccaaugcuauccugcgaaaaaguggcuuuucaucauuaucgugauucugcucggcuacgccgggcugaugcuucugaccaauguucucaaggcuaucggcauuuggggaucuugggugaucgccccggucaaacugaucuuugcuauuaucaagaaacugaugcgcaccguguccugucucaugggcaagcugauggauagagggcggcagguuauucaugaagagaucggagaaaacagagagggcaaucaggacgaugugcgcauugagauggcccggcccagacgcguccggcacuggauguauagcccugugauccuuacaauucuggugauggggcucgccgaaucuugcgacgagaugguucaugcugauagcaaacuggucuccuguagacagggaagcggcaacaugaaggaaugcgugacgaccgggcgcgcgcuucugcccgccgugaauccuggccaagaggcuugucuccacuucacagcccccggaucuccggacuccaagugccugaaaaucaaggucaaacggaucaaccugaaguguaaaaagagcuccucuuacuuugugccugaugccagaagccgcugcaccuccguucggagaugucgcugggcuggcgacugccagucugggugucccccucauuucacaagcaauuccuuuucugacgauugggccggaaagauggaccgggcgggccucggguucagcggaugcuccgauggcugcgggggcgcugccuguggaugcuuuaacgccgcucccagcuguauuuucuggagaaaauggguggagaauccucacggcaucauuuggaaggucucucccugcgccgcuugggugccguccgccguuaucgaacugaccaugccuagcggggaggugcggacguuccaccccaugucuggcauucccacacaggucuuuaaaggaguguccguuaccuaucuugggagcgacauggaagugucuggacugaccgaucucugugagaucgaagaacugaaguccaaaaagcuggcgcuugccccuugcaaccaggcuggcaugggcgucguggggaaagugggagagauccaauguagcuccgaagagagcgcccgcacaauuaagaaggacggcugcaucuggaacgcugaucucgucgggauugaacugagaguugacgaugccguguguuacucuaaaaucaccagcguggaggcggucgccaauuauuccgcuauuccgacaacgaucggaggccugcgguucgaaagaucucaugacagccaggggaagaucuccggaucuccccucgauauuaccgccauccgcggcagcuuuuccgugaacuaccggggccugagacuuucucugagcgagauuacagcuaccugcacaggggagguuaccaauguguccggaugcuacagcuguaugacgggcgccaaagucucuaucaagcuccacuccagcaaaaacucuaccgcccaugugcgcugcaagggggacgaaacagcuuucuccguucuggagggagugcacagcuauaccgucucccugucuuuugaucacgcggugguugacgaacagugucagcuuaauugcggcgggcaugagagccaagugacacucaagggaaaccugauuuuccuggacgucccuaaauuuguggauggcuccuacaugcagaccuaucacagcacggugcccacaggcgccaauaucccuucucccaccgacuggcucaacgcucuguucgggaauggacuuuccagauggauccugggcgucauugggguucuccugggaggccuggcccuguuuuucaugaucaugagccucuuuaagcuggggacaaaacagguguuccggucucgcaccaagcuggccuga

SEQ ID NO: 14798 - RNA, 3222 nt, Artificial Sequence
  derived and/or modified CDS sequence (opt5) from SFTSV(NB24/CHN/2013)__KR698337.1__GP
augaugaaggugaucugguucagcucccugauuugccucgucauccaguguucuggcgacaccgggcccauuaucugcgccggaccuauucacagcaacaaauccgcugauaucccgcaucugcuuggcuacucugagaagaucugucaaauugacagacugauccacguuagcuccuggcuccggaaucauucucaguuucagggguaugugggacagcgcggcgggagaagccaaguguccuacuaucccgccgaaaacagcuacucucggugguccggacugcuuagcccuugcgaugcggacuggcugggcaugcucgucgugaaaaaggcuaaaggcucugauaugauuguucccgggccuuccuauaagggaaagguguucuuugagcgccccacauucgacggcuacgucggguggggauguggcagcgggaaaucuagaacggaauccggagagcugugcagcuccgauucuggcaccagcuccggccugcucccuagcgaccgggugcuguggaucggggauguugccugucagccgaugacacccauuccugaagagaccuuucuugagcugaagucuuucucccagagcgaauuucccgacaucugcaaaauugauggaaucguguucaaucagugugagucugaaagccucccucaacccuuugacgucgccuggauggaugugggccacucccauaagaucauuaugcgcgagcacaaaacaaagugggugcaggagucuagcuccaaggacuucgucugcuauaaagaagggaccggaccguguagcgagucugaagagaagacaugcaaaaccuccggcagcugcagaggggacaugcaguuuuguaagguugcuggaugcgaacacggcgaggaggccucugaagcuaaaugucggugcucccuggugcauaagccuggcgagguggucgugagcuacgggggaaugcgcguuagacccaaauguuacggcuucucccggaugauggccacgcuugaagugaacccucccgagcagcgcaucgggcaaugcaccggaugucaccuggaaugcgucaauggcggggugagacucauuacacugaccucugagcuuaagagcgcgacaguuugugccucccauuuuugcucuagcgcuaccuccggcaagaaaagcacggagauccaguuccacucuggaucccucgugggcaagacagccauucacgucaaaggggcucugguggauggaaccgaguucacauuugaaggcagcuguauguuccccgacgggugcgaugccgucgacugcaccuuuugucgggaguuccuuaagaacccucagugcuauccggcgaaaaaguggcuguuuaucaauaucgugauucuccugggauacgccggccuuaugcugcucaccaacguucugaaggcuaucgggguguggggcucuugggucauugcccccgugaaacugauguucgcuaucauuaagaaacucaugcgcuccguuagcugucugaugggaaagcugauggauagaggccggcaagugauccaugaagaaaucggggagaauagagagggaaaccaggacgauguccgcauugaaauggcccggccuagacgcgugcggcacuggauguauucucccgugauccugacaauucucgccguuggccuggcugaggggugcgacgaaaugguccaugcggauagcaaacuuguguccuguaagcagggaagcggcaauaugaaggagugcgugacgaccgggagagcccugcucccugcugucaaccccggccaggaggccugucugcacuuuacagccccgggaucuccugacuccaaaugccugaagaucaaagugaagaaaauuaaucucaaguguaagaaaagcuccucuuacuucguucccgaugcucgcagccggugcaccuccgugagacgcugucggugggccggcgacugccaaucugggugcccuagccauuuuacauccaacucuuucagcgacgauugggcgggaaagauggacagagcuggccugggguuuuccggauguagcgauggcugcgggggcgccgccuguggaugcuucaaugcugcccccucuuguaucuuuuggcgcaaaugggucgaaaacccucacggcauuaucuggaaggugucccccugcgcugccuggguuccgagcgcggugaucgagcuuaccaugccuucuggggaaguccggacguuccaccccauguccggcauucccacacagguguucaaaggaguuagcgugaccuaucuggggucugacauggaggucuccggacucaccgaucugugugaaaucgaggagcuuaagagcaaaaagcuggcccucgcuccuugcaaccaggccggcaugggcgugguggggaaggucggagaaauucaguguuccagcgaggaaucugcuagaacaaucaaaaaggacggcugcauuuggaaugccgaucugguugggaucgagcugcggguggacgaugcgguguguuacagcaaaaucaccuccgucgaagccguggcuaacuauucugccauuccgacaacgaucggaggccuccgcuuugagagaagccaugacucccaagggaagauuucuggaagcccccuggauaucaccgcuauucggggcuccuucucuguuaauuacagaggccuucgccugagccucuccgagaucacagcuaccugcacaggggaagugaccaacgucagcggaugcuacucuuguaugacgggcgccaaaguguccaucaagcugcacagcaauaagaacucuaccgcccauguucggugcaaaggggacgagacagcguuuuccgugcuggaaggaguccacagcuauaccgugucccuuucuuucgaucacgccguuguggacgagcagugucagcucaauugcggcgggcaugaaagccaggucacacugaagggaaaccugauuuuucucgacgugccuaaauucguggauggcuccuacaugcaaaccuaucacagcucuguccccacgggcgcuaauaucccuucccccacagacuggcugaacgcccuuuuugggaauggacugagcagauggauucucggcguuaucggggugcugcugggaggccuugcccucuucuuucugauuaugucucuguucaagcucgggaccaaacagguguuucgcagcagauccaagcuggcuuga

SEQ ID NO: 14799 - RNA, 3222 nt, Artificial Sequence
  derived and/or modified CDS sequence (opt5) from SFTSV(NB31/CHN/2013)__KR698338.1__GP
augaugaaggugaucugguucagcucccugauuugcuuugucauccaguguucuggcgacaccgggcccauuaucugcgccggaccuauucacagcaacaaauccgcuaauaucccgcaucuccugggcuacucugagaagaucugucaaauugauagacuuauccacguuagcuccuggcugcggaaccauucucaguuccagggguaugugggacagcgcggcgggagaagccaaguguccuacuaucccagcgaaaauucuaacucccgguggagcggacuccugucuccuugcgacgccgauuggcuuggcaugcuggucgugaaaaaggcgaaaggcuccgacaugauuguucccgggccuagcuacaagggaaagguguuuuucgagcgccccacauuugauggcuaugucggguggggauguggcucugggaaauccagaacggaaagcggagagcucugcuccucugacagcggcaccuccagcggccugcugccuucugaucgggugcucuggaucggggacguugcuugucagccgaugacacccauuccugaagagaccuuccuggagcuuaaguccuuuagccagucugaauuucccgauaucugcaaaauugacggaaucguguuuaaucagugugagagcgaaucccugccucaacccuucgaugucgccuggauggacgugggccacucucauaagaucauuaugcgcgagcacaaaacaaagugggugcaggagagcuccagcaaggauuuugucugcuacaaagaagggaccggaccguguucugaguccgaagagaagacaugcaaaaccagcggcucuugcagaggggacaugcaguucuguaagguugccggaugcgaacacggcgaggaggcuuccgaagccaaaugucggugcagccucgugcauaagccuggcgagguggucguguccuaugggggaaugcgcguuagacccaaauguuacggcuuuucucggaugauggcuacgcuggaagugaacccucccgagcagcgcaucgggcaaugcaccggaugucaccuugaaugcauuaauggcggggucagacugaucacacucaccagcgagcugaaguccgccacagugugugcgucucauuucugcagcuccgccaccagcggcaagaaaaacacggagauucaguuccacucuggaucccugguuggcaagacagugauccacgucaaaggggcucucguggacggaaccgaauuuacauucgagggcagcuguauguuucccgaugggugcgaagccgucgacugcaccuucugucgggaguuucugaagaauccucagugcuacccggcuaaaaaguggcuuuucaucauuaucgugauucugcucggauaugccggccugaugcuucugaccaacguucucaaggcgaucgggguguggggcucuugggucauugcccccgugaaacugauguuugcuaucaucaagaaacugaugcgcuccguuagcugucucaugggaaagcugauggauagaggccggcaagugauucaugaagagaucggggagaauagagaaggaaaccgcgacgauguccggauugagauggccagaccucgccgggugagacacuggauguacucucccgugauccuuacaauucuggcuaucggccucgccgaagggugcgacgagaugguucaugccgauagcaaacuggucuccuguaagcagggaagcggcaauaugaaggagugcgugacgaccgggcgcgugcuucugccugcugucaaccccggccaggaagcgugucuccacuucacagccccgggaucuccugacuccaaaugccugaagauuaaagugaagcggaucaaucugaaauguaagaaguccuccucuuauuuuguucccgaugcuagaagccgcugcaccuccgugcggagaugucgcugggccggcgacugccagucugggugcccuagccauuucacauccaacucuuuuagcgaugacugggccggaaaaauggaccgggcuggccucggguucuccggauguagcgauggcugcgggggcgccgcguguggaugcuuuaacgcugcccccucuuguaucuucuggagaaagugggucgagaauccucacggcauuaucuggaaagugucccccugcgccgcuuggguuccgagcgccgugauugaacugaccaugccuucuggggagguccggacguuccaccccauguccggaauccccacacaaguguuuaagggcguuagcgugaccuaccuugggucugacauggaagucuccggacugaccgaucucugugagauugaggaacugaaaagcaagaaacuggcucuugccccuugcaaccaggcgggcaugggcgugguggggaaggucggagagauccaguguuccagcgaagagucugcccgcacaaucaagaaagacggcugcauuuggaaugcugaucucguugggaucgaacugagaguggacgaugccguguguuauagcaagauuaccuccgucgaggcuguggccaacuacucugcgaucccgacaacgauuggaggccugcgguucgagagaagccaugacucccaggggaaaaucucuggaagcccccucgauaucaccgccauucgcggcuccuuuucuguuaauuaucggggccugagacuuagccuguccgaaaucacagcuaccugcacaggggaggugaccaacgucagcggaugcuacucuuguaugacgggcgccaagguguccauuaaacuccacagcucuaagaauagcaccgcucauguucgcugcaagggggacgaaacagccuucagcgugcuggagggaguccacuccuacaccgugucucugagcuuugaucacgccguuguggacgaacaaugucagcuuaacugcggcgggcaugagucccaggucacacucaaaggaaaucugaucuuccuggaugugccuaaguuuguggacggcagcuauaugcagaccuaccacucuuccguccccacgggcgcuaacauuccuagccccacagacuggcucaaugcgcuguucgggaacggacuuucuagauggauccugggcguugugggggugcuccugggaggccugguccuuuucuuccucaucaugagccuguuuaaacuggggaccaagcaaguguuccggucccgcacaaaacucgccuga

SEQ ID NO: 14800 - RNA, 3222 nt, Artificial Sequence
  derived and/or modified CDS sequence (opt5) from SFTSV(NB38/CHN/2013)__KR698341.1__GP
augaugaaggugaucugguucagcucccugauuugccucgucauccaguguggcggggacaccucucccauuaucugcgccggaccuauucacagcaacaaauccgcugauaucccgcaucugcuuggcuacucugagaagaucugucaaauugacagacugauccacguuagcuccuggcuccggaaucauucucaguuucagggguaugugggacagcgcggcgggagaagccaaguguccuacuaucccgccgaaaacagcuacucucggugguccggacugcuuagcccuugcgaugcggacuggcugggcaugcucgucgugaaaaaggcuaaaggcucugauaugauuguucccgggccuuccuauaagggaaagguguucuuugagcgccccacauucgacggcuacgucggguggggauguggcagcgggaaaucuagaacggaauccggagagcugugcagcuccgauucuggcaccagcuccggccugcucccuagcgaccgggugcuguggaucggggauguugccugucagccgaugacacccauuccugaagagaccuuucuugagcugaagucuuucucccagagcgaauuucccgacaucugcaaaauugauggaaucguguucaaucagugugagggcgaaucucucccucaacccuuugacgucgccuggauggauguggggcacagccauaagaucauuaugcgcgagcacaaaacaaagugggugcaggaguccucuagcaaggacuucgucugcuauaaagaaggaaccggcccguguuccgagagcgaagagaagacaugcaaaaccucuggguccugcagaggagacaugcaguuuuguaagguugcuggcugcgaacacgaggaggaagccagcgaggcuaaaugucggugcucucuggugcauaagccuggcgaaguggucguguccuacgggggaaugcgcguuagacccaaauguuacggcuucagccggaugauggccacgcuugaggugaaccagccugaacaacgcaucgggcagugcaccggaugucaccuggagugcauuuccggcggggucagacucaucacacugaccucugagcuuaagagcgcgacagugugugccucccauuuuugcucuagcgcuaccuccggcaagaaaagcacggaaauucaguuccacucuggaucccucguuggcaagacagccauccacgugaaaggggcucuggucgauggaaccgaguucacauuugaaggcagcuguauguuccccgacgggugcgaugccguggacugcaccuuuugucgggaguuccuuaagaauccccaaugcuauccugcgaaaaaguggcuguuuaucauuaucgucauucuccugggauacgccggccuuaugcugcucaccaacgugcugaaggcuaucgggguuuggggcucuugggugauugccccggucaaacugguguucgcuaucaucaagaaacucaugcgcgccguuuccugucugaugggaaagcugauggauagaggcagacaggugauucaugaagagaucggggagaaucgggaaggaaaccaggacgauguccgcauugagauggcccggcccagacgcgugcggcacuggauguauagcccugugauccugacaauucucgcuaucggccuggcggaagggugcgacgagaugguucaugccgauucuaaacuugucagcuguagacagggauccggcaauaugaaggagugcgugacgaccgggcgcgcucugcuccccgccgugaacccuggccaagaagccugucugcacuuuacagcucccggaagcccggacucuaagugccugaaaauuaaggucaaacggaucaaucucaaguguaaaaaguccagcuccuacuucgugccugaugccagaucucgcugcaccagcguucggagaugucgcugggcgggcgacugccaguccgggugucccccucauuuuacaucuaacagcuucuccgacgauugggcuggaaagauggaccgggccggccugggguuuucuggaugcagcgauggcugcgggggcgccgcuuguggaugcuucaaugccgcucccuccuguaucuuuuggagaaaauggguggagaacccucacggcauuaucuggaaggucagccccugcgccgcgugggugccgucugccguuauugaacuuaccaugccuuccggggaggugcggacguuccaccccaugagcggaauccccacacaggucuucaaaggcgugucuguuaccuaucugggguccgacauggaagugagcggacucaccgaucugugugagauggaggaacugaagucuaaaaagcucgcucuugccccuugcaaucaggcuggcaugggcgucguggggaaagugggagagauucaauguuccagcgaagaguccgcccgcacaaucaagaaggacggcugcaucuggaacgcggaucuggucgggauugaacugagaguugacgaugccguguguuacagcaaaaucaccucuguggaggcugucgccaaccauagcgcuauuccgacaacgaucggaggccuccgguuugagagaucccacgacucucaggggaagauuagcggaucuccccuggauaucaccgccauccgcggcuccuucagcgugaauuaucggggccuuagacugucccucucugaaauuacagcuaccugcacaggggagguuaccaacgugagcggaugcuacuccuguaugacgggcgccaaagucagcaucaagcugcauucuuccaaaaauagcaccgcgcacgugcgcugcaagggggacgaaacagccuuuucuguucuggagggagugcacuccuacagcgucucccuuucuuucgaucaugcugugguugacgaacagugucagcucaacugcggcgggcacgagagcaaggugacccugagaggaaaucugauuuuucucgacgucccuaaauucguggauggcuccuauaugcaaacauaccauagcaccgugcccacgggcgccaacaucccuucucccacagacuggcugaaugcccuuuuugggaacggacugucccggugguuccucggcgucauugggguucugcugggaggccuugcucucuuuuuccugaucaugagccuguuuaagcucgggaccaaacagguguuccgcucuagaagcaagcuggccuga

SEQ ID NO: 14801 - RNA, 3222 nt, Artificial Sequence
  derived and/or modified CDS sequence (opt5) from SFTSV(NB39/CHN/2014)__KR698342.1__GP
augaugaaggugaucugguucagcucccugauuugccucgucauccaguguucuggcgacaccgggcccauuaucugcgccggaccuauucacagcaacaaguccgcugauaucccgcaucugcuuggcuacucugagaagaucugucaaauugacagacugauccacguuagcuccuggcuccggaaucauucucaguuucagggguaugugggacgcagaggcgggcggagccagguguccuacuaucccgccgaaaacagcuacucucgcugguccggacugcuuagcccuugcgaugcggacuggcugggcaugcucgucgugaaaaaggcuaaaggcucugauaugauuguucccgggccuuccuauaagggaaagguguucuuugagagacccacauucgacggcuacgucggguggggauguggcagcgggaaaucucggacggaauccggagagcugugcagcuccgauucuggcaccagcuccggccugcucccuagcgaccgcgugcuguggaucggggauguugccugucaaccgaugacacccauuccugaagagaccuuucuugagcugaagucuuucucccagagcgaauuucccgacaucugcaaaauugauggaaucguguucaaucagugugagucugaaagccucccucagcccuuugacgucgccuggauggaugugggccacucccauaagaucauuaugagagagcacaaaacaaagugggugcaagagucuagcuccaaggacuucgucugcuauaaagaagggaccggaccguguagcgagucugaagagaagacaugcaaaaccuccggcagcugccgcggggacaugcaguuuuguaagguugcuggaugcgaacacggcgaggaggccucugaagcuaaaugucggugcucccuggugcauaagccuggcgagguggucgugagcuacgggggaaugagaguucggcccaaauguuacggcuucucccgcaugauggccacgcuugaagugaacccucccgagcagagaaucgggcagugcaccggaugucaccuggaaugcgucaauggcggggugcggcucauuacacugaccucugagcuuaagagcgcgacaguuugugccucccauuuuugcucuagcgcuaccuccggcaagaaaagcacggagauccaauuccacucuggaucccucgugggcaagacagccauucacgucaaaggggcucugguggauggaaccgaauuuacauuugagggcagcuguauguuccccgacgggugcgaugccgucgacugcaccuuuugucgcgaguuccuuaagaacccucagugcuauccggcgaaaaaguggcuguuuaucaucauugugauccuccugggauacgccggccuuaugcugcucaccaauguucugaaggcuauugggguguggggcucuugggucaucgcccccgugaaacugauguucgcuauuaucaagaaacucaugagauccguuagcugucugaugggaaagcugauggaucggggcagacaggugauccaugaagaaauuggggagaaccgcgagggaaaucaagacgauguccggaucgaaauggccagaccucgccgggugagacacuggauguauucucccgugauucugacaauccucgccguuggccuggcugaggggugcgacgaaaugguccaugcggauagcaaacuuguguccuguaagcagggaagcggcaacaugaaggagugcgugacgaccgggcgcgcccugcucccugcugucaaucccggccaggaggccugucugcacuuuacagccccgggaucuccugaccugaaaugccucaagauuaaagugaagaaaaucaaccugaaguguaagaaauccagcuccuacuucguucccgaugcucggucuagaugcaccagcgugcgccgguguagaugggccggcgacugccaguccgggugcccuucucauuuuacaagcaauuccuucucugacgauugggcgggaaagauggaccgcgcuggccuuggguuuagcggauguuccgauggcugcgggggcgccgccuguggaugcuucaacgcugcccccagcuguauuuucuggcggaaaugggucgaaaauccucacggcaucaucuggaaggugucucccugcgcugccuggguuccguccgcggugauugagcugaccaugccuagcggggaagucagaacguuccaccccaugucuggaauccccacacaaguguucaaaggcguuuccgugaccuaucucgggagcgacauggaggucucuggacugaccgaucugugugaaauugaggagcuuaaguccaaaaagcucgcccuggcuccuugcaaccaggccggcaugggcgugguggggaaggucggagaaauccaguguagcuccgaggaaagcgcucggacaauuaaaaaggacggcugcaucuggaacgccgaucugguugggaucgagcuccgcguggacgaugcgguguguuacucuaaaauuaccagcgucgaagccguggcuaauuauuccgccaucccgacaacgauuggaggccugagauuugagcggucucaugacagccaggggaagaucuccggaucuccccuugauauuaccgcuaucagaggcagcuucuccguuaacuaccgcggccugcggcucucucugagcgagaucacagcuaccugcacaggggaagugaccaaugucuccggaugcuacagcuguaugacgggcgccaaagugucuauuaagcugcacuccaacaagaauagcaccgcccauguuagaugcaaaggggacgagacagcguuuucugugcuugaaggaguccacuccuauaccgugagccucuccuucgaucacgccguuguggacgagcaaugucagcugaacugcggcgggcaugaaucucaggucacacugaagggaaaucucaucuuucuggacgugccuaaauucguggauggcagcuacaugcagaccuaucacuccagcguccccacgggcgcuaacauuccuucucccacagacuggcuuaaugcccuguuugggaacggacucucccgcuggauccugggcguuauuggggugcugcuuggaggccucgcccuguucuuucugaucaugagccucuucaagcuggggaccaaacaaguguuuagaucucggacaaaacuugcuuga

SEQ ID NO: 14802 - RNA, 3222 nt, Artificial Sequence
  derived and/or modified CDS sequence (opt5) from SFTSV(QD7)__KR706566.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuccuggagcuuaaguccuuuagccagucugaguuccccgacaucugcaaaauugauggaaucguguuuaaucagugugaaggcgaaagccugccucaacccuucgacgucgccuggauggauguggggcacucccauaagaucauuaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcaucagacccaaauguuacggguuuucccggaugauggccacccuggaaguuaaccagccugagcaacgcauuggacagugcacgggcugucaccuugaaugcaucaaugggggcgugagacugauuacccucacaucugagcucaagagcgcgaccgucugugccucccauuucugcucuagcgcuacauccggaaagaaaagcaccgagauccaguuccacucuggcucccugguggggaagacggccauccacguuaaaggagcucugguggauggcacagaauuuaccuucgaggggagcuguauguuucccgacggaugcgaugccgucgacugcacauucugucgggaauuucugaagaacccccaaugcuauccugcgaaaaaguggcuuuucauuaucauugugauccugcucggcuacgccgggcugaugcuucugaccaauguccucaaggcuauuggcaucuggggaucuugggugaucgccccgguuaaacugauguuugcuauuaucaagaaacugaugcgcaccauguccugucucaugggcaagcugauggauagagggagacaggugauucaugaggaaaucggagagaaccgggagggcaaucaggacgauguccgcauugaaauggcccggcccagacgcgugcggcacuggauguauagcccuguuauccuuacauuccuggccauugggcucgcugagucuugcgacgaaauggugcaugcggauagcaaacuggccuccuguagacagggaagcggcaacaugaaggagugcgucacgaccgggcgcgcccuucaccccgccgugaauccuggccaagaggccugucugcauuuuacagcucccggaucuccggacuccaagugccucaaaaucaaggugaaacggaucaaccugaaguguaaaaagagcuccucuuacuucguuccugaugccagaagccgcugcaccuccguccggagaugucgcugggcgggcgacugccagucugggugucccccucacuuuacaagcaauuccuucucugacgauugggcuggaaagauggaccgggccggccugggguuuagcggaugcuccgauggcugcgggggcgccgcuuguggaugcuucaacgccgcucccagcuguauuuucuggagaaaauggguggaaaauccucacggcaucauuuggaaggugucucccugcgccgcgugggucccguccgccgugaucgagcucaccaugccuagcggggaaguucggacguuucaucccaugucuggcauucccacacagguguucaaaggagucuccgugaccuaucuggggagcgacauggagguuucuggacuuaccgaucugugugaaaucgaggagcucaaguccaaaaagcuggcucuggccccuugcaaccaggcuggcaugggcguggucgggaaagugggagaaauccaauguagcuccgaggaaagcgcccgcacaauuaagaaggacggcugcaucuggaacgcggaucuuguugggauugagcucagaguggacgaugccgucuguuacucuaaaaucaccagcguggaagcuguggccaauuauuccgcuauuccgacaacgaucggaggccugcgguuugagagaucucacgacagccaggggaagaucuccggaucuccccuggauauuaccgccauccgcggcagcuucuccgucaacuaccggggccucagacugucucuuagcgagauuacagcuaccugcacaggggaaguuaccaauguguccggaugcuacagcuguaugacgggcgcuaaagugucuaucaagcugcauuccagcaaaaacucuaccgcgcacguccgcugcaagggggacgagacagccuuuuccgugcucgaaggaguucacagcuauaccgugucccugucuuucgaucaugcugucguggacgagcagugucagcugaauugcggcgggcacgaaagccaaguuacacuuaagggaaaccucauuuuucuggacgugccuaaauucgucgauggcuccuacaugcagaccuaucauagcacggugcccacaggcgccaauaucccuucucccaccgacuggcugaacgcccucuuugggaauggacuguccagauggauccuuggcguuauuggggugcugcucggaggccuggcucuguucuuuaugaucaugagccuuuucaagcucgggacaaaacaggucuuucggucucgcaccaagcuggccuga

SEQ ID NO: 14803 - RNA, 3222 nt, Artificial Sequence
  derived and/or modified CDS sequence (opt5) from SFTSV(Rodent01/NB/CHN/2014)__KR698343.1__GP
augaugaaggugaucugguucagcucccugauuugccucgucauccaguguucuggcgacaccgggcccauuaucugcgccggaccuauucacagcaacaaguccgcugauaucccgcaucugcuuggcuacucugagaagaucugucaaauugacagacugauccacguuagcuccuggcuccggaaucauucucaguuucagggguaugugggacgcagaggcgggcggagccagguguccuacuaucccgccgaaaacagcuacucucgcugguccggacugcuuagcccuugcgaugcggacuggcugggcaugcucgucgugaaaaaggcuaaaggcucugauaugauuguucccgggccuuccuauaagggaaagguguucuuugagagacccacauucgacggcuacgucggguggggauguggcagcgggaaaucucggacggaauccggagagcugugcagcuccgauucuggcaccagcuccggccugcucccuagcgaccgcgugcuguggaucggggauguugccugucaaccgaugacacccauuccugaagagaccuuucuugagcugaagucuuucucccagagcgaauuucccgacaucugcaaaauugauggaaucguguucaaucagugugagucugaaagccucccucagcccuuugacgucgccuggauggaugugggccacucccauaagaucauuaugagagagcacaaaacaaagugggugcaagagucuagcuccaaggacuucgucugcuauaaagaagggaccggaccguguagcgagucugaagagaagacaugcaaaaccuccggcagcugccgcggggacaugcaguuuuguaagguugcuggaugcgaacacggcgaggaggccucugaagcuaaaugucggugcucccuggugcauaagccuggcgagguggucgugagcuacgggggaaugagaguucggcccaaauguuacggcuucucccgcaugauggccacgcuugaagugaacccucccgagcagagaaucgggcagugcaccggaugucaccuggaaugcgucaauggcggggugcggcucauuacacugaccucugagcuuaagagcgcgacaguuugugccucccauuuuugcucuagcgcuaccuccggcaagaaaagcacggagauccaauuccacucuggaucccucgugggcaagacagccauucacgucaaaggggcucugguggauggaaccgaauuuacauuugagggcagcuguauguuccccgacgggugcgaugccgucgacugcaccuuuugucgcgaguuccuuaagaacccucagugcuauccggcgaaaaaguggcuguuuaucaucauugugauccuccugggauacgccggccuuaugcugcucaccaauguucugaaggcuauugggguguggggcucuugggucaucgcccccgugaaacugauguucgcuauuaucaagaaacucaugagauccguuagcugucugaugggaaagcugauggaucggggcagacaggugauccaugaagaaauuggggagaaccgcgagggaaaucaagacgauguccggaucgaaauggccagaccucgccgggugagacacuggauguauucucccgugauucugacaauccucgccguuggccuggcugaggggugcgacgaaaugguccaugcggauagcaaacuuguguccuguaagcagggaagcggcaacaugaaggagugcgugacgaccgggcgcgcccugcucccugcugucaaucccggccaggaggccugucugcacuuuacagccccgggaucuccugaccugaaaugccucaagauuaaagugaagaaaaucaaccugaaguguaagaaauccagcuccuacuucguucccgaugcucggucuagaugcaccagcgugcgccgguguagaugggccggcgacugccaguccgggugcccuucucauuuuacaagcaauuccuucucugacgauugggcgggaaagauggaccgcgcuggccuuggguuuagcggauguuccgauggcugcgggggcgccgccuguggaugcuucaacgcugcccccagcuguauuuucuggcggaaaugggucgaaaauccucacggcaucaucuggaaggugucucccugcgcugccuggguuccguccgcggugauugagcugaccaugccuagcggggaagucagaacguuccaccccaugucuggaauccccacacaaguguucaaaggcguuuccgugaccuaucucgggagcgacauggaggucucuggacugaccgaucugugugaaauugaggagcuuaaguccaaaaagcucgcccuggcuccuugcaaccaggccggcaugggcgugguggggaaggucggagaaauccaguguagcuccgaggaaagcgcucggacaauuaaaaaggacggcugcaucuggaacgccgaucugguugggaucgagcuccgcguggacgaugcgguguguuacucuaaaauuaccagcgucgaagccguggcuaauuauuccgccaucccgacaacgauuggaggccugagauuugagcggucucaugacagccaggggaagaucuccggaucuccccuugauauuaccgcuaucagaggcagcuucuccguuaacuaccgcggccugcggcucucucugagcgagaucacagcuaccugcacaggggaagugaccaaugucuccggaugcuacagcuguaugauuggcgccaaagugucuaucaagcugcacuccaacaagaauagcacggcccauguuagaugcaaaggggacgagaccgcguuuucugugcuugaaggaguccacuccuauacagugagccucuccuucgaucacgccguuguggacgagcaaugucagcugaacugcggcgggcaugaaucucaggucacccugaagggaaaucucauuuuucuggacgugccuaaauucguggauggcagcuacaugcagacauaucacuccagcguccccaccggcgcuaacaucccuucucccacggacuggcuuaaugcccuguuugggaacggacucucccgcuggauucugggcguuaucggggugcugcuuggaggccucgcccuguucuuucugaucaugagccucuucaagcuggggacaaaacaaguguuuagaucucggaccaaacuugcuuga

SEQ ID NO: 14804 - RNA, 3222 nt, Artificial Sequence
  derived and/or modified CDS sequence (opt5) from SFTSV(SDLZtick12/2010)__JQ684872.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuccuggagcuuaaguccuuuagccagucugaguuccccgacaucugcaaaauugauggaaucguguuuaaucagugugaaggcgaaagccugccucaacccuucgacgucgccuggauggauguggggcacucccauaagaucauuaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcaucagacccaaauguuacggguuuucccggaugauggccacccuggaaguuaaccagccugagcaacgcauuggacagugcacgggcugucaccuugaaugcaucaaugggggcgugagacugauuacccucacaucugagcucaagagcgcgaccgucugugccucccauuucugcucuagcgcuacauccggaaagaaaagcaccgagauccaguuccacucuggcucccugguggggaagacggccauccacguuaaaggagcucugguggauggcacagaauuuaccuucgaggggagcuguauguuucccgacggaugcgaugccgucgacugcacauucugucgggaauuucugaagaacccccaaugcuauccugcgaaaaaguggcuuuucauuaucauugugauccugcucggcuacgccgggcugaugcuucugaccaauguccucaaggcuauuggcaucuggggaucuugggugaucgccccgguuaaacugauguuugcuauuaucaagaaacugaugcgcaccguguccugucucaugggcaagcugauggauagagggcggcaggucauucaugaggaaaucggagagaacagagagggcaaucaggacgaugugcgcauugaaauggcccggcccagacgcguucggcacuggauguauagcccugugauccuuacauuccuggccauugggcucgcugagucuugcgacgaaaugguccaugcggauagcaaacugguguccuguagacagggaagcggcaacaugaaggagugcgugacgaccgggcgcgcccuucugcccgcuguuaauccuggccaagaggccugucuccacuuuacagcccccggaucuccggacuccaagugccugaaaaucaaggucaaacggaucaaccugaaguguaaaaagagcuccucuuacuucgugccugaugcuagaagccgcugcaccuccgugcggagaugucgcugggccggcgacugccagucugggugucccccucauuuuacaagcaauuccuucucugacgauugggcgggaaagauggaccgggcuggccucggguuuagcggaugcuccgauggcugcgggggcgccgccuguggaugcuucaacgcugcccccagcuguauuuucuggagaaaaugggucgaaaauccucacggcaucauuuggaaggugucucccugcgcugccuggguuccguccgcggugaucgagcugaccaugccuagcggggaaguccggacguuucaccccaugucuggcauucccacacagguguucaaaggaguuuccgugaccuaucuugggagcgacauggaggucucuggacugaccgaucucugugaaaucgaggagcugaaguccaaaaagcuggcccuugcuccuugcaaccaggccggcaugggcgugguugggaaagugggagaaauccaauguagcuccgaggaaagcgcucgcacaauuaagaaggacggcugcaucuggaacgccgaucucgucgggauugagcugagaguggacgaugcgguguguuacucuaaaaucaccagcgucgaagccguugcuaauuauuccgccauuccgacaacgaucggaggccugcgguuugagagaucucaugacagccaggggaagaucuccggaucuccccucgauauuaccgcuauccgcggcagcuucuccgugaacuaccggggccugagacuuucucugagcgagauuacagcuaccugcacaggggaagugaccaaugucuccggaugcuacagcuguaugacgggcgccaaagugucuaucaagcuccacuccagcaaaaacucuaccgcccauguucgcugcaagggggacgagacagcguuuuccgugcuggaaggaguccacagcuauaccgugucccugucuuucgaucacgccguuguggacgagcagugucagcuuaauugcggcgggcaugaaagccaagucacacucaagggaaaccugauuuuucuggacgugccuaaauucguugauggcuccuacaugcagaccuaucacagcacggugcccacaggcgcuaauaucccuucucccaccgacuggcucaacgcccuguuugggaauggacuuuccagauggauccugggcgucauuggggugcuccugggaggccuggcccuuuucuuuaugaucaugagccucuucaagcuggggacaaaacagguguuucggucucgcaccaagcuggcuuga

SEQ ID NO: 14805 - RNA, 3222 nt, Artificial Sequence
  derived and/or modified CDS sequence (opt5) from SFTSV(Zhao)__KF374684.1__GP
augaugaaggugaucugguucagcucccugauuugccucgucauccaguguucuggcgacaccgggcccauuaucugcgccggaccuauucacagcaacaaauccgcuaauaucccgcaucugcuuggcuacucugagaagaucugucaaauugauagacugauccacguuagcuccuggcuccggaaccauucucaguuucagggguaugugggacagcgcggcgggagaagccaaguguccuacuaucccgccgaaaauagcuacucucggugguccggacugcuuagcccuugcgacgcggauuggcugggcaugcucgucgugaaaaaggcuaaaggcucugacaugauuguucccgggccuuccuauaagggaaagguguucuuugagcgccccacauucgauggcuacgucggguggggauguggcagcgggaaaucuagaacggaauccggagagcugugcagcuccgacucuggcaccagcuccggccugcucccuagcgaucgggugcuguggaucggggacguugccugucagccgaugacacccauuccugaagagaccuuucuugagcugaagucuuucucccagagcgaauuucccgauaucugcaaaauugacggaaucguguucaaccagugugagucugaaagccucccucaacccuuugaugucgccuggauggacgugggccacucccauaagaucauuaugcgcgagcacaaaacaaagugggugcaggagucuagcuccaaggauuucgucugcuauaaagaagggaccggaccguguagcgagucugaagagaagacaugcaaaaccuccggcagcugcagaggggacaugcaguuuuguaagguugcuggaugcgaacacggcgaggaggccucugaagcuaaaugucggugcucccuggugcauaagccuggcgagguggucgugagcuacgggggaaugcgcguuagacccaaauguuacggcuucucccggaugauggccacgcuugaagugaauccucccgagcagcgcaucgggcaaugcaccggaugucaccuggaaugcauuaacggcggggucagacucgugacacugaccucugagcuuaagagcgcgacaguuugugccucccauuuuugcucuagcgcuaccuccggcaagaaaagcacggagauccaguuccacucuggaucccucgugggcaaggccgcuauucacgucaaaggggcccugguggacggaacagaguucaccuuugaaggcagcuguauguuccccgaugggugcgacgcggucgauugcacauuuugucgggaguuccuuaagaauccucagugcuauccggccaaaaaguggcuguuuaucaucauugugauccuccugggauacgcuggccuuaugcugcucaccaacguucugaaggccauugggguguggggcucuugggucaucgcucccgugaaacugauguucgccauuaucaagaaacucaugcgcuccguuagcugucugaugggaaagcugauggacagaggccggcaagugauccaugaagaaauuggggagaauagagagggaaaccaggaugacguccgcaucgaaauggugcggccuagacgcgugcggcacuggauguauucucccguuauucugaccauccucgccauuggccugacagaggggugcgaugaaaugguccaugcugacagcaaacuuguguccuguagacagggaagcggcaauaugaaggagugcgugacgaccgggcgcgcgcugcucccugccgucaaccccggccaggaggcuugucugcacuuuacagccccgggaucuccugauuccaagugccugaaaaucaaggugaaacggauuaaucucaaguguaaaaagagcuccucuuacuucguucccgacgccagaagccgcugcaccuccgugcggagaugucgcugggcuggcgauugccaaucugggugcccuagccauuuuacauccaacucuuucagcgacgacugggccggaaagauggaucgggcgggccugggguuuuccggauguagcgacggcugcgggggcgcugccuguggaugcuucaaugccgcucccucuuguaucuuuuggagaaaaugggucgaaaacccucacggcaucauuuggaaggugucccccugcgccgcuuggguuccgagcgccgugaucgagcuuaccaugccuucuggggaaguccggacguuccaccccauguccggcauucccacacagguguucaaaggaguuagcgugaccuaucuggggucugauauggaggucuccggacucaccgaccugugugaaaucgaggagcuuaagagcaaaaagcuggcgcucgccccuugcaaccaggcuggcaugggcgugguggggaaagucggagaaauucaguguuccagcgaggaaucugcccgcacaaucaagaaggauggcugcaucuggaaugcugaccugguugggauugagcugagaguggaugacgccguguguuacagcaaaaucaccuccgucgaagcgguggccaacuauucugcuauuccgacaacgaucggaggccuccgguuugagagaagccaugauucccaagggaagguuucuggaagcccccuggacauuaccgccauccgcggcuccuucucugugaauuaccggggccuuagacugagccucuccgagaucacagcuaccugcacaggggaagucaccaacgugagcggaugcuacucuuguaugacgggcgccaaaguuuccauuaagcugcacagcucuaaaaauuccaccgcccaugugcgcugcaagggggaugagacagcuuuuagcguccuggaaggagugcacuccuauaccguuucucuuagcuucgaccacgcgguggucgaugagcagugucagcucaacugcggcgggcaugaaucccaggugacacugaagggaaaucugaucuuucucgacgugccuaaauucgucgacggcagcuacaugcaaaccuaucacucuuccguucccacgggcgccaacauuccuagccccacagauuggcugaaugcucuuuuugggaacggacugucuagauggauccucggcgugauuggggugcugcugggaggccuugcccucuucuuucugaucaugagccuguucaagcucgggaccaaacaggucuuucggucccgcacaaagcuggccuga

SEQ ID NO: 14806 - RNA, 3222 nt, Artificial Sequence
  derived and/or modified CDS sequence (opt5) from SFTSV(Zhejiang/01/2011)__KJ597824.1__GP
augaugaaggugaucugguucagcucccugauuugccucgucauccaguguucuggcgacaccgggcccauuaucugcgccggaccuauucacagcaacaaauccgcuaauaucccgcaucugcuuggcuacucugagaagaucugucaaauugauagacugauccacguuagcuccuggcuccggaaccauucucaguuucagggguaugugggacagcgcggcgggagaagccaaguguccuacuaucccgccgaaaauagcuacucucggugguccggacugcuuagcccuugcgacgcggauuggcugggcaugcucgucgugaaaaaggcuaaaggcucugacaugauuguucccgggccuuccuauaagggaaagguguucuuugagcgccccacauucgauggcuacgucggguggggauguggcagcgggaaaucuagaacggaauccggagagcugugcagcuccgacucuggcaccagcuccggccugcucccuagcgaucgggugcuguggaucggggacguugccugucagccgaugacacccauuccugaagagaccuuucuugagcugaagucuuucucccagagcgaauuucccgauaucugcaaaauugacggaaucguguucaaccagugugagucugaaagccucccucaacccuuugaugucgccuggauggacgugggccacucccauaagaucauuaugcgcgagcacaaaacaaagugggugcaggagucuagcuccaaggauuucgucugcuauaaagaagggaccggaccguguagcgagucugaagagaagacaugcaaaaccuccggcagcugcagaggggacaugcaguuuuguaagguugcuggaugcgaacacggcgaggaggccucugaagcuaaaugucggugcucccuggugcauaagccuggcgagguggucgugagcuacgggggaaugcgcguuagacccaaauguuacggcuucucccggaugauggccacgcuugaagugaauccucccgagcagcgcaucgggcaaugcaccggaugucaccuggaaugcauuaacggcggggucagacucgugacacugaccucugagcuuaagagcgcgacaguuugugccucccauuuuugcucuagcgcuaccuccggcaagaaaagcacggagauccaguuccacucuggaucccucgugggcaaggccgcuauucacgucaaaggggcccugguggacggaacagaguucaccuuugaaggcagcuguauguuccccgaugggugcgacgcggucgauugcacauuuugucgggaguuccuuaagaauccucagugcuauccggccaaaaaguggcuguuuaucaucauugugauccuccugggauacgcuggccuuaugcugcucaccaacguucugaaggccauugggguguggggcucuugggucaucgcucccgugaaacugauguucgccauuaucaagaaacucaugcgcuccguuagcugucugaugggaaagcugauggacagaggccggcaagugauccaugaagaaauuggggagaauagagagggaaaccaggaugacguccgcaucgaaauggugcggccuagacgcgugcggcacuggauguauucucccguuauucugaccauccucgccauuggccugacagaggggugcgaugaaaugguccaugcugacagcaaacuuguguccuguagacagggaagcggcaauaugaaggagugcgugacgaccgggcgcgcgcugcucccugccgucaaccccggccaggaggcuugucugcacuuuacagccccgggaucuccugauuccaagugccugaaaaucaaggugaaacggauuaaucucaaguguaaaaagagcuccucuuacuucguucccgacgccagaagccgcugcaccuccgugcggagaugucgcugggcuggcgauugccaaucugggugcccuagccauuuuacauccaacucuuucagcgacgacugggccggaaagauggaucgggcgggccugggguuuuccggauguagcgacggcugcgggggcgcugccuguggaugcuucaaugccgcucccucuuguaucuuuuggagaaaaugggucgaaaacccucacggcaucauuuggaaggugucccccugcgccgcuuggguuccgagcgccgugaucgagcuuaccaugccuucuggggaaguccggacguuccaccccauguccggcauucccacacagguguucaaaggaguuagcgugaccuaucuggggucugauauggaggucuccggacucaccgaccugugugaaaucgaggagcuuaagagcaaaaagcuggcgcucgccccuugcaaccaggcuggcaugggcgugguggggaaagucggagaaauucaguguuccagcgaggaaucugcccgcacaaucaagaaggauggcugcaucuggaaugcugaccugguugggauugagcugagaguggaugacgccguguguuacagcaaaaucaccuccgucgaagcgguggccaacuauucugcuauuccgacaacgaucggaggccuccgguuugagagaagccaugauucccaagggaagauuucuggaagcccccuggacaucaccgccauccgcggcuccuucucuguuaauuaccggggccuuagacugagccucuccgagauuacagcuaccugcacaggggaagugaccaacgucagcggaugcuacucuuguaugacgggcgccaaaguguccaucaagcugcacagcucuaaaaauuccaccgcccauguucgcugcaagggggaugagacagcuuuuagcgugcuggaaggaguccacuccuauaccgugucucuuagcuucgaccacgcgguuguggaugagcagugucagcucaacugcggcgggcaugaaucccaggucacacugaagggaaaucugauuuuucucgacgugccuaaauucguggacggcagcuacaugcaaaccuaucacucuuccguccccacgggcgccaacaucccuagccccacagauuggcugaaugcucuuuuugggaacggacugucuagauggauucucggcguuaucggggugcugcugggaggccuugcccucuucuuucugaucaugagccuguucaagcucgggaccaaacagguguuucggucccgcacaaagcuggccuga

SEQ ID NO: 14807 - RNA, 3222 nt, Artificial Sequence
  derived and/or modified CDS sequence (opt5) from SFTSV(ZJ2013-06)__KP280204.1__GP
augaugaaggugaucugguucagcucccugauuugccucgucauccaguguucuggcgacaccgggcccauuaucugcgccggaccuauucacagcaacaaauccgcugauaucccgcaucugcuuggcuacucugagaagaucugucaaauugacagacugauccacguuagcuccuggcuccggaaucauucucaguuucagggguaugugggacagcgcggcgggagaagccaaguguccuacuaucccgccgaaaacagcuacucucggugguccggacugcuuagcccuugcgaugcggacuggcugggcaugcucgucgugaaaaaggcuaaaggcucugauaugauuguucccgggccuuccuauaagggaaagguguucuuugagcgccccacauucgacggcuacgucggguggggauguggcagcgggaaaucuagaacggaauccggagagcugugcagcuccgauucuggcaccagcuccggccugcucccuagcgaccgggugcuguggaucggggauguugccugucagccgaugacacccauuccugaagagaccuuucuugagcugaagucuuucucccagagcgaauuucccgacaucugcaaaauugauggaaucguguucaaucagugugagucugaaagccucccucaacccuuugacgucgccuggauggaugugggccacucccauaagaucauuaugcgcgagcacaaaacaaagugggugcaggagucuagcuccaaggacuucgucugcuauaaagaagggaccggaccguguagcgagucugaagagaagacaugcaaaaccuccggcagcugcagaggggacaugcaguuuuguaagguugcuggaugcgaacacggcgaggaggccucugaagcuaaaugucggugcucccuggugcauaagccuggcgagguggucgugagcuacgggggaaugcgcguuagacccaaauguuacggcuucucccggaugauggccacgcuugaagugaacccucccgagcagcgcaucgggcaaugcaccggaugucaccuggaaugcgucaauggcggggugagacucauuacacugaccucugagcuuaagagcgcgacaguuugugccucccauuuuugcucuagcgcuaccuccggcaagaaaagcacggagauccaguuccacucuggaucccucgugggcaagacagccauucacgucaaaggggcucugguggauggaaccgaguucacauuugaaggcagcuguauguuccccgacgggugcgaugccgucgacugcaccuuuugucgggaguuccuuaagaacccucagugcuauccggcgaaaaaguggcuguuuaucaauaucgugauucuccugggauacgccggccuuaugcugcucaccaacguucugaaggcuaucgggguguggggcucuugggucauugcccccgugaaacugauguucgcuaucauuaagaaacucaugcgcuccguuagcugucugaugggaaagcugauggauagaggccggcaagugauccaugaagaaaucggggagaauagagagggaaaccaggacgauguccgcauugaaauggcccggccuagacgcgugcggcacuggauguauucucccgugauccugacaauucucgccguuggccuggcugaggggugcgacgaaaugguccaugcggauagcaaacuuguguccuguaagcagggaagcggcaauaugaaggagugcgugacgaccgggagagcccugcucccugcugucaaccccggccaggaggccugucugcacuuuacagccccgggaucuccugacuccaaaugccugaagaucaaagugaagaaaauuaaucucaaguguaagaaaagcuccucuuacuucguucccgaugcucgcagccggugcaccuccgugagacgcugucggugggccggcgacugccaaucugggugcccuagccauuuuacauccaacucuuucagcgacgauugggcgggaaagauggacagagcuggccugggguuuuccggauguagcgauggcugcgggggcgccgccuguggaugcuucaaugcugcccccucuuguaucuuuuggcgcaaaugggucgaaaacccucacggcauuaucuggaaggugucccccugcgcugccuggguuccgagcgcggugaucgagcuuaccaugccuucuggggaaguccggacguuccaccccauguccggcauucccacacagguguucaaaggaguuagcgugaccuaucuggggucugacauggaggucuccggacucaccgaucugugugaaaucgaggagcuuaagagcaaaaagcuggcccucgcuccuugcaaccaggccggcaugggcgugguggggaaggucggagaaauucaguguuccagcgaggaaucugcuagaacaaucaaaaaggacggcugcauuuggaaugccgaucugguugggaucgagcugcggguggacgaugcgguguguuacagcaaaaucaccuccgucgaagccguggcuaacuauucugccauuccgacaacgaucggaggccuccgcuuugagagaagccaugacucccaagggaagauuucuggaagcccccuggauaucaccgcuauucggggcuccuucucuguuaauuacagaggccuucgccugagccucuccgagaucacagcuaccugcacaggggaagugaccaacgucagcggaugcuacucuuguaugacgggcgccaaaguguccaucaagcugcacagcaauaagaacucuaccgcccauguucggugcaaaggggacgagacagcguuuuccgugcuggaaggaguccacagcuauaccgugucccuuucuuucgaucacgccguuguggacgagcagugucagcucaauugcggcgggcaugaaagccaggucacacugaagggaaaccugauuuuucucgacgugccuaaauucguggauggcuccuacaugcaaaccuaucacagcucuguccccacgggcgcuaauaucccuucccccacagacuggcugaacgcccuuuuugggaauggacugagcagauggauucucggcguuaucggggugcugcugggaggccuugcccucuucuuucugauuaugucucuguucaagcucgggaccaaacagguguuucgcagcagaacaaagcuggcuuga

SEQ ID NO: 14808 - RNA, 3222 nt, Artificial Sequence
  derived and/or modified CDS sequence (opt5) from SFTSV(ZJZHSH-AM/China/05/2012)__KR017846.1__GP
augaugaaggugaucugguucagcucccugauuugccucgucauccaguguucuggcgacaccgggcccauuaucugcgccggaccuauucacagcaacaaauccgcuaauaucccgcaucugcuuggcuacucugagaagaucugucaaauugauagacugauccacguuagcuccuggcuccggaaccauucucaguuucagggguaugugggacagcgcggcgggagaagccaaguguccuacuaucccgccgaaaauagcuacucucggugguccggacugcuuagcccuugcgacgcggauuggcugggcaugcucgucgugaaaaaggcuaaaggcucugacaugauuguucccgggccuuccuauaagggaaagguguucuuugagcgccccacauucgauggcuacgucggguggggauguggcagcgggaaaucuagaacggaauccggagagcugugcagcuccgacucuggcaccagcuccggccugcucccuagcgaucgggugcuguggaucggggacguugccugucagccgaugacacccauuccugaagagaccuuucuugagcugaagucuuucucccagagcgaauuucccgauaucugcaaaauugacggaaucguguucaaccagugugagucugaaagccucccucaacccuuugaugucgccuggauggacgugggccacucccauaagaucauuaugcgcgagcacaaaacaaagugggugcaggagucuagcuccaaggauuucgucugcuauaaagaagggaccggaccguguagcgagucugaagagaagacaugcaaaaccuccggcagcugcagaggggacauccaguuuuguaagguugcuggaugcgaacacggcgaggaggccucugaagcuaaaugucggugcucccuggugcauaagccuggcgagguggucgugagcuacgggggaaugcgcguuagacccaaauguuacggcuucucccggaugauggccacgcuugaagugaauccucccgagcagcgcauugggcaaugcaccggaugucaccuggaaugcaucaacggcggggucagacucauuacacugaccucugagcuuaagagcgcgacagugugugccucccauuuuugcucuagcgcuaccuccggcaagaaaagcacggagauccaguuccacucuggaucccucguuggcaaggccgcuauccacgugaaaggggcccuggucgacggaacagaauuuaccuuugagggcagcuguauguuccccgaugggugcgacgcgguggauugcacauuuugucgggaguuccuuaagaauccucagugcuauccggccaaaaaguggcuguuuauuaucauugucauccuccugggauacgcuggccuuaugcugcucaccaacgugcugaaggccauugggguuuggggcucuugggugaucgcucccgucaaacugauguucgccaucauuaagaaacucaugcgcuccgugagcugucugaugggaaagcugauggacagaggccggcaaguuauccaugaagaaauuggggagaauagagagggaaaccaggaugacgugcgcaucgaaaugguccggccuagacgcgugcggcacuggauguauucucccgugauucugaccauccucgccauuggccugacagaggggugcgaugaaaugguucaugcugacagcaaacuugucuccuguagacagggaagcggcaauaugaaggagugcgugacgaccgggcgcgcgcugcucccugccgugaaccccggccaggaggcuugucugcacuuuacagccccgggaucuccugauuccaagugccugaaaaucaaggucaaacggaucaaucucaaguguaaaaagagcuccucuuacuucgugcccgacgccagaagccgcugcaccuccguucggagaugucgcugggcuggcgauugccaaucugggugcccuagccauuuuacauccaacucuuucagcgacgacugggccggaaagauggaucgggcgggccugggguuuuccggauguagcgacggcugcgggggcgcugccuguggaugcuucaaugccgcucccucuuguauuuucuggagaaaauggguggaaaacccucacggcaucauuuggaaggucucccccugcgccgcuugggugccgagcgccguuaucgagcuuaccaugccuucuggggaagugcggacguuccaccccauguccggcauucccacacaggucuucaaaggagugagcguuaccuaucuggggucugauauggagguguccggacucaccgaccugugugaaaucgaggagcuuaagagcaaaaagcuggcgcucgccccuugcaaccaggcuggcaugggcgucguggggaaagugggagaaauccaguguuccagcgaggaaucugcccgcacaauuaagaaggauggcugcaucuggaaugcugaccuggucgggauugagcugagaguugaugacgccguguguuacagcaaaaucaccuccguggaagcggucgccaacuauucugcuauuccgacaacgaucggaggccuccgguuugagagaagccaugauucccaagggaagaucucuggaagcccccuggacauuaccgccauccgcggcuccuucucugugaauuaccggggccuuagacugagccucuccgagauuacagcuaccugcacaggggaaguuaccaacgugagcggaugcuacucuuguaugacgggcgccaaagucuccaucaagcugcacagcucuaaaaauuccaccgcccaugugcgcugcaagggggaugagacagcuuuuagcguucuggaaggagugcacuccuauaccgucucucuuagcuucgaccacgcggugguugaugagcagugucagcucaacugcggcgggcaugaaucccaggugacacugaagggaaaucugauuuuucucgacgucccuaaauucguggacggcagcuacaugcaaaccuaucacucuuccgugcccacgggcgccaacaucccuagccccacagauuggcugaaugcucuuuuugggaacggacugucuagauggauccucggcgucauugggguucugcugggaggccuugcccucuucuuucugaucaugagccuguucaagcucgggaccaaacagguguuucggucccgcacaaagcuggccuga

SEQ ID NO: 14809 - RNA, 3222 nt, Artificial Sequence
  derived and/or modified CDS sequence (opt5) from SFTSV(ZJZHSH-CXD/China/05/2012)__KR017858.1__GP
augaugaaggugaucugguucagcucccugauuugccucgucauccaguguggcggggacaccggacccauuaucugcgccggcccuauucacucuaacaaaagcgcugggaucccgcaucugcuuggauacuccgagaagaucugucaaauugauagacugauccacguuucuagcuggcuccggaaucauucccaguuucagggcuauguggggcagcgcggaggcagaucucaagugagcuacuaucccgccgaaaacuccuacagccgguggucuggccugcuuuccccuugcgacgcggauuggcuggggaugcucgucgugaaaaaggcuaaaggaagcgacaugauuguucccggcccuucuuauaaggggaagguguucuuugagcgccccacauucgauggauacgucggcuggggguguggauccggcaaaagcagaacggaaucuggcgagcugugcuccagcgacuccgggaccucuagcggacugcucccuuccgaucgggugcuguggaucggcgacguugccugucagccgaugacacccauuccugaagagaccuuucuugagcuuaagagcuucucucaguccgaauuucccgaugugugcaaaaucgacgggauugucuucaaucagugugagggagaaagccucccucaacccuuugauguggccuggauggacgugggccacucucauaagaucaucaugcgcgagcacaaaacaaaguggguccaggagagcuccucuaaggauuucguuugcuauaaagaagggaccggaccguguagcgaguccgaagagaagacaugcaaaaccagcggcucuugcagaggcgacaugcaguuuuguaagguggcugggugcgaacacggagaggaggccuccgaagcuaaaugucggugcagccuggugcauaagccuggcgaggucgugguuucuuacgggggaaugcgcgugagacccaaauguuacggcuucucccggaugauggccacgcuugaagucaacccucccgagcagcgcauugggcaaugcaccggcugucaccuggaaugcaucaauggaggcgugagacucauuacacugaccagcgagcugaaguccgcgacaguuugugccucucauuuuugcagcuccgcuaccucugggaagaaaagcacggagauccaguuccacuccggaagccucgugggcaagacagccauucacgucaaaggggcucugguggacggaaccgaguucacauuugaaggcucuuguauguuccccgaugggugcgacgccgucgauugcaccuuuugucgggaguuccuuaagaacccucagugcuauccggcgaaaaaguggcuguuuaucaucauugugauccuccugggcuacgccggacuuaugcugcucaccaauguucugaaggcuauuggcguguggggguccugggucaucgcccccgugaaacugguuuucgcuauuaucaagaaacucaugcgcgccgugagcugucugaugggaaagcugauggacagaggccggcaagucauccaugaagaaauuggggagaacagagagggaaaucagaacgaugugcgcaucgaaauggcccggccuagacgcgugcggcacuggauguauucucccguuauucugacaauccucgcuauuggcuuugcggaggggugcgacgaaaugguccaugccgauuccaaacuggugagcuguagacagggcucugagaauaugaaggagugcgugacgaccggacgcgcccuucugccugccgucaaccccggccaggaagccugucuccacuucacagcuccggggagcccugacuccaagugccugaaaaucaaggugaaacggauuaaucugaaguguaaaaagucuagcuccuacuuuguucccgaugccagaagccgcugcaccuccgugcggagaugucgcugggcgggagacugccaaucuggcugcccuccccauuucacaagcaacuccuuuucugaugacugggcugggaagauggaccgggccggacucggcuucagcggguguuccgauggcugcggaggcgccgcuugugggugcuuuaaugccgcuccuucuuguaucuucuggagaaaaugggucgagaacccccacggaaucauuuggaaggugagcccgugcgccgcguggguuccuuccgccgugaucgaacugaccaugcccagcggcgagguccggacguuccaccccaugucugggauuccuacacagguguuuaaaggaguuuccgugaccuaucuuggcagcgacauggaagucucuggccugaccgaucucugugagaucgaggaacugaaguccaaaaagcuggcucuugccccgugcaaccaggcugggaugggaguggugggcaaagucggggagauucaguguagcucugaagaguccgcccgcacaaucaagaaggacggaugcaucuggaaugcggaucucguuggcauugaacugagaguggacgaugccguguguuacagcaaaaucaccuccgucgaggcuguggccaacuauagcgcuauucccacaacgaucgggggacugcgguucgagagaucucaugacagccaaggcaagauuuccggcucuccucucgauaucaccgccauccgcgggagcuuuuccguuaauuaccggggacugagacuuucucugagcgaaauuacagcuaccugcacaggcgaggugaccaacgucuccgggugcuacucuuguaugacgggagcuaaagugagcaucaagcuccacuccagcaaaaauucuaccgcgcauguucgcugcaagggcgacgaaacagccuucuccgugcuggaggggguccacagcuauucugugucccugagcuuugaucacgcuguuguggacgaacagugucagcuuaacugcggaggccaugagucccaggucacccucagaggcaaucugauuuuccuggaugugcccaaguuuguggacgggucuuacaugcaaacauaucacagcaccgucccuacgggagccaacauccccuccccuacagacuggcucaaugcccuguucggcaacgggcuuagccgguggauucugggaguuaucggcgugcuccuugggggacuggcucuguuuuuccucaucaugucucuguuuaaacugggcaccaaacagguguuccgcuccagaacaaagcucgccuga

SEQ ID NO: 14810 - RNA, 3222 nt, Artificial Sequence
  derived and/or modified CDS sequence (opt5) from SFTSV(ZJZHSH-FDE/China/06/2012)__KR017859.1__GP
augaugaaggugaucugguucagcucccugauuugccucgucauccaguguucuggcgacaccgggcccauuaucugcgccggaccuauucacagcaacaaauccgcuaauaucccgcaucugcuuggcuacucugagaagaucugucaaauugauagacugauccacguuagcuccuggcuccggaaccauucucaguuucagggguaugugggacagcgcggcgggagaagccaaguguccuacuaucccgccgaaaauagcuacucucggugguccggacugcuuagcccuugcgacgcggauuggcugggcaugcucgucgugaaaaaggcuaaaggcucugacaugauuguucccgggccuuccuauaagggaaagguguucuuugagcgccccacauucgauggcuacgucggguggggauguggcagcgggaaaucuagaacggaauccggagagcugugcagcuccgacucuggcaccagcuccggccugcucccuagcgaucgggugcuguggaucggggacguugccugucagccgaugacacccauuccugaagagaccuuucuugagcugaagucuuucucccagagcgaauuucccgauaucugcaaaauugacggaaucguguucaaccagugugagucugaaagccucccucaacccuuugaugucgccuggauggacgugggccacucccauaagaucauuaugcgcgagcacaaaacaaagugggugcaggagucuagcuccaaggauuucgucugcuauaaagaagggaccggaccguguagcgagucugaagagaagacaugcaaaaccuccggcagcugcagaggggacaugcaguuuuguaagguugcuggaugcgaacacggcgaggaggccucugaagcuaaaugucggugcucccuggugcauaagccuggcgagguggucgugagcuacgggggaaugcgcguuagacccaaauguuacggcuucucccggaugauggccacgcuugaagugaauccucccgagcagcgcaucgggcaaugcaccggaugucaccuggaaugcauuaacggcggggucagacucaucacacugaccucugagcuuaagagcgcgacagugugugccucccauuuuugcucuagcgcuaccuccggcaagaaaagcacggagauucaguuccacucuggaucccucguuggcaaggccgcuauccacgugaaaggggcccuggucgacggaacagaguucaccuuugaaggcagcuguauguuccccgaugggugcgacgcgguggauugcacauuuugucgggaguuccuuaagaauccucagugcuauccggccaaaaaguggcuguuuaucauuaucgucauucuccugggauacgcuggccuuaugcugcucaccaacgugcugaaggccaucgggguuuggggcucuugggugauugcucccgucaaacugauguucgccaucaucaagaaacucaugcgcuccgugagcugucugaugggaaagcugauggacagaggccggcaaguuauucaugaagaaaucggggagaauagagagggaaaccaggaugacgugcgcauugaaaugguccggccuagacgcgugcggcacuggauguauucucccgugauccugaccauucucgccaucggccugacagaggggugcgaugaaaugguucaugcugacagcaaacuugucuccuguagacagggaagcggcaauaugaaggagugcgugacgaccgggcgcgcgcugcucccugccgugaaccccggccaggaggcuugucugcacuuuacagccccgggaucuccugauuccaagugccugaaaauuaaggucaaacggaucaaucucaaguguaaaaagagcuccucuuacuucgugcccgacgccagaagccgcugcaccuccguucggagaugucgcugggcuggcgauugccaaucugggugcccuagccauuuuacauccaacucuuucagcgacgacugggccggaaagauggaucgggcgggccugggguuuuccggauguagcgacggcugcgggggcgcugccuguggaugcuucaaugccgcucccucuuguaucuuuuggagaaaauggguggaaaacccucacggcauuaucuggaaggucucccccugcgccgcuugggugccgagcgccguuauugagcuuaccaugccuucuggggaagugcggacguuccaccccauguccggaauccccacacaggucuucaaaggcgugagcguuaccuaucuggggucugauauggagguguccggacucaccgaccugugugaaauugaggagcuuaagagcaaaaagcuggcgcucgccccuugcaaccaggcuggcaugggcgucguggggaaagugggagaaauccaguguuccagcgaggaaucugcccgcacaaucaagaaggauggcugcauuuggaaugcugaccuggucgggaucgagcugagaguugaugacgccguguguuacagcaaaauuaccuccguggaagcggucgccaacuauucugcuaucccgacaacgauuggaggccuccgguuugagagaagccaugauucccaagggaagaucucuggaagcccccuggacaucaccgccauucgcggcuccuucucugugaauuaccggggccuuagacugagccucuccgagaucacagcuaccugcacaggggaaguuaccaacgugagcggaugcuacucuuguaugacgggcgccaaagucuccauuaagcugcacagcucuaaaaauuccaccgcccaugugcgcugcaagggggaugagacagcuuuuagcguucuggaaggagugcacuccuauaccgucucucuuagcuucgaccacgcggugguugaugagcagugucagcucaacugcggcgggcaugaaucccaggugacacugaagggaaaucugaucuuucucgacgucccuaaauucguggacggcagcuacaugcaaaccuaucacucuuccgugcccacgggcgccaacauuccuagccccacagauuggcugaaugcucuuuuugggaacggacugucuagauggauccucggcgucaucgggguucugcugggaggccuugcccucuucuuucugauuaugagccuguucaagcucgggaccaaacagguguuucggucccgcacaaagcuggccuga

SEQ ID NO: 14811 - RNA, 3222 nt, Artificial Sequence
  derived and/or modified CDS sequence (opt5) from SFTSV(ZJZHSH-FZHR/China/07/2013)__KR017862.1__GP
augaugaaggugaucugguucagcucccugauuugccucgucauccaguguggcggggacaccggacccauuaucugcgccggcccuauucacucuaacaaaagagcugggaucccgcaucugcuuggauacagcgagaagaucugucaaauugaucggcugauccacguuuccucuuggcuccgcaaucauagccaguuucagggcuauguggggcagagaggaggccggucccaagugucuuacuaucccgccgaaaacagcuacucccgcuggagcggccugcuuucuccuugcgacgcggauuggcuggggaugcucgucgugaaaaaggcuaaaggauccgacaugauuguucccggcccuagcuauaaggggaagguguucuuugagagacccacauucgauggauacgucggcuggggguguggaucuggcaaaucccggacggaaagcggcgagcuguguucuuccgacagcgggaccuccucuggacugcucccuagcgaucgcgugcuguggaucggcgacguugccugccagccgaugacacccauuccugaagagaccuuucuugagcugaaguccuucagccagucugaauuucccgaugugugcaaaaucgacgggauugucuucaaucagugugagggagaaucccucccucaacccuuugauguggccuggauggacgugggccacagccauaagaucaucaugagagagcacaaaacaaaguggguccaggagucuagcuccaaggauuucguuugcuauaaagaagggaccggaccguguucugagagcgaagagaagacaugcaaaaccuccggcagcugccggggcgacaugcaguuuuguaagguggcugggugcgaacacggagaggaggccucugaagcuaaaugucgcugcucccuggugcauaagccuggcgaggucgugguuagcuacgggggaaugagagugcggcccaaauguuacggcuucucucgcaugauggccacgcuugaagucaacccucccgagcagagaauugggcaaugcaccggcugucaccuggaaugcaucaauggaggcgugcggcucauuacacugaccuccgagcuuaagagcgcgacaguuugugccucccauuuuugcucuagcgcuaccuccgggaagaaaucuacggagauccaguuccacagcggaucccucgugggcaagacagccauucacgucaaaggggcucugguggacggaaccgaguucacauuugaaggcagcuguauguuccccgaugggugcgacgccgucgauugcaccuuuugucgcgaguuccuuaagaacccucagugcuauccggcgaaaaaguggcuguuuaucaucauugugauccuccugggcuacgccggacuuaugcugcucaccaauguucugaaggcuauuggcgugugggggucuugggucaucgcccccgugaaacugguuuucgcuauuaucaagaaacucaugagagccguguccugucugaugggaaagcugauggaccggggcagacaagucauccaugaagaaauuggggagaaccgcgagggaaaucaggaugacgugcggaucgaaauggccagaccucgccgggugagacacuggauguauagccccguuauucugacaauccucgcuauuggccuggcggaggggugcgaugaaaugguccaugccgacucuaaacuuguguccugucgccagggcagcggaaacaugaaggagugcgugacgaccggccgggcucugcucccugccgucaaucccgggcaggaggccugucugcacuuuacagcuccgggaucuccugauagcaagugccugaaaaucaaggugaaaagaauuaaccucaaguguaaaaaguccagcucuuacuucguucccgacgcccgcucccggugcaccagcgugagacgcugucggugggcgggcgauugccaauccgggugcccuccccauuuuacaucuaauagcuucuccgacgacugggcuggaaagauggauagagccggccugggguuuucuggcuguagcgacggaugcggcggggccgcuuguggaugcuucaacgccgcuccuuccuguaucuuuuggcggaaaugggucgaaaauccccacggcaucauuuggaaggugucuccgugcgccgcguggguuccuagcgccgugaucgagcuuaccaugcccuccggggaaguccgcacguuccaccccaugagcggcauuccuacacagguguucaaaggaguuucugugaccuaucugggcuccgauauggaggucagcgggcucaccgaccugugugaaaucgaggagcugaagucuaaaaagcucgcucuugccccgugcaaccaggcuggaaugggcgugguggggaaagucggagaaauucaguguuccagcgaggaaucugccagaacaaucaagaaggauggcugcaucuggaacgcggaccugguugggauugagcugcggguggaugacgccguguguuacuccaaaaucaccagcgucgaagcuguggccaauuauuccgcuauucccacaacgaucggaggccucagauuugagcgcagccaugauucucaaggcaagauuagcggguccccucuggacaucaccgccauccggggaucuuucagcguuaacuacagaggccuucgccugucccucucugagauuacagcuaccugcacaggggaagugaccaaugucagcggaugcuacuccuguaugacgggcgccaaagugucuaucaagcugcacagcuccaaaaacagcaccgcgcauguuagaugcaagggggaugagacagccuuuucugugcuggaaggaguccacuccuauagcgugucucuuuccuucgaccacgcuguuguggaugagcagugucagcucaauugcggcggccaugaaagccaggucacccugcgggggaaccugauuuuucucgacgugcccaaguucguggacggauccuacaugcaaacauaucacucuaccgucccuacgggcgccaauauccccagcccuacagauuggcugaacgcccuuuuugggaauggacugucccgcuggauucucggcguuaucggggugcugcugggaggccuugcucucuucuuucugaucaugagccuguucaaacucggcaccaaacagguguuuagaucucggacaaagcuggccuga

SEQ ID NO: 14812 - RNA, 3222 nt, Artificial Sequence
  derived and/or modified CDS sequence (opt5) from SFTSV(ZJZHSH-HCY/China/06/2012)__KR017855.1__GP
augaugaaggugaucugguuccccagccugauuugccucgucauccaguguuccggcgacaccgggccuauuaucugcgccggaccgauucacucuaacaaaagcgcuaauaucccccaucugcuuggcuacuccgagaagaucugucaaauugauagacugauccacguuucuagcuggcuccggaaccauucccaguuucagggguaugugggacagcgcggcgggagaucucaagugagcuacuauccugccgaaaauuccuacagccgguggucuggacugcuuucccccugcgacgcggauuggcugggcaugcucgucgugaaaaaggcuaaaggcagcgacaugauuguuccugggcccucuuauaagggaaagguguucuuugagcgcccuacauucgauggcuacgucggguggggauguggcuccgggaaaagcagaacggaaucuggagagcugugcuccagcgacuccggcaccucuagcggccugcucccguccgaucgggugcuguggaucggggacguugccugucagcccaugacaccuauucccgaagagaccuuucuugagcuuaagagcuucucucaguccgaauuuccugauaucugcaaaauugacggaaucguguucaaccagugugagagcgaaucucucccccaaccguuugaugucgccuggauggacgugggccacagccauaagaucauuaugcgcgagcacaaaacaaagugggugcaggaguccucuagcaaggauuucgucugcuauaaagaagggaccggaccuuguuccgagagcgaagagaagacaugcaaaaccucuggcuccugcagaggggacaugcaguuuuguaagguugcuggaugcgaacacggcgaggaggccagcgaagcuaaaugucggugcucucuggugcauaagcccggcgagguggucguguccuacgggggaaugcgcguuagaccuaaauguuacggcuucagccggaugauggccacgcuugaagugaauccucccgagcagcgcaucgggcaaugcaccggaugucaccuggaaugcauuaacggcggggucagacucgugacacugaccuccgagcugaagucugcgacaguuugugccagccauuuuugcuccucugcuaccagcggcaagaaauccacggagauccaguuccacagcggaucucucgugggcaaggccgcuauucacgucaaaggggcccugguggacggaacagaguucaccuuugaaggcuccuguauguuccccgaugggugcgacgcggucgauugcacauuuugucgggaguuccuuaagaauccgcagugcuaucccgccaaaaaguggcuguuuaucaucauugugauccuccugggauacgcuggccuuaugcugcucaccaacguucugaaggccauugggguguggggcagcugggucaucgcuccugugaaacugauguucgccauuaucaagaaacucaugcgcucuguuuccugucugaugggaaagcugauggacagaggccggcaagugauccaugaagaaauuggggagaauagagagggaaaccaggaugacguccgcaucgaaauggugcggcccagacgcgugcggcacuggauguauagcccuguuauucugaccauccucgccauuggccugacagaggggugcgaugaaaugguccaugcugacucuaaacuugugagcuguagacagggauccggcaauaugaaggagugcgugacgaccgggcgcgcgcugcuccccgccgucaacccgggccaggaggcuugucugcacuuuacagccccuggaagccccgauucuaagugccugaaaaucaaggugaaacggauuaaucucaaguguaaaaaguccagcuccuacuucguuccugacgccagaucucgcugcaccagcgugcggagaugucgcugggcuggcgauugccaauccgggugccccucucauuuuacaagcaacuccuucucugacgacugggccggaaagauggaucgggcgggccugggguuuagcggauguuccgacggcugcgggggcgcugccuguggaugcuucaaugccgcuccuagcuguaucuuuuggagaaaaugggucgaaaacccccacggcaucauuuggaaggugucuccgugcgccgcuuggguuccuuccgccgugaucgagcuuaccaugcccagcggggaaguccggacguuccaccccaugucuggcauuccuacacagguguucaaaggaguuuccgugaccuaucuggggagcgauauggaggucucuggacucaccgaccugugugaaaucgaggagcugaaguccaaaaagcucgcgcuugccccgugcaaccaggcuggcaugggcgugguggggaaagucggagaaauucaguguagcuccgaggaaagcgcccgcacaaucaagaaggauggcugcaucuggaaugcugaccugguugggauugagcugagaguggaugacgccguguguuacucuaaaaucaccagcgucgaagcgguggccaacuauuccgcuauucccacaacgaucggaggccuccgguuugagagaucucaugauagccaagggaagauuuccggaucuccucuggacaucaccgccauccgcggcagcuucuccguuaauuaccggggccuuagacugucucucagcgagauuacagcuaccugcacaggggaagugaccaacgucuccggaugcuacagcuguaugacgggcgccaaagugucuaucaagcugcacuccagcaaaaauucuaccgcccauguucgcugcaagggggaugagacagcuuuuuccgugcuggaaggaguccacagcuauaccgugucccuuucuuucgaccacgcgguuguggaugagcagugucagcucaacugcggcgggcaugaaagccaggucacacugaagggaaaucugauuuuucucgacgugcccaaauucguggacggcuccuacaugcaaaccuaucacagcucugucccuacgggcgccaacauccccuccccuacagauuggcugaaugcucuuuuugggaacggacugagcagauggauucucggcguuaucggggugcugcugggaggccuugcccucuucuuucuguucaugucucuguuuaagcucgggaccaaacagguguuccggagccgcacaaagcuggccuga

SEQ ID NO: 14813 - RNA, 3222 nt, Artificial Sequence
  derived and/or modified CDS sequence (opt5) from SFTSV(ZJZHSH-HYC/China/05/2012)__KR017847.1__GP
augaugaaggugaucugguucagcucccugauuugccucgucauccaguguucuggcgacaccgggcccauuaucugcgccggaccuauucacagcaacaaauccgcuaauaucccgcaucugcuuggcuacucugagaagaucugucaaauugauagacugauccacguuagcuccuggcuccggaaccauucucaguuucagggguaugugggacagcgcggcgggagaagccaaguguccuacuaucccgccgaaaauagcuacucucggugguccggacugcuuagcccuugcgacgcggauuggcugggcaugcucgucgugaaaaaggcuaaaggcucugacaugauuguucccgggccuuccuauaagggaaagguguucuuugagcgccccacauucgauggcuacgucggguggggauguggcagcgggaaaucuagaacggaauccggagagcugugcagcuccgacucuggcaccagcuccggccugcucccuagcgaucgggugcuguggaucggggacguugccugucagccgaugacacccauuccugaagagaccuuucuugagcugaagucuuucucccagagcgaauuucccgauaucugcaaaauugacggaaucguguucaaccagugugagucugaaagccucccucaacccuuugaugucgccuggauggacgugggccacucccauaagaucauuaugcgcgagcacaaaacaaagugggugcaggagucuagcuccaaggauuucgucugcuauaaagaagggaccggaccguguagcgagucugaagagaagacaugcaaaaccuccggcagcugcagaggggacaugcaguuuuguaagguugcuggaugcgaacacggcgaggaggccucugaagcuaaaugucggugcucccuggugcauaagccuggcgagguggucgugagcuacgggggaaugcgcguuagacccaaauguuacggcuucucccggaugauggccacgcuugaagugaauccucccgagcagcgcaucgggcaaugcaccggaugucaccuggaaugcauuaacggcggggucagacucaucacacugaccucugagcuuaagagcgcgacagugugugccucccauuuuugcucuagcgcuaccuccggcaagaaaagcacggagauucaguuccacucuggaucccucguuggcaaggccgcuauccacgugaaaggggcccuggucgacggaacagaguucaccuuugaaggcagcuguauguuccccgaugggugcgacgcgguggauugcacauuuugucgggaguuccuuaagaauccucagugcuauccggccaaaaaguggcuguuuaucauuaucgucauucuccugggauacgcuggccuuaugcugcucaccaacgugcugaaggccaucgggguuuggggcucuugggugauugcucccgucaaacugauguucgccaucaucaagaaacucaugcgcuccgugagcugucugaugggaaagcugauggacagaggccggcaaguuauucaugaagaaaucggggagaauagaaaaggaaaccaggaugacgugcgcauugagaugguccggccuagacgcgugcggcacuggauguauucucccgugauccugaccauucucgccaucggccugacagaagggugcgaugagaugguucaugcugacagcaaacuugucuccuguagacagggaagcggcaauaugaaggaaugcgugacgaccgggcgcgcgcugcucccugccgugaaccccggccaggaggcuugucugcacuuuacagccccgggaucuccugauuccaagugccugaagauuaaagucaagcggaucaaucucaaauguaaaaagagcuccucuuacuucgugcccgacgccagaagccgcugcaccuccguucggagaugucgcugggcuggcgauugccaaucugggugcccuagccauuuuacauccaacucuuucagcgacgacugggccggaaagauggaucgggcgggccugggguuuuccggauguagcgacggcugcgggggcgcugccuguggaugcuucaaugccgcucccucuuguaucuuuuggagaaaguggguggagaacccucacggcauuaucuggaaagucucccccugcgccgcuugggugccgagcgccguuauugaacuuaccaugccuucuggggaggugcggacguuccaccccauguccggaauccccacacaggucuucaagggcgugagcguuaccuaucuggggucugauauggaaguguccggacucaccgaccugugugagauugaggaacugaaaagcaagaaacuugcgcucgccccuugcaaccaggcuggcaugggcgucguggggaaggugggagagauccaguguuccagcgaagagucugcccgcacaaucaagaaagauggcugcauuuggaaugcugaccuggucgggaucgaacugagaguugaugacgccguguguuacagcaagauuaccuccguggaggcggucgccaacuauucugcuaucccgacaacgauuggaggccuccgguuugaaagaagccaugauucccaagggaaaaucucuggaagcccccuggacaucaccgccauucgcggcuccuucucugugaauuaccggggccuuagacugagccucuccgagaucacagcuaccugcacaggggagguuaccaacgugagcggaugcuacucuuguaugacgggcgccaaggucuccauuaaacugcacagcucuaaaaauuccaccgcccaugugcgcugcaagggggaugaaacagcuuuuagcguucuggagggagugcacuccuauaccgucucucuuagcuucgaccacgcggugguugaugaacagugucagcucaacugcggcgggcaugagucccaggugacacugaagggaaaucugaucuuucucgacgucccuaaguucguggacggcagcuacaugcaaaccuaucacucuuccgugcccacgggcgccaacauuccuagccccacagauuggcugaaugcucuuuuugggaacggacugucuagauggauccucggcgucaucgggguucugcugggaggccuugcccucuucuuucugauuaugagccuguucaaacucgggaccaaacagguguuucggucccgcacaaagcuggccuga

SEQ ID NO: 14814 - RNA, 3222 nt, Artificial Sequence
  derived and/or modified CDS sequence (opt5) from SFTSV(ZJZHSH-HYJ/China/07/2012)__KR017852.1__GP
augaugaaggugaucugguucagcucccugauuugccucgucauccaguguucuggcgacaccgggcccauuaucugcgccggaccuauucacagcaacaaauccgcuaauaucccgcaucugcuuggcuacucugagaagaucugucaaauugauagacugauccacguuagcuccuggcuccggaaccauucucaguuucagggguaugugggacagcgcggcgggagaagccaaguguccuacuaucccgccgaaaauagcuacucucggugguccggacugcuuagcccuugcgacgcggauuggcugggcaugcucgucgugaaaaaggcuaaaggcucugacaugauuguucccgggccuuccuauaagggaaagguguucuuugagcgccccacauucgauggcuacgucggguggggauguggcagcgggaaaucuagaacggaauccggagagcugugcagcuccgacucuggcaccagcuccggccugcucccuagcgaucgggugcuguggaucggggacguugccugucagccgaugacacccauuccugaagagaccuuucuugagcugaagucuuucucccagagcgaauuucccgauaucugcaaaauugacggaaucguguucaaccagugugagucugaaagccucccucaacccuuugaugucgccuggauggacgugggccacucccauaagaucauuaugcgcgagcacaaaacaaagugggugcaggagucuagcuccaaggauuucgucugcuauaaagaagggaccggaccguguagcgagucugaagagaagacaugcaaaaccuccggcagcugcagaggggacaugcaguuuuguaagguugcuggaugcgaacacggcgaggaggccucugaagcuaaaugucggugcucccuggugcauaagccuggcgagguggucgugagcuacgggggaaugcgcguuagacccaaauguuacggcuucucccggaugauggccacgcuugaagugaauccucccgagcagcgcaucgggcaaugcaccggaugucaccuggaaugcauuaacggcggggucagacucaucacacugaccucugagcuuaagagcgcgacagugugugccucccauuuuugcucuagcgcuaccuccggcaagaaaagcacggagauucaguuccacucuggaucccucguuggcaaggccgcuauccacgugaaaggggcccuggucgacggaacagaguucaccuuugaaggcagcuguauguuccccgaugggugcgacgcgguggauugcacauuuugucgggaguuccuuaagaauccucagugcuauccggccaaaaaguggcuguuuaucauuaucgucauucuccugggauacgcuggccuuaugcugcucaccaacgugcugaaggccaucgggguuuggggcucuugggugauugcucccgucaaacugauguucgccaucaucaagaaacucaugcgcuccgugagcugucugaugggaaagcugauggacagaggccggcaaguuauucaugaagaaaucggggagaauagagagggaaaccaggaugacgugcgcauugaaaugguccggccuagacgcgugcggcacuggauguauucucccgugauccugaccauucucgccaucggccugacagaggggugcgaugaaaugguucaugcugacagcaaacuugucuccuguagacagggaagcggcaauaugaaggagugcgugacgaccgggcgcgcgcugcucccugccgugaaccccggccaggaggcuugucugcacuuuacagccccgggaucuccugauuccaagugccugaaagucaaggugaaacggauuaaucucaaguguaaaaagagcuccucuuacuucguucccgacgccagaagccgcugcaccuccgugcggagaugucgcugggcuggcgauugccaaucugggugcccuagccauuuuacauccaacucuuucagcgacgacugggccggaaagauggaucgggcgggccugggguuuuccggauguagcgacggcugcgggggcgcugccuguggaugcuucaaugccgcucccucuuguaucuuuuggagaaaaugggucgaaaacccucacggcaucauuuggaaggugucccccugcgccgcuuggguuccgagcgccgugaucgagcuuaccaugccuucuggggaaguccggacguuccaccccauguccggcauucccacacagguguucaaaggaguuagcgugaccuaucuggggucugauauggaggucuccggacucaccgaccugugugaaaucgaggagcuuaagagcaaaaagcuggcgcucgccccuugcaaccaggcuggcaugggcgugguggggaaagucggagaaauucaguguuccagcgaggaaucugcccgcacaaucaagaaggauggcugcaucuggaaugcugaccugguugggauugagcugagaguggaugacgccguguguuacagcaaaaucaccuccgucgaagcgguggccaacuauucugcuauuccgacaacgaucggaggccuccgguuugagagaagccaugauucccaagggaagauuucuggaagcccccuggacaucaccgccauccgcggcuccuucucuguuaauuaccggggccuuagacugagccucuccgagauuacagcuaccugcacaggggaagugaccaacgucagcggaugcuacucuuguaugacgggcgccaaaguguccaucaagcugcacagcucuaaaaauuccaccgcccauguucgcugcaagggggaugagacagcuuuuagcgugcuggaaggaguccacuccuauaccgugucucuuagcuucgaccacgcgguuguggaugagcagugucagcucaacugcggcgggcaugaaucccaggucacacugaagggaaaucugauuuuucucgacgugccuaaauucguggacggcagcuacaugcaaaccuaucacucuuccguccccacgggcgccaacaucccuagccccacagauuggcugaaugcucuuuuugggaacggacugucuagauggauucucggcguuaucggggugcugcugggaggccuugcccucuucuuucugaucaugagccuguucaagcucgggaccaaacagguguuucggucccgcacaaagcuggccuga

SEQ ID NO: 14815 - RNA, 3222 nt, Artificial Sequence
  derived and/or modified CDS sequence (opt5) from SFTSV(ZJZHSH-LU/China/10/2011)__KR017850.1__GP
augaugaaggugaucugguucagcucccugauuugccucgucauccaguguucuggcgacaccgggcccauuaucugcgccggaccuauucacagcaacaaauccgcuaauaucccgcaucugcuuggcuacucugagaagaucugucaaauugauagacugauccacguuagcuccuggcuccggaaccauucucaguuucagggguaugugggacagcgcggcgggagaagccaaguguccuacuaucccgccgaaaauagcuacucucggugguccggacugcuuagcccuugcgacgcggauuggcugggcaugcucgucgugaaaaaggcuaaaggcucugacaugauuguucccgggccuuccuauaagggaaagguguucuuugagcgccccacauucgauggcuacgucggguggggauguggcagcgggaaaucuagaacggaauccggagagcugugcagcuccgacucuggcaccagcuccggccugcucccuagcgaucgggugcuguggaucggggacguugccugucagccgaugacacccauuccugaagagaccuuucuugagcugaagucuuucucccagagcgaauuucccgauaugugcaaaaucgacggaauuguguucaaccagugugagucugaaagccucccucaacccuuugaugucgccuggauggacgugggccacucccauaagaucaucaugcgcgagcacaaaacaaagugggugcaggagucuagcuccaaggauuucgucugcuauaaagaagggaccggaccguguagcgagucugaagagaagacaugcaaaaccuccggcagcugcagaggggacaugcaguuuuguaagguugcuggaugcgaacacggcgaggaggccucugaagcuaaaugucggugcucccuggugcauaagccuggcgagguggucgugagcuacgggggaaugcgcguuagacccaaauguuacggcuucucccggaugauggccacgcuugaagugaauccucccgagcagcgcauugggcaaugcaccggaugucaccuggaaugcaucaacggcggggucagacucgugacacugaccucugagcuuaagagcgcgacaguuugugccucccauuuuugcucuagcgcuaccuccggcaagaaaagcacggagauucaguuccacucuggaucccucgugggcaaggccgcuauccacgucaaaggggcccugguggacggaacagaauuuaccuuugagggcagcuguauguuccccgaugggugcgacgcggucgauugcacauuuugucgggaguuccuuaagaauccucagugcuauccggccaaaaaguggcuguuuauuaucaucgugauucuccugggauacgcuggccuuaugcugcucaccaacguucugaaggccaucgggguguggggcucuugggucauugcucccgugaaacugauguucgccaucauuaagaaacucaugcgcuccguuagcugucugaugggaaagcugauggacagaggccggcaagugauccaugaagaaaucggggagaauagagagggaaaccaggaugacguccgcauugaaauggugcggccuagacgcgugcggcacuggauguauucucccguuauccugaccauucucgccaucggccugacagaggggugcgaugaaaugguccaugcugacagcaaacuuguguccuguagacagggaagcggcaauaugaaggagugcgugacgaccgggcgcgcgcugcucccugccgucaaccccggccaggaggcuugucugcacuuuacagccccgggaucuccugauuccaagugccugaaaauuaaggugaaacggaucaaucucaaguguaaaaagagcuccucuuacuucguucccgacgccagaagccgcugcaccuccgugcggagaugucgcugggcuggcgauugccaaucugggugcccuagccauuuuacauccaacucuuucagcgacgacugggccggaaagauggaucgggcgggccugggguuuuccggauguagcgacggcugcgggggcgcugccuguggaugcuucaaugccgcucccucuuguauuuucuggagaaaaugggucgaaaacccucacggcaucaucuggaaggugucccccugcgccgcuuggguuccgagcgccgugauugagcuuaccaugccuucuggggaaguccggacguuccaccccauguccggaauccccacacagguguucaaaggcguuagcgugaccuaucuggggucugauauggaggucuccggacucaccgaccugugugaaauugaggagcuuaagagcaaaaagcuggcgcucgccccuugcaaccaggcuggcaugggcgugguggggaaagucggagaaauccaguguuccagcgaggaaucugcccgcacaauuaagaaggauggcugcaucuggaaugcugaccugguugggaucgagcugagaguggaugacgccguguguuacagcaaaauuaccuccgucgaagcgguggccaacuauucugcuaucccgacaacgauuggaggccuccgguuugagagaagccaugauucccaagggaagaucucuggaagcccccuggacauuaccgccauccgcggcuccuucucuguuaauuaccggggccuuagacugagccucuccgagaucacagcuaccugcacaggggaagugaccaacgucagcggaugcuacucuuguaugacgggcgccaaaguguccauuaagcugcacagcucuaaaaauuccaccgcccauguucgcugcaagggggaugagacagcuuuuagcgugcuggaaggaguccacuccuauaccgugucucuuagcuucgaccacgcgguuguggaugagcagugucagcucaacugcggcgggcaugaaucccaggucacacugaagggaaaucugaucuuucucgacgugccuaaauucguggacggcagcuacaugcaaaccuaucacucuuccguccccacgggcgccaacauuccuagccccacagauuggcugaaugcucuuuuugggaacggacugucuagauggauccucggcguuauuggggugcugcugggaggccuugcccucuucuuucugaucaugagccuguucaagcucgggaccaaacagguguuucggucccgcacaaagcuggccuga

SEQ ID NO: 14816 - RNA, 3222 nt, Artificial Sequence
  derived and/or modified CDS sequence (opt5) from SFTSV(ZJZHSH-SHZ/China/05/2012)__KR017848.1__GP
augaugaaggugaucugguucagcucccugauuugccucgucauccaguguucuggcgacaccgggcccauuaucugcgccggaccuauucacagcaacaaauccgcuaauaucccgcaucugcuuggcuacucugagaagaucugucaaauugauagacugauccacguuagcuccuggcuccggaaccauucucaguuucagggguaugugggacagcgcggcgggagaagccaaguguccuacuaucccgccgaaaauagcuacucucggugguccggacugcuuagcccuugcgacgcggauuggcugggcaugcucgucgugaaaaaggcuaaaggcucugacaugauuguucccgggccuuccuauaagggaaagguguucuuugagcgccccacauucgauggcuacgucggguggggauguggcagcgggaaaucuagaacggaauccggagagcugugcagcuccgacucuggcaccagcuccggccugcucccuagcgaucgggugcuguggaucggggacguugccugucagccgaugacacccauuccugaagagaccuuucuugagcugaagucuuucucccagagcgaauuucccgauaucugcaaaauugacggaaucguguucaaccagugugagucugaaagccucccucaacccuuugaugucgccuggauggacgugggccacucccauaagaucauuaugcgcgagcacaaaacaaagugggugcaggagucuagcuccaaggauuucgucugcuauaaagaagggaccggaccguguagcgagucugaagagaagacaugcaaaaccuccggcagcugcagaggggacaugcaguuuuguaagguugcuggaugcgaacacggcgaggaggccucugaagcuaaaugucggugcucccuggugcauaagccuggcgagguggucgugagcuacgggggaaugcgcguuagacccaaauguuacggcuucucccggaugauggccacgcuugaagugaauccucccgagcagcgcaucgggcaaugcaccggaugucaccuggaaugcauuaacggcggggucagacucgugacacugaccucugagcuuaagagcgcgacaguuugugccucccauuuuugcucuagcgcuaccuccggcaagaaaagcacggagauccaguuccacucuggaucccucgugggcaaggccgcuauucacgucaaaggggcccugguggacggaacagaguucaccuuugaaggcagcuguauguuccccgaugggugcgacgcggucgauugcacauuuugucgggaguuccuuaagaauccucagugcuauccggccaaaaaguggcuguuuaucaucauugugauccuccugggauacgcuggccuuaugcugcucaccaacguucugaaggccauugggguguggggcucuugggucaucgcucccgugaaacugauguucgccauuaucaagaaacucaugcgcuccguuagcugucugaugggaaagcugauggacagaggccggcaagugauccaugaagaaauuggggagaauagagagggaaaccaggaugacguccgcaucgaaauggugcggccuagacgcgugcggcacuggauguauucucccguuauucugaccauccucgccauuggccugacagaggggugcgaugaaaugguccaugcugacagcaaacuuguguccuguagacagggaagcggcaauaugaaggagugcgugacgaccgggcgcgcgcugcucccugccgucaaccccggccaggaggcuugucugcacuuuacagccccgggaucuccugauuccaagugccugaaaaucaaggugaaacggauuaaucucaaguguaaaaagagcuccucuuacuucguucccgacgccagaagccgcugcaccuccgugcggagaugucgcugggcuggcgauugccaaucugggugcccuagccauuuuacauccaacucuuucagcgacgacugggccggaaagauggaucgggcgggccugggguuuuccggauguagcgacggcugcgggggcgcugccuguggaugcuucaaugccgcucccucuuguaucuuuuggagaaaaugggucgaaaacccucacggcaucauuuggaaggugucccccugcgccgcuuggguuccgagcgccgugaucgagcuuaccaugccuucuggggaaguccggacguuccaccccauguccggcauucccacacagguguucaaaggaguuagcgugaccuaucuggggucugauauggaggucuccggacucaccgaccugugugaaaucgaggagcuuaagagcaaaaagcuggcgcucgccccuugcaaccaggcuggcaugggcgugguggggaaagucggagaaauucaguguuccagcgaggaaucugcccgcacaaucaagaaggauggcugcaucuggaaugcugaccugguugggauugagcugagaguggaugacgccguguguuacagcaaaaucaccuccgucgaagcgguggccaacuauucugcuauuccgacaacgaucggaggccuccgguuugagagaagccaugauucccaagggaagauuucuggaagcccccuggacaucaccgccauccgcggcuccuucucuguuaauuaccggggccuuagacugagccucuccgagauuacagcuaccugcacaggggaagugaccaacgucagcggaugcuacucuuguaugacgggcgccaaaguguccaucaagcugcacagcucuaaaaauuccaccgcccauguucgcugcaagggggaugagacagcuuuuagcgugcuggaaggaguccacggcuauaccgugucccuuucuuucgaccacgcgguuguggaugagcagugucagcucaacugcgggggacaugaaagccaggucacacugaagggcaaucugauuuuucucgacgugccuaaauucguggacggcuccuacaugcaaaccuaucacagcucuguccccacgggggccaacaucccuucccccacagauuggcugaaugcucuuuuuggaaacggccugagcagauggauucucgggguuaucggagugcugcugggcgggcuugcccucuucuuucugaucaugucucuguucaagcucggaaccaaacagguguuucggagccgcacaaagcuggccuga

SEQ ID NO: 14817 - RNA, 3222 nt, Artificial Sequence
  derived and/or modified CDS sequence (opt5) from SFTSV(ZJZHSH-WSH/China/08/2012)__KR017854.1__GP
augaugaaggugaucugguucagcucccugauuugccucgucauccaguguggcggggacaccggacccauuaucugcgccggcccuauucacucuaacaaaagcgcugggaucccgcaucugcuuggauacuccgagaagaucugucaaauugauagacugauccacguuucuagcuggcuccggaaucauucccaguuucagggcuauguggggcagcgcggaggcagaucucaagugagcuacuaucccgccgaaaacuccuacagccgguggucuggccugcuuuccccuugcgacgcggauuggcuggggaugcucgucgugaaaaaggcuaaaggaagcgacaugauuguucccggcccuucuuauaaggggaagguguucuuugagcgccccacauucgauggauacgucggcuggggguguggauccggcaaaagcagaacggaaucuggcgagcugugcuccagcgacuccgggaccucuagcggacugcucccuuccgaucgggugcuguggaucggcgacguugccugucagccgaugacacccauuccugaagagaccuuucuugagcuuaagagcuucucucaguccgaauuucccgaugugugcaaaaucgacgggauugucuucaaucagugugagggagaaagccucccucaacccuuugauguggccuggauggacgugggccacucucauaagaucaucaugcgcgagcacaaaacaaaguggguccaggagagcuccucuaaggauuucguuugcuauaaagaagggaccggaccguguagcgaguccgaagagaagacaugcaaaaccagcggcucuugcagaggcgacaugcaguuuuguaagguggcugggugcgaacacggagaggaggccuccgaagcuaaaugucggugcagccuggugcagaagccuggcgaggucgugguuucuuacgggggaaugcgcgugagacccaaauguuacggcuucucccggaugauggccacgcuugaagucaacccucccgagcaacgcauugggcagugcaccggcugucaucuggaaugcaucaauggaggcgugagacucauuacacugaccagcgagcugaaguccgcgacaguuugugccucucacuuuugcagcuccgcuaccucugggaagaaaagcacggagauccaguuccauuccggaagccucgugggcaagacagccauucacgucaaaggggcucugguggacggaaccgaauuuacauuugagggcucuuguauguuccccgaugggugcgacgccgucgauugcaccuuuugucgggaguuccuuaagaacccucaaugcuauccggcgaaaaaguggcuguuuaucaucauugugauccuccugggcuacgccggacuuaugcugcucaccaauguucugaaggcuauuggcguguggggguccugggucaucgcccccgugaaacugauguucgcuauuaugaagaaacucaugcgcagcguuucuugucugaugggaaagcugauggacagaggcagacaggugauccacgaagaaaucggggagaaccgggagggaaaucaggaugacguccgcauugaaauggugcggccuagacgcgugcggcauuggauguauucccccguuauccugacaauucucgccaucggccugacggaggggugcgaugaaaugguccacgccgacagcaaacuugugucuuguagacagggcagcggaaacaugaaggagugcgugaccacaggccgcgcucugcucccugcggucaaucccgggcaagaggccugucugcauuuuaccgcuccgggauccccugauagcaagugccugaaaauuaaggugaaacggaucaaccucaaguguaaaaagucuuccagcuacuucguucccgacgccagaucccgcugcacaucugugcggagaugucgcugggccggcgauugccagagcgggugcccuccccacuuuaccuccaauucuuucagcgacgacugggcuggaaagauggaucgggccggccugggguuuuccggcuguucugacggaugcggcggggcggcuuguggaugcuucaacgccgccccuagcuguauuuucuggagaaaaugggucgaaaauccccauggcaucaucuggaagguguccccgugcgcugccuggguuccuagcgcugugauugagcuuacgaugcccucuggggaaguccggacauuccaccccauguccggaaucccuacccagguguucaaaggcguuagcgugaccuaucugggcucugauauggaggucuccgggcucacagaccugugugaaauugaggagcuuaagagcaaaaagcuggcccucgcgccgugcaaccaggccggaaugggcgugguggggaaagucggagaaauccaauguucuuccgaggaaagcgcucgcaccauuaagaaggauggcugcaucuggaacgccgaccugguugggaucgagcugagaguggaugacgcuguguguuacuccaaaauuacaagcgucgaagccguggcgaauuauucugccauccccacgaccauuggaggccuccgguuugagagaagccacgauucccagggcaagaucucugggagcccucuggacauuacagcuauccgcggauccuucucuguuaacuaccggggccuuagacugagccucuccgagaucaccgccacaugcaccggggaagugacgaaugucucuggaugcuacagcuguaugaccggcgcuaaaguguccauuaagcugcauagcucuaaaaacuccacagcccacguucgcugcaagggggaugagaccgccuuuagcgugcuggaaggaguccauucuuauuccgugagccuuuccuucgaccacgcuguuguggaugagcagugucagcucaauugcggcggccacgaaucucaagucacacugagagggaaccugaucuuucucgacgugcccaaguucguggacggaagcuacaugcagaccuaucauuccacggucccuacaggcgcgaauauucccagcccuaccgauuggcugaacgcccuuuuugggaauggacugucucgguggauccucggcguuauuggggugcugcugggaggccuugcucucuucuuucugaucaugucccuguucaaacucggcacaaaacagguguuucgcagcagaaccaagcuggccuga

SEQ ID NO: 14818 - RNA, 3222 nt, Artificial Sequence
  derived and/or modified CDS sequence (opt5) from SFTSV(ZJZHSH-XAM/China/06/2012)__KR017853.1__GP
augaugaaggugaucugguucagcucccugauuugccucgucauccaguguucuggcgacaccgggcccauuaucugcgccggaccuauucacagcaacaaauccgcuaauaucccgcaucugcuuggcuacucugagaagaucugucaaauugauagacugauccacguuagcuccuggcuccggaaccauucucaguuucagggguaugugggacagcgcggcgggagaagccaaguguccuacuaucccgccgaaaauagcuacucucggugguccggacugcuuagcccuugcgacgcggauuggcugggcaugcucgucgugaaaaaggcuaaaggcucugacaugauuguucccgggccuuccuauaagggaaagguguucuuugagcgccccacauucgauggcuacgucggguggggauguggcagcgggaaaucuagaacggaauccggagagcugugcagcuccgacucuggcaccagcuccggccugcucccuagcgaucgggugcuguggaucggggacguugccugucagccgaugacacccauuccugaagagaccuuucuugagcugaagucuuucucccagagcgaauuucccgauaucugcaaaauugacggaaucguguucaaccagugugagucugaaagccucccucaacccuuugaugucgccuggauggacgugggccacucccauaagaucauuaugcgcgagcacaaaacaaagugggugcaggagucuagcuccaaggauuucgucugcuauaaagaagggaccggaccguguagcgagucugaagagaagacaugcaaaaccuccggcagcugcagaggggacaugcaguuuuguaagguugcuggaugcgaacacggcgaggaggccucugaagcuaaaugucggugcucccuggugcauaagccuggcgagguggucgugagcuacgggggaaugcgcguuagacccaaauguuacggcuucucccggaugauggccacgcuugaagugaauccucccgagcagcgcaucgggcaaugcaccggaugucaccuggaaugcauuaacggcggggucagacucgugacacugaccucugagcuuaagagcgcgacaguuugugccucccauuuuugcucuagcgcuaccuccggcaagaaaagcacggagauccaguuccacucuggaucccucgugggcaaggccgcuauucacgucaaaggggcccugguggacggaacagaguucaccuuugaaggcagcuguauguuccccgaugggugcgacgcggucgauugcacauuuugucgggaguuccuuaagaauccucagugcuauccggccaaaaaguggcuguuuaucaucauugugauccuccugggauacgcuggccuuaugcugcucaccaacguucugaaggccauugggguguggggcucuugggucaucgcucccgugaaacugguuuucgccauuaucaagaaacucaugcgcgccguguccugucugaugggaaagcugauggacagaggccggcaagucauccaugaagaaauuggggagaauagagagggaaaccaggaugacgugcgcaucgaaauggcucggccuagacgcgugcggcacuggauguauagccccguuauucugaccauccucgcgauuggccuggccgaggggugcgaugaaaugguccaugcugacucuaaacuugugagcuguagacagggauccggcaauaugaaggagugcgugacaacggggcgcgcccugcucccugccgucaaccccggccaggaggcuugucugcacuuuaccgccccgggaagcccugauucuaagugccugaaaaucaaggugaaacggauuaaucucaaguguaaaaaguccagcuccuacuucguucccgacgcgagaucucgcugcacaagcgugcggagaugucgcugggcuggcgauugccaauccgggugcccuucucauuuuaccagcaacuccuucucugacgacugggccggaaagauggaucgggccggccugggguuuagcggauguuccgacggcugcgggggcgcugccuguggaugcuucaaugcugcccccagcuguaucuuuuggagaaaaugggucgaaaacccucacggcaucauuuggaaggugucucccugcgcggccuggguuccguccgcugugaucgagcuuacaaugccuagcggggaaguccggaccuuccaccccaugucuggcauucccacacagguguucaaaggaguuuccgugacguaucuggggagcgauauggaggucucuggacucaccgaccugugugaaaucgaggagcugaaguccaaaaagcucgcccuugcuccuugcaaccaggccggcaugggcgugguggggaaagucggagaaauucaguguagcuccgaggaaagcgcgcgcaccaucaagaaggauggcugcaucuggaaugccgaccugguugggauugagcugagaguggaugacgcuguguguuacucuaaaaucacaagcgucgaagccguggcuaacuauuccgccauuccgaccacaaucggaggccuccgguuugagagaucucaugauagccaagggaagauuuccggaucuccccuggacaucacggccauccgcggcagcuucuccguuaauuaccggggccuuagacugucucucagcgagauuaccgcuacaugcaccggggaagugacaaacgucuccggaugcuacagcuguaugaccggcgcgaaagugucuaucaagcugcacuccagcaaaaauucuacggcccauguucgcugcaagggggaugagaccgcuuuuuccgugcuggaaggaguccacagcuauacagugucccuuucuuucgaccacgccguuguggaugagcagugucagcucaacugcggcgggcaugaaagccaggucacccugaagggaaaucugauuuuucucgacgugccuaaauucguggacggcuccuacaugcaaacauaucacagcucuguccccaccggcgccaacaucccuucccccacggauuggcugaaugcucuuuuugggaacggacugagcagauggauucucggcguuaucggggugcugcugggaggccuugcccucuucuuucugaucaugucucuguucaagcucgggacaaaacagguguuucggagccgcaccaagcuggcguga

SEQ ID NO: 14819 - RNA, 3222 nt, Artificial Sequence
  derived and/or modified CDS sequence (opt5) from SFTSV(ZJZHSH-YJX/China/06/2012)__KR017860.1__GP
augaugaaggugaucugguucagcucccugauuugccucgucauccaguguucuggcgacaccgggcccauuaucugcgccggaccuauucacagcaacaaauccgcuaauaucccgcaucugcuuggcuacucugagaagaucugucaaauugauagacugauccacguuagcuccuggcuccggaaccauucucaguuucagggguaugugggacagcgcggcgggagaagccaaguguccuacuaucccgccgaaaauagcuacucucggugguccggacugcuuagcccuugcgacgcggauuggcugggcaugcucgucgugaaaaaggcuaaaggcucugacaugauuguucccgggccuuccuauaagggaaagguguucuuugagcgccccacauucgauggcuacgucggguggggauguggcagcgggaaaucuagaacggaauccggagagcugugcagcuccgacucuggcaccagcuccggccugcucccuagcgaucgggugcuguggaucggggacguugccugucagccgaugacacccauuccugaagagaccuuucuugagcugaagucuuucucccagagcgaauuucccgauaucugcaaaauugacggaaucguguucaaccagugugagucugaaagccucccucaacccuuugaugucgccuggauggacgugggccacucccauaagaucauuaugcgcgagcacaaaacaaagugggugcaggagucuagcuccaaggauuucgucugcuauaaagaagggaccggaccguguagcgagucugaagagaagacaugcaaaaccuccggcagcugcagaggggacaugcaguuuuguaagguugcuggaugcgaacacggcgaggaggccucugacgcuaaaugucggugcucccuggugcauaagccuggcgaaguggucgugagcuacgggggaaugcgcguuagacccaaauguuacggcuucucccggaugauggccacgcuugaggugaauccucccgaacagcgcaucgggcaaugcaccggaugucaccuggagugcauuaacggcggggucagacucaucacacugaccucugaacugcggagcgcgacagugugugccucccauuuuugcucuagcgcuaccuccggcaaaaagagcacggagauucaguuccacucuggaucccucguuggcaagacaaccauccacgugaagggggcccuggucgauggaacagaguucaccuuugaaggcagcuguauguuccccgacgggugcgaugcuguggacugcaccuuuugucgcgaguuccuuaaaaauccucagugcuauccggccaagaaauggcuguuuaucauuaucgucauucuccugggauacgcgggccuuaugcugcucacaaacgugcugaaggccaucgggguuuggggcucuugggugauugcucccgucaagcugauguucgccaucaucaaaaagcucaugagauccgugagcugucugaugggaaaacuuauggaucggggcagacaaguuauucaugaagagaucggggaaaaucgcgagggaaaccaggacgaugugcggauugagauggcuagaccucgccgggucagacacuggauguauucucccgugauccugacgauucucgccaucggccuggccgaagggugcgacgagauggugcaugcugauagcaaacuuguuuccuguaagcaggcgagcggaaauaugaaggaaugcgucaccacaggccgcgcccugcucccugcugugaaccccgggcaggaggccugucugcacuuuaccgccccgggcucuccugacuccaagugccugaaaauuaaggugaaacggaucaaucucaaguguaaaaagagcuccucuuacuucguccuggaugcuagaagccgcugcacauccgugcggagaugucgcugggccggagacugccaaucuggcugccccagccauuuuaccuccaacucuuucagcgacgauugggcggggaagauggaccgggcuggacuuggcuuuuccggguguagcgauggaugcggcggggccgccuguggcugcuucaaugcugccccuucuuguaucuuuuggagaaaauggguugagaacccccacggaauuaucuggaagguguccccuugcgcugccuggguccccagcgcggugauugaacugacgaugccgucuggcgagguucggacauuccacccuauguccgggauccccacccagguguucaaaggagucagcgugaccuaucucggcucugacauggaaguuuccgggcugacagaucugugugagauugaggaacuuaagagcaaaaagcucgcccuggcucccugcaaccaggccggaaugggcguggucggcaaagugggggagauccaguguuccagcgaagagucugcucgcaccaucaagaaggacggaugcauuuggaaugccgaucuggugggcaucgaacucagagucgacgaugcgguuuguuacagcaaaauuacauccguggaggccguggcuaacuauucugccaucccuacgaccauugggggacugcgguuugaaagaagccaugacucccaaggcaagaucucugggagcccgcuugauaucacagcuauucgcggauccuucucugucaauuaccggggccugagacucagccuguccgaggugaccgccacaugcaccggcgagguuacgaacgugagcgggugcuacucuuguaugaccggagccaaagucuccaucaagcugcacagcucuaaaaauuccacagcucaugugcgcugcaagggcgacgaaaccgcguuuagcguucuugagggggugcacuccuauacagucucucucagcuucgaucacgccgugguugacgaacagugucagcugaacugcggaggccaugagucccaggugacccugaaggggaaucucauuuuucuggacguccccaaauucguggauggaagcuacaugcaaacguaucacucuuccgugcuuacaggcgcuaacaucccuagccccaccgacuggcugaaugcccucuuuggcaacgggcugucuaaguggauucugggagucaucggcguucuucucgggggacuggcccuguucuuucucaucaugagccuguucaaacuuggcacaaagcagauuuuuagaucccggaccaaacuggcuuga

SEQ ID NO: 14820 - RNA, 3222 nt, Artificial Sequence
  derived and/or modified CDS sequence (opt5) from SFTSV(SPL003A)__AB817988.1__GP
augaugaaggugaucugguucagcucccugauuugccucgucauccaguguucuggcgacaccgggcccauuaucugcgccggaccuauucacagcaacaaauccgcuaauaucccgcaucugcuuggcuacucugagaagaucugucaaauugauagacugauccacguuagcuccuggcuccggaaccauucucaguuucagggguaugugggacagcgcggcgggagaagccaaguguccuacuuccccgccgaaaauagcuauucucggugguccggacugcuuagcccuugcgacgcggauuggcugggcaugcucgucgugaaaaaggcuaaaggcucugacaugauuguucccgggccuuccuacaagggaaagguguuuuucgagcgccccacauuugauggcuaugucggguggggauguggcagcgggaaaucuagaacggaauccggagagcugugcagcuccgacucuggcaccagcuccggccugcucccuagcgaucgggugcuguggaucggggacguugccugucagccgaugacacccauuccugaagagaccuuccuugagcugaagucuuuuucccagagcgaguuccccgauaucugcaaaauugacggaaucguguuuaaccagugugaaucugaaagccucccucaacccuucgaugucgccuggauggacgugggccacucccauaagaucauuaugcgcgagcacaaaacaaagugggugcaggagucuagcuccaaggauuuugucugcuacaaagaagggaccggaccguguagcgagucugaagagaagacaugcaaaaccuccggcagcugcagaggggacaugcaguucuguaagguugcuggaugcgaacacggcgaggaggccucugaagcuaaaugucggugcucccuggugcauaagccuggcgagguggucgugagcuaugggggaaugcgcguuagacccaaauguuacggcuuuucccggaugauggccacgcuugaagucaauucuccugagcagcgcaucgggcaaugcaccggaugucaccuggaaugcauuaacggcggggugagacucaucacacugaccagcgagcugaaguccgcgacagugugugccucucauuucugcagcuccgcuaccagcggcaagaaaucuacggagauucaguuccacuccggaagccucguuggcaagacagccauccacgugaaaggggcucuggucgacggaaccgaauuuacauucgagggcucuuguauguuucccgaugggugcgacgccguggauugcaccuucugucgggaauuucuuaagaauccccagugcuacccugcgaaaaaguggcuguucaucauuaucgucauucuccugggauaugccggccuuaugcugcucaccaacgugcugaaggcuaucgggguuuggggcuccugggugauugccccggucaaacugauguuugcuaucaucaagaaacucaugcgcagcgugucuugucugaugggaaagcugauggacagaggccggcaaguuauucaugaggaaaucggggagaauagagagggaaaccaggaugacgugcgcauugaaauggcccggcccagacgcguccggcacuggauguacagcccugugauccuuacaauucucgccaucggccuggcugaggggugcgaugaaauggugcaugcggacuccaaacuuguuagcuguaagcagggaucuggcaauaugaaggagugcgucacgaccgggagagcccugcuccccgcugugaacccuggccaggaggccugucugcacuucacagcccccggauccccggauagcaaaugccugaagauuaaagugaagcgcaucaaucucaaauguaagaaguccucuagcuauuuugucccugacgcucgguccagaugcaccucugugcgccgguguagaugggccggcgauugccaaagcgggugccccucccauuucacaucuaacagcuuuuccgacgacugggcgggaaaaauggaucgcgcuggccugggguucagcggauguucugacggcugcgggggcgccgccuguggaugcuuuaaugcugccccuuccuguaucuucuggcggaaguggguugaaaacccccacggcauuaucuggaaagugagcccuugcgcugccuggguccccucugcggugauugagcuuaccaugccguccggggaaguuagaacguuccacccuaugagcggaauccccacacagguguuuaagggcgucucugugaccuaccugggguccgauauggagguuagcggacucaccgaccugugugaaauugaggagcugaaauccaagaaacuugcccucgcucccugcaaccaggccggcaugggcguggucgggaaggugggagaaauccaguguagcucugaggaaagcgcucggacaaucaagaaagauggcugcauuuggaaugccgaccugguggggaucgagcugcgcgucgaugacgcgguuuguuauuccaagauuaccucuguggaagccguggcuaacuacagcgccaucccuacaacgauuggaggccucagauucgagcggucccaugauucucaagggaaaaucagcggauccccgcuggacaucaccgcuauuagaggcucuuuuagcgucaauuaucgcggccuucggcugucccucagcgagaucacagcuaccugcacaggggaagugaccaacguuucuggaugcuacuccuguaugacgggcgccagagugagcauuaagcugcacucuuccaaaaauagcaccgcccauguccgcugcaagggggaugagacagcguucuccgugcuggaaggaguucacucuuacaccgugagccuuuccuuugaccacgccgucguggaugagcagugucagcucaacugcggcgggcaugaaagccagguuacacugaagggaaaucugaucuuccucgacgugcccaaauuugucgacggcucuuauaugcaaaccuaccacuccagcgugccuacgggcgcuaacauucccucuccuacagauuggcugaaugcccuuuucgggaacggacugagcagauggauccucggcgugaucgggguccugcugggaggccuugcccucuuuuuccugauuaugucccuguuuaagcucgggaccaaacagguuuuccggucucgcacaaagcuggcuuga

SEQ ID NO: 14821 - RNA, 3222 nt, Artificial Sequence
  derived and/or modified CDS sequence (opt5) from SFTSV(SPL004A)__AB817989.1__GP
augaugaaggugaucugguucagcucccugauuugccucgucauccaguguucuggcgacaccgggcccauuaucugcgccggaccuauucacagcaacaaauccgcuaauaucccgcaucugcuuggcuacucugagaagaucugucaaauugauagacugauccacguuagcuccuggcuccggaaccauucucaguuucagggguaugugggacagcgcggcgggagaagccaaguguccuacuaucccgccgaaaauagcuacucucggugguccggacugcuuagcccuugcgacgcggauuggcugggcaugcucgucgugaaaaaggcuaaaggcucugacaugauuguucccgggccuuccuauaagggaaagguguucuuugagcgccccacauucgauggcuacgucggguggggauguggcagcgggaaaucuagaacggaauccggagagcugugcagcuccgacucuggcaccagcuccggccugcucccuagcgaucgggugcuguggaucggggacguugccugucagccgaugacacccauuccugaagagaccuuucuugagcugaagucuuucucccagagcgaauuucccgauaucugcaaaauugacggaaucguguucaaccagugugagucugaaagccucccucaacccuuugaugucgccuggauggacgugggccacucccauaagaucauuaugcgcgagcacaaaacaaagugggugcaggagucuagcuccaaggauuucgucugcuauaaagaagggaccggaccguguagcgagucugaagagaagacaugcaaaaccuccggcagcugcagaggggacaugcaguuuuguaagguugcuggaugcgaacacggcgaggaggccucugaagcuaaaugucggugcucccuggugcauaagccuggcgagguggucgugagcuacgggggaaugcgcguuagacccaaauguuacggcuucucccggaugauggccacgcuugaagugaauccucccgagcagcgcaucgggcaaugcaccggaugucaccuggaaugcauuucuggcggggucagacucaucacacugaccagcgagcugaaguccgcgacagugugugccucucauuuuugcagcuccgcuaccagcggcaagaaaucuacggagauucaguuccacuccggaagccucguuggcaaggccgcuauccacgugaaaggggcccuggucgacggaacagaguucaccuuugaaggcucuuguauguuccccgaugggugcgacgcgguggauugcacauuuugucgggaguuccuuaagaacccucagugcuauccggccaaaaaguggcuguuuaucauuaucgucauucuccugggauacgcuggccuuaugcugcucaccaaugugcugaaggccaucgggguuuggggcuccugggugauugcucccgucaaacugauguucgccaucaugaagaaacucaugcgcagcgugucuugucugaugggaaagcugauggacagaggccggcaaguuauccaugaagaaauuggggagaacagagagggaaaucaggaugacgugcgcaucgaaauggcccggccuagacgcguccggcacuggauguauagccccgugauucugaccauccucgcuauuggccuggcggaggggugcgaugaaauggugcaugccgacuccaaacuuguuagcuguagacagggaucuggcaacaugaaggagugcgucacaacggggcgcgcucugcucccugccgugaaucccggccaggaggccugucugcacuuuaccgcuccgggauccccugauagcaagugccugaaaaucaaggugaaacggauuaaccucaaguguaaaaaguccucuagcuacuucguccccgacgccagaucccgcugcacaucugugcggagaugucgcugggcgggcgauugccaaagcgggugcccuucccauuuuaccucuaauagcuucuccgacgacugggcuggaaagauggaucgggccggccugggguuuagcggauguucugacggcugcgggggcgccgcuuguggaugcuucaacgccgcucccuccuguaucuuuuggagaaaauggguugaaaauccucacggcaucauuuggaaggugagccccugcgccgcgugggucccgucugccgugaucgagcuuacaaugccuuccggggaaguucggaccuuccaccccaugagcggcauucccacacagguguucaaaggagucucugugacguaucugggguccgauauggagguuagcggacucaccgaccugugugaaaucgaggagcugaaguccaaaaagcucgcucuugccccuugcaaccaggcuggcaugggcguggucgggaaagugggagaaauucaguguagcucugaggaaagcgcccgcaccaucaagaaggauggcugcaucuggaacgcggaccugguggggauugagcugagagucgaugacgccguuuguuacuccaaaaucacaucuguggaagcuguggccaauuauagcgcuauuccgaccacaaucggaggccuccgguuugagagaucccaugauucucaagggaagauuagcggaucuccccuggacaucacggccauccgcggcuccuucagcgucaacuaccggggccuuagacugucccucagcgagauuaccgccacaugcaccggggaagugacaaauguuucuggaugcuacuccuguaugaccggcgcuaaagugagcaucaagcugcacucuuccaaaaacagcacggcgcauguccgcugcaaggaggaugaaaccgccuuuuccgugcuggaggggguucacucuuauacagugagccuuuccuucgaccacgcugucguggaugaacagugucagcucaauugcggaggccaugagagccacguuacccugaaggggaaccugauuuuucucgacgugccuaaauucgucgacggaucuuacaugcagacauaucauuccagcgugcccaccggcgccaauaucccuucucccacggauuggcugaacgcccuuuuuggcaaugggcugagcagauggauucucggagugaugggcguccugcuugggggacuugcucucuucuuucugaucaugucccuguucaagcucggcacaaaacaaguuuuucggucucgcaccaagcuggccuga

SEQ ID NO: 14822 - RNA, 3222 nt, Artificial Sequence
  derived and/or modified CDS sequence (opt5) from SFTSV(SPL005A)__AB817990.1__GP
augaugaaggugaucugguucagcucccugauuugccucgucauccaguguucuggcgacgccagccccauuaucugcgcugggccuauucacuccaacaaaucugccaauaucccgcaucugcuuggauacagcgagaagaucugucaaauugauagacugauccacguuuccucuuggcuccggaaccauagccaguuucagggcuauguggggcagcgcggaggcagaucccaagugagcuacuuccccgcggaaaauucuuauucccgguggagcgggcugcuuucuccuugcgacgcugauuggcugggaaugcucgucgugaaaaaggccaaaggcuccgacaugauuguucccggcccuagcuacaaggggaagguguuuuucgagcgccccaccuuugauggauaugucggcuggggguguggaucuggcaaauccagaacagaaagcggggagcugugcuccucugacagcggaacguccagcggccugcucccuucugaucgggugcuguggaucggcgacguugccugucagccgaugacccccauuccugaagagacauuccuugagcugaaguccuuuagccagucugaguuccccgauaucugcaaaauugacgggaucguguuuaaccagugugaaagcgaaucccucccucaaccccuggaugucgcuuggauggacgugggacacucucauaagaucauuaugcgcgagcacaaaaccaagugggugcaggagagcuccagcaaggauuucgucugcuacaaagaaggcacagggccguguucugaguccgaagagaagaccugcaaaacaagcggaucuugcagaggcgacaugcaguuuuguaagguugccgggugcgaacacggagaggaggcuuccgaagccaaaugucggugcagccuugugcauaagccuggcgagguggucguguccuauggcgggaugcgcguuagacccaaauguuacggauucucucggaugauggcgacccuggaagugaauccucucgagcagcgcaucggccaaugcacggggugucaccuggaaugcauuaacggaggcgucagacugaucacccucacaagcgagcugaaguccgccaccgugugugcuucucauuuuugcagcuccgccacaagcgggaagaaaucuaccgagauucaguuccacuccggcagccuuguuggaaagacggcuauccacgugaaaggcgcccuggucgacgggacagaguucaccuuugaaggaucuuguauguuccccgauggcugcgacgcgguggauugcacauuuugucgggaguuccucaagaauccccagugcuacccugccaaaaaguggcuguuuaucauuaucgucauucuucugggguaugcuggacucaugcugcugaccaacgugcucaaggccaucggcguuuggggguccugggugauugcuccggucaaacugauguucgccaucaucaagaaacuuaugcgcagcgugucuugucugaugggcaagcucauggacagaggacggcaaguuauucaugaagaaaucggcgagaauagagaggggaaccaggaugacgugcgcauugaaauggcccggcccagacgcguccggcacuggauguacagcccugugauccugaccauucuugcuaucggacuggcggagggcugcgaugaaauggugcaugccgacuccaaacucguuagcuguaagcaagggggaggcaauaugaaggagugcgucacaacggggagagcucugcugcccgccgugaacccuggccaggaggccugucuccacuuuaccgcucccggaucuccggauuccaaaugccugaagauuaaagugaagcgcaucaaucuuaaauguaagaaguccuccucuuauuucgucccugacgcccggagcagaugcacauccgugcgccgguguagaugggcgggcgauugccagucugggugccccagccauuuuaccuccaacucuuucagcgacgacugggcuggaaaaauggaucgcgccggccugggguuuuccggauguagcgacggcugcgggggcgccgcuuguggaugcuucaaugccgcuccuucuuguaucuuuuggcggaaguggguugaaaacccccacggcauuaucuggaaaguguccccuugcgccgcguggguccccagcgccgugauugagcucacaaugccgucuggggaaguuagaaccuuccacccuauguccggaauccccacacagguguucaagggcgucagcgugacguaccuggggucugauauggagguuuccggacugaccgaccuuugugaaauugaggagcucaaaagcaagaaacuggcucuggcccccugcaaccaggcuggcaugggcguggucgggaaggugggagaaauccaguguuccagcgaggaaucugcccggaccaucaagaaagauggcugcauuuggaaugcggaccucguggggaucgagcugcgcgucgaugacgccguuuguuauagcaagauuacauccguggaagcuguggccaacuacucugcuaucccuaccacaauuggaggccuuagauuugagcggagccaugauucccaagggaaaaucucuggaagcccgcuggacaucacggccauuagaggcuccuucucugucaauuaucgcggccuccggcugagccuguccgagaucaccgccacaugcaccggggaagugacaaacguuagcggaugcuacucuuguaugaccggcgcuaagguguccauuaaacuucacagcucuaagaauagcacggcgcaugucagaugcaagggggaugagaccgccuuuagcgugcucgaaggaguucacuccuacacagugucucugagcuucgaccacgcugucguggaugagcagugucagcugaacugcggcgggcaugaaucccagguuacccucaaaggaaaucugaucuuucuugacgugcccaaguucgucgacggcagcuauaugcaaacauaccacucuuccgugccuaccggcgccaacauucccagcccuacggauuggcugaaugcccucuuugggaacggacugucucgcuggauccugggcgugaucgggguccuucucggaggccuggcucuguucuuucucauuaugagccuguucaaacuugggacaaagcagguuuuuagaucccggaccaaacuggccuga

SEQ ID NO: 14823 - RNA, 3222 nt, Artificial Sequence
  derived and/or modified CDS sequence (opt5) from SFTSV(SPL010A)__AB817991.1__GP
augaugaaggugaucugguucagcucccugauuugccucgucauccaguguucuggcgacaccgggcccauuaucugcgccggaccuauucacagcaacaaauccgcuaauaucccgcaucugcuuggcuacucugagaagaucugucaaauugauagacugauccacguuagcuccuggcuccggaaccauucucaguuucagggguaugugggacagcgcggcgggagaagccaaguguccuacuuccccgccgaaaauagcuauucucggugguccggacugcuuagcccuugcgacgcggauuggcugggcaugcucgucgugaaaaaggcuaaaggcucugacaugauuguucccgggccuuccuacaagggaaagguguuuuucgagcgccccacauuugauggcuaugucggguggggauguggcagcgggaaaucuagaacggaauccggagagcugugcagcuccgacucuggcaccagcuccggccugcucccuagcgaucgggugcuguggaucggggacguugccugucagccgaugacacccauuccugaagagaccuuccuugagcugaagucuuuuucccagagcgaguuccccgauaucugcaaaauugacggaaucguguuuaaccagugugaaucugaaagccucccucaacccuucgaugucgccuggauggacgugggccacucccauaagaucauuaugcgcgagcacaaaacaaagugggugcaggagucuagcuccaaggauuuugucugcuacaaagaagggaccggaccguguagcgagucugaagagaagacaugcaaaaccuccggcagcugcagaggggacaugcaguucuguaagguugcuggaugcgaacacggcgaggaggccucugaagcuaaaugucggugcucccuggugcauaagccuggcgagguggucgugagcuaugggggaaugcgcguuagacccaaauguuacggcuuuucccggaugauggccacgcuugaagucaauucuccugagcagcgcaucgggcaaugcaccggaugucaccuggaaugcauuaacggcggggugagacucaucacacugaccagcgagcugaaguccgcgacagugugugccucucauuucugcagcuccgcuaccagcggcaagaaaucuacggagauucaguuccacuccggaagccucguuggcaagacagccauccacgugaaaggggcucuggucgacggaaccgaauuuacauucgagggcucuuguauguuucccgaugggugcgacgccguggauugcaccuucugucgggaauuucuuaagaauccccagugcuacccugcgaaaaaguggcuguucaucauuaucgucauucuccugggauaugccggccuuaugcugcucaccaacgugcugaaggcuaucgggguuuggggcuccugggugauugccccggucaaacugauguuugcuaucaucaagaaacucaugcgcagcgugucuugucugaugggaaagcugauggacagaggccggcaaguuauucaugaggaaaucggggagaauagagagggaaaccaggaugacgugcgcauugaaauggcccggcccagacgcguccggcacuggauguacagcccugugauccuuacaauucucgccaucggccuggcugaggggugcgaugaaauggugcaugcggacuccaaacuuguuagcuguaagcagggaucuggcaauaugaaggagugcgucacgaccgggagagcccugcuccccgcugugaacccuggccaggaggccugucugcacuucacagcccccggauccccggauagcaaaugccugaagauuaaagugaagcgcaucaaucucaaauguaagaaguccucuagcuauuuugucccugacgcucgguccagaugcaccucugugcgccgguguagaugggccggcgauugccaaagcgggugccccucccauuucacaucuaacagcuuuuccgacgacugggcgggaaaaauggaucgcgcuggccugggguucagcggauguucugacggcugcgggggcgccgccuguggaugcuuuaaugcugccccuuccuguaucuucuggcggaaguggguugaaaacccccacggcauuaucuggaaagugagcccuugcgcugccuggguccccucugcggugauugagcuuaccaugccguccggggaaguuagaacguuccacccuaugagcggaauccccacacagguguuuaagggcgucucugugaccuaccugggguccgauauggagguuagcggacucaccgaccugugugaaauugaggagcugaaauccaagaaacuugcccucgcucccugcaaccaggccggcaugggcguggucgggaaggugggagaaauccaguguagcucugaggaaagcgcucggacaaucaagaaagauggcugcauuuggaaugccgaccugguggggaucgagcugcgcgucgaugacgcgguuuguuauuccaagauuaccucuguggaagccguggcuaacuacagcgccaucccuacaacgauuggaggccucagauucgagcggucccaugauucucaagggaaaaucagcggauccccgcuggacaucaccacaauuagaggcucuuuuagcgucaauuaucgcggccuucggcugucccucagcgagaucaccgcuacaugcaccggggaagugacgaacguuucuggaugcuacuccuguaugaccggcgccagagugagcauuaagcugcacucuuccaaaaauagcacagcccauguccgcugcaagggggaugagaccgcuuucuccgugcuggaaggaguucacucuuacacagugagccuuuccuuugaccacgcggucguggaugagcagugucagcucaacugcggcgggcaugaaagccagguuacccugaagggaaaucugaucuuccucgacgugcccaaauuugucgacggcucuuauaugcaaacguaccacuccagcgugccuacaggcgccaacauucccucuccuaccgauuggcugaaugcucuuuucgggaacggacugagcagauggauccucggcgugaucgggguccugcugggaggccuugcccucuuuuuccugauuaugucccuguuuaagcucgggacaaaacagguuuuccggucucgcaccaagcuggccuga

SEQ ID NO: 14824 - RNA, 3222 nt, Artificial Sequence
  derived and/or modified CDS sequence (opt5) from SFTSV(SPL030A)__AB817992.1__GP
augaugaaggugaucugguucagcucccugauuugccucgucauccaguguucuggcgacaccagccccauuaucugcgccgggccuauucacuccaacaaaucugcuagcaucccgcaucugcuuggauacuccgagaagaucugucaaauugauagacugauccacguuucuagcuggcuccggaaucauucccaguuucagggcuauguggggcagcgcggaggcagaagccaagugucuuacuuccccgccgaaaacuccuauagccgguggucugggcugcuuuccccuugcgacgcggauuggcugggaaugcucgucgugaaaaaggcuaaaggcagcgacaugauuguucccggcccuucuuacaaggggaagguguuuuucgagcgccccacauuugauggauaugucggcuggggguguggauccggcaaaagcagaacggaauccggggagcugugcucuagcgacuccggaaccagcucuggccugcucccuuccgaucgggugcuguggaucggcgacguugccugucagccgaugacacccauuccugaagagaccuuccuugagcuuaagagcuuuucucagagcgaguuccccgauaucugcaaaauugacgggaucguguuuaaucagugugaauccgaaucucucccucaaccccuggaugucgccuggauggacgugggacacagccauaagaucauuaugcgcgagcacaaaacaaagugggugcaggaguccagcucuaaggauuucgucugcuacaaagaaggcaccgggccguguuccgagagcgaagagaagacaugcaaaaccucuggauccugcagaggcgacaugcaguuuuguaagguugcugggugcgaacacggagaggaggccagcgaagcuaaaugucggugcucccuugugcauaagccuggcgagguggucgugucuuauggcgggaugcgcguuagacccaaauguuacggauucagccggaugauggccacgcuggaagugaacccucccgagcuccgcaucggccagugcaccgggugucaccuggaaugcauuaauggaggcgucagacugaucacacucaccuccgagcugaagucugcgacagugugugccagccauuuuugcuccagcgcuaccucugggaagaaauccacggagauucaauuccacagcggcucucuuguuggaaagacagccauccacgugaaaggcgcucuggucgacgggaccgaguucacauuugaaggauccuguauguuccccgauggcugcgacgccguggauugcaccuuuugucgggaguuccucaagaacccucagugcuacccggcgaaaaaguggcuguuuaucauuaucgucauucuucugggguaugccggacucaugcugcugaccaaugugcucaaggcuaucggcguuugggggagcugggugauugcccccgucaaacugauguucgcuaucaucaagaaacuuaugcgcucugugagcugucugaugggcaagcucauggacagaggacggcagguuauucaugaagaaaucggcgagaacagagaggggaaucaagaugacgugcgcauugaaauggcccggccuagacgcguccggcacuggauguacucccccgugauccugacaauucuugccaucggacuggcugagggcugcgaugaaauggugcaugcggacagcaaacucguuucuuguaagcaagggggaggcaacaugaaggagugcgucacgaccgggagagcccugcugccugcugugaaucccggccaggaggccugucuccacuuuacagccccgggauccccugauagcaaaugccugaagauucgcgugaaacggaucaaccuuaaguguaaaaaguccucuagcuauuucguccccgacgcuagaucccgcugcaccucugugcggagaugucgcugggccggcgauugccagagcgggugcccuucccauuuuacaucuaauagcuucuccgacgacugggcgggaaagauggaucgggcuggccugggguuuagcggauguucugacggcugcgggggcgccgccuguggaugcuucaacgcugcccccuccuguaucuuuuggagaaaauggguugaaaauccucacggcauuaucuggaaggugagccccugcgcugccugggucccgucugcggugauugagcucaccaugccuuccggggaaguucggacguuccaccccaugagcggaauccccacacagguguucaaaggcgucucugugaccuaccugggguccgauauggagguuagcggacugaccgaccuuugugaaauugaggagcucaaguccaaaaagcuggcccuggcuccuugcaaccaggccggcaugggcguggucgggaaagugggagaaauccaguguaacagcgaggaaucugcucgcacaaucaagaaggauggcugcauuuggaaugccgaccucguggggaucgagcugagagucgaugacgcgguuuguuauagcaaaauuaccuccguggaagccguggcuaacuacucugccaucccgacaacgauuggaggccuucgguuugagagaagccaugauucccaggggaagaucucuggaagcccccuggacaucaccgcuauucgcggcuccuucucugucaauuaucggggccucagacugagccuguccgagaucacagcuaccugcacaggggaagugaccaacguuagcggaugcuacucuuguaugacgggcgccaaaguguccauuaagcugcacagcucuaaaaauuccaccgcccauguccgcugcaagggggaugagacagcguuuagcgugcucgaaggaguucacuccuacaccgugucucugagcuucgaccacgccgucguggaugagcaaugucagcugaacugcggcgggcaugaaucccagguuacacucaagggaaaucugaucuuucuugacgugccuaaauucgucgacggcagcuauaugcagaccuaccacucuuccgugcccacgggcgcuaacauuccuagccccacagauuggcugaaugcccucuuugggaacggacugucuagauggauccugggcgugaucgggguccuucucggaggccuggcccuguucuuucucauuaugagccuguucaaacuugggaccaagcaaguuuuucggucccgcacaaagcuggcuuga

SEQ ID NO: 14825 - RNA, 3222 nt, Artificial Sequence
  derived and/or modified CDS sequence (opt5) from SFTSV(SPL053A)__AB985292.1__GP
augaugaaggugaucugguucagcucccugauuugccucgucauccaguguucuggcgacaccgggcccauuaucugcgccggaccuauucacagcaacaaaggcgcuaauaucccgcaucugcuuggguacuccgagaagaucugucaaauugauagacugauccacguuucuagcuggcuccggaaccauucccaguuucagggauaugugggccagcgcgggggaagaucucaagugagcuacuuccccgccgaaaauuccuauagccgguggucuggccugcuuuccccuugcgacgcggauuggcugggcaugcucgucgugaaaaaggcuaaagggagcgacaugauuguucccggaccuucuuacaagggcaagguguuuuucgagcgccccacauuugauggguaugucggauggggcuguggguccggaaaaagcagaacggaaucuggcgagcugugcaucuccgacagcggcaccuccucugggcugcucccuagcgaucgggugcuguggauuggagacguugccugucagccgaugacacccaucccugaagagaccuuccuugagcugaaguccuuuagccagucugaguuccccgauauuugcaaaaucgacggcaucguguuuaaccagugugaauccgaaagccucccucaacccuucgaugucgccuggauggacguggggcacucucauaagauuaucaugcgcgagcacaaaacaaagugggugcaggagagcuccucuaaggauuuugucugcuacaaagaaggaaccggcccguguagcgaguccgaagagaagacaugcaaaaccagcgggucuugcagaggagacaugcaguucuguaagguugcuggcugcgaacacggcgaggaggccuccgaagcuaaaugucggugcagccuggugcauaagccuggggagguggucgugucuuauggaggcaugcgcguuagacccaaauguuacggguuuucccggaugauggccacgcuugaagugaauagcccugagcagcgcauuggacaaugcaccggcugucaccuggaaugcaucaacgggggcgucagacucauuacacugaccuccgagcugaagucugcgacagugugugccagccauuucugcuccucugcuaccagcggaaagaaauccacggagauccaguuccacagcggcucucucguugggaagacagccauccacgugaaaggagcucuggucgacggcaccgaauuuacauucgagggguccuguauguuucccgauggaugcgacgccguggauugcaccuucugucgggaauuucuuaagaauccccagugcuacccugcgaaaaaguggcuguucauuaucauugucauccuccugggcuaugccgggcuuaugcugcucaccaacgugcugaaggcuauuggcguuuggggaagcugggugaucgccccggucaaacugauguuugcuaucauuaagaaacucaugcgcucuguguccugucugaugggcaagcugauggacagagggcggcaaguuauccaugaggaaauuggagagaauagagagggcaaccaggaugacgugcgcaucgaaauggcccggcccagacgcguccggcacuggauguacagcccugugauucuuacaauccucgccauugggcuggcugagggaugcgaugaaauggugcaugcggacucuaaacuuguuagcuguaagcagggcuccgggaauaugaaggagugcgucacgaccggcagagcccugcuccccgcugugaacccuggacaggaggccugucugcacuucacagcccccggcagcccggauucuaaaugccugaagaucaaagugaagcgcaucaaucucaaauguaagaaguccagcuccuauuuugucccugacgcucggucuagaugcaccagcgugcgccgguguagaugggccggggauugccaauccggaugccccucucauuucacaagcaacuccuuuucugacgacugggcgggcaaaauggaucgcgcugggcugggauucagcggcuguuccgacgggugcggcggagccgccuguggcugcuuuaaugcugccccuagcuguauuuucuggcggaaguggguugaaaacccccacgggaucauuuggaaagugucuccuugcgcugccuggguccccuccgcggugaucgagcuuaccaugccgagcggagaaguuagaacguuccacccuaugucuggcauucccacacagguguuuaagggggucuccgugaccuaccugggaagcgauauggagguuucuggccucaccgaccugugugaaaucgaggagcugaaauccaagaaacuugcccucgcucccugcaaccaggccggcauggggguggucggaaaggugggcgaaauccaguguagcuccgaggaaagcgcucggacaauuaagaaagaugggugcaucuggaaugccgaccuggugggaauugagcugcgcgucgaugacgcgguuuguuauucuaagaucaccagcguggaagccguggcuaacuacuccgccauuccuacaacgaucggcgggcucagauucgagcggucucaugauagccaaggaaaaaucuccggcucuccgcuggacauuaccgcuaucagaggcagcuuuuccgucaauuaucgcgggcuucggcugucucucagcgagauuacagcuaccugcacaggagaagugaccaacguuuccggcugcuacagcuguaugacgggggccagagugucuaucaagcugcacuccagcaaaaauucuaccgcccauguccgcugcaagggagaugagacagcguucuccgugcuggaaggcguucacagcuacaccgugucccuuucuuuugaccacgccgucguggaugagcagugucagcucaacugcgggggacaugaaagccagguuacacugaagggcaaucugauuuuccucgacgugcccaaauuugucgacggcuccuauaugcaaaccuaccacagcucugugccuacgggggcuaacauccccuccccuacagauuggcugaaugcccuuuucggaaacggccugagcagauggauccucggggugauuggaguccugcugggcgggcuugcccucuuuuuccugaucaugucucuguuuaagcucggaaccaaacagguuuuccggagccgcacaaagcuggcuuga

SEQ ID NO: 14826 - RNA, 3222 nt, Artificial Sequence
  derived and/or modified CDS sequence (opt5) from SFTSV(SPL054A)__AB985293.1__GP
augaugaaggugaucugguucagcucccugauuugccucgucauccaguguucuggcgacaccgggcccauuaucugcgccggaccuauucacagcaacaaauccgcuaauaucccgcaucugcuuggcuacucugagaagaucugucaaauugauagacugauccacguuagcuccuggcuccggaaccauucucaguuucagggguaugugggacagcgcggcgggagaagccaaguguccuacuuccccgccgaaaauagcuauucucggugguccggacugcuuagcccuugcgacgcggauuggcugggcaugcucgucgugaaaaaggcuaaaggcucugacaugauuguucccgggccuuccuacaagggaaagguguuuuucgagcgccccacauuugauggcuaugucggguggggauguggcagcgggaaaucuagaacggaauccggagagcugugcagcuccgacucuggcaccagcuccggccugcucccuagcgaucgggugcuguggaucggggacguugccugucagccgaugacacccauuccugaagagaccuucauggagcuuaagucuuuuucccagagcgaauuucccgauaucugcaaaauugacggaaucguguuuaaccagugugagucugaaagccugccucaacccuucgaugucgccuggauggacgugggccacucccauaagaucauuaugcgcgagcacaaaacaaagugggugcaggagucuagcuccaaggauuuugucugcuacaaagaagggaccggaccguguagcgagucugaagagaagacaugcaaaaccuccggcagcugcagaggggacaugcaguucuguaagguugcuggaugcgaacacggcgaggaggccucugaagcuaaaugucggugcucccucgugcauaagccuggcgagguggucgugagcuaugggggaaugcgcguuagacccaaauguuacggcuuuucccggaugauggccacgcuggaagugaauccucccgagcagcgcaucgggcaaugcaccggaugucaccuugaaugcauuaacggcggggucagacugaucacacucaccucugagcugaaguccgcgacagugugugccucccauuucugcucuagcgcuaccuccggcaagaaaagcacggagauucaguuccacucuggaucccugguuggcaagacagccauccacgugaaaggggcucucgucgacggaaccgaauuuacauucgagggcagcuguauguuucccgaugggugcgacgccguggauugcaccuucugucgggaauuucugaagaauccucagugcuacccggcgaaaaaguggcuuuucaucauuaucgucauucugcucggauaugccggccugaugcuucugaccaacgugcucaaggcuaucgggguuuggggcucuugggugauugcccccgucaaacugauguuugcuaucaucaagaaacugaugcgcuccgugagcugucucaugggaaagcugauggacagaggccggcaaguuauucaugaggaaaucggggagaauggagagggcaaccaggaugacgugagaauugaaaucgcccgcccucggagaguccgccacuggauguacucucccgugauucuuacaauccuggccauugggcucgcugagggaugcgaugaaauggugcaugcggacagcaaacugguuuccuguaagcagggcagcgggaauaugaaggagugcgucacgaccggccgggcccuucugccugcugugaaccccggacaggaggccugucuccacuucacagccccgggcucuccugauuccaaaugccugaagaucaaagugaagagaaucaaucugaaauguaaaaagagcuccucuuauuuuguccccgacgcucgcagccggugcaccuccgugagacgcugucggugggccggggauugccaaucuggaugcccuagccauuucacauccaacucuuuuagcgacgacugggcgggcaagauggauagagcugggcucggauucuccggcuguagcgacgggugcggcggagccgccuguggcugcuuuaaugcugcccccucuuguauuuucuggcgcaaguggguugaaaacccucacgggaucauuuggaaagugucccccugcgcugccugggucccgagcgcggugaucgagcugaccaugccuucuggagaaguucggacguuccaccccauguccggcauucccacacagguguuuaagggggucagcgugaccuaccuuggaucugauauggagguuuccggccugaccgaccucugugaaaucgaggagcugaaaagcaagaaacuggcccuugcuccuugcaaccaggccggcauggggguggucggaaaggugggcgaaauccaguguuccagcgaggaaucugcuagaacaauuaagaaagaugggugcaucuggaaugccgaccucgugggaauugagcugcgggucgaugacgcgguuuguuauagcaagaucaccuccguggaagccguggcuaacuacucugccauuccgacaacgaucggcgggcugcgcuucgagagaagccaugauucccaaggaaaaaucucuggcagcccccucgacauuaccgcuauccggggcuccuuuucugucaauuauagagggcugcgccuuagccuguccgagauuacagcuaccugcacaggagaagugaccaacguuagcggcugcuacucuuguaugacgggggccaagguguccaucaaacuccacagcucuaagaauagcaccgcccauguccggugcaagggagaugagacagcguucagcgugcuggaaggcguucacuccuacaccgugucucugagcuuugaccacgccgucguggaugagcagugucagcuuaacugcgggggacaugaaucccagguuacacucaaaggcaaucugauuuuccuggacgugccuagauuugucgacggcagcuauaugcaaaccuaccacucuuccgugcccacgggggcuaacaucccuagccccacagauuggcucaaugcccuguucggaaacggccuuucucgcuggauccugggggugauuggaguccuccugggcgggcuggcccuuuucuuccucaucaugagccuguuuaagcugggaaccaaacagguuuucagaucccggacaaagcucgcuuga

SEQ ID NO: 14827 - RNA, 3222 nt, Artificial Sequence
  derived and/or modified CDS sequence (opt5) from SFTSV(SPL055A)__AB985294.1__GP
augaugaaggugaucugguucagcucccugauuugccucgucauccaguguucuggcgacaccgggcccauuaucugcgccggaccuauucacagcaacaaauccgcuaauaucccgcaucugcuuggcuacucugagaagaucugucaaauugauagacugauccacguuagcuccuggcuccggaaccauucucaguuucagggguaugugggacagcgcggcgggagaagccaaguguccuacuuccccgccgaaaauagcuauucucggugguccggacugcuuagcccuugcgacgcggauuggcugggcaugcucgucgugaaaaaggcuaaaggcucugacaugauuguucccgggccuuccuacaagggaaagguguuuuucgagcgccccacauuugauggcuaugucggguggggauguggcagcgggaaaucuagaacggaauccggagagcugugcagcuccgacucuggcaccagcuccggccugcucccuagcgaucgggugcuguggaucggggacguugccugucagccgaugacacccauuccugaagagaccuuccuugagcugaagucuuuuucccagagcgaguuccccgauaucugcaaaauugacggaaucguguuuaaccagugugaaucugaaagccucccucaacccuucgaugucgccuggauggacgugggccacucccauaagaucauuaugcgcgagcacaaaacaaagugggugcaggagucuagcuccaaggauuuugucugcuacaaagaagggaccggaccguguagcgagucugaagagaagacaugcaaaaccuccggcagcugcagaggggacaugcaguucuguaagguugcuggaugcgaacacggcgaggaggccucugaagcuaaaugucggugcucccuggugcauaagccuggcgagguggucgugagcuaugggggaaugcgcguuagacccaaauguuacggcuuuucccggaugauggccacgcuugaagucaauucuccugagcagcgcaucgggcaaugcaccggaugucaccuggaaugcauuaacggcggggugagacucaucacacugaccagcgagcugaaguccgcgacagugugugccucucauuucugcagcuccgcuaccagcggcaagaaaucuacggagauucaguuccacuccggaagccucguuggcaagacagccauccacgugaaaggggcucuggucgacggaaccgaauuuacauucgagggcucuuguauguuucccgaugggugcgacgccguggauugcaccuucugucgggaauuucuuaagaauccccagugcuacccugcgaaaaaguggcuguucaucauuaucgucauucuccugggauaugccggccuuaugcugcucaccaacgugcugaaggcuaucgggguuuggggcuccugggugauugccccggucaaacugauguuugcuaucaucaagaaacucaugcgcagcgugucuugucugaugggaaagcugauggacagaggccggcaaguuauucaugaggaaaucggggagaauagagagggaaaccaggaugacgugcgcauugaagucgcccggcccagacgcgugcggcacuggauguacagcccugugauccuuacaauucucgccaucggccuggcugaggggugcgaugaaaugguucaugcggacuccaaacuugucagcuguaagcagggaucuggcaauaugaaggagugcgugacgaccgggagagcccugcuccccgcugugaacccuggccaggaggccugucugcacuucacagcccccggauccccggauagcaaaugccugaagauuaaagucaagcgcaucaaucucaaauguaagaaguccucuagcuauuuugugccugacgcucgguccagaugcaccucuguucgccgguguagaugggccggcgauugccaaagcgggugccccucccauuucacaucuaacagcuuuuccgacgacugggcgggaaaaauggaucgcgcuggccugggguucagcggauguucugacggcugcgggggcgccgccuguggaugcuuuaaugcugccccuuccuguaucuucuggcggaaguggguggaaaacccccacggcauuaucuggaaagucagcccuugcgcugccugggugcccucugcgguuauugagcuuaccaugccguccggggaagugagaacguuccacccuaugagcggaauccccacacaggucuuuaagggcgugucuguuaccuaccugggguccgauauggaggugagcggacucaccgaccugugugaaauugaggagcugaaauccaagaaacuugcccucgcucccugcaaccaggccggcaugggcgucguggggaaggugggagaaauccaguguagcucugaggaaagcgcucggacaaucaagaaagauggcugcauuuggaaugccgaccuggucgggaucgagcugcgcguugaugacgcgguguguuauuccaagauuaccucuguggaagccgucgcuaacuacagcgccaucccuacaacgauuggaggccucagauucgagcggucccaugauucucaagggaaaaucagcggauccccgcuggacaucaccgcuauuagaggcucuuuuagcgugaauuaucgcggccuucggcugucccucagcgagaucacagcuaccugcacaggggaaguuaccaacgugucuggaugcuacuccuguaugacgggcgccagagucagcauuaagcugcacucuuccaaaaauagcaccgcccaugugcgcugcaagggggaugagacagcguucuccguucuggaaggagugcacucuuacaccgucagccuuuccuuugaccacgccgugguugaugagcagugucagcucaacugcggcgggcaugaaagccaggugacacugaagggaaaucugaucuuccucgacguccccaaauuuguggacggcucuuauaugcaaaccuaccacuccagcgugccuacgggcgcuaacauucccucuccuacagauuggcugaaugcccuuuucgggaacggacugagcagauggauccucggcgucaucgggguucugcugggaggccuugcccucuuuuuccugauuaugucccuguuuaagcucgggaccaaacagguguuccggucucgcacaaagcuggcuuga

SEQ ID NO: 14828 - RNA, 3222 nt, Artificial Sequence
  derived and/or modified CDS sequence (opt5) from SFTSV(SPL057A)__AB985295.1__GP
augaugaaggugaucugguucagcucccugauuugccucgucauccaguguucuggcgacaccgggcccauuaucugcgccggaccuauucacagcaacaaauccgcugauaucccgcaucugcuuggcuacucugagaagaucugucaaauugacagacugauccacguuagcuccuggcuccggaaucauucucaguuucagggguaugugggacagcgcggcgggagaagccaaguguccuacuaucccgccgaaaacagcuacucucggugguccggacugcuuagcccuugcgaugcggacuggcugggcaugcucgucgugaaaaaggcuaaaggcucugauaugauuguucccgggccuuccuauaagggaaagguguucuuugagcgccccacauucgacggcuacgucggguggggauguggcagcgggaaaucuagaacggaauccggagagcugugcagcuccgauucuggcaccagcuccggccugcucccuagcgaccgggugcuguggaucggggauguugccugucagccgaugacacccauuccugaagagaccuuucuugagcugaagucuuucucccagagcgaauuucccgacaucugccgcauugauggaaucguguucaaucagugugagucugaaagccucccucaacccuuugacgucgccuggauggaugugggccacucccauaaaaucauuaugagagagcacaagacaaaaugggugcaggagucuagcuccaaggacuucgucugcuauaaggaagggaccggaccguguagcgagucugaagagaaaacaugcaagaccuccggcagcugccgcggggacaugcaguuuuguaaaguugcuggaugcgaacacggcgaggaggccucugaagcuaagugucggugcucccuggugcauaaaccuggcgagguggucgugagcuacgggggaaugagaguucggcccaaguguuacggcuucucccgcaugauggccacgcuugaagugaacccucccgagcagagaaucgggcaaugcaccggaugucaccuggaaugcgucaauggcggggugcggcucauuacacugaccucugagcugaaaagcgcgacaguuugugccucccauuuuugcucuagcgcuaucuccggcaaaaagagcaccgagauucaguuccacucuggaucccucgugggcaagacggccauccacgucaagggggcucugguggauggaacagaauuuaccuuugagggcagcuguauguuccccgacgggugcgaugccgucgacugcacauuuugucgcgaguuccuuaaaaacccucagugcuauccggcgaagaaauggcuguuuaucauuaucgugauucuccugggauacgccggccuuaugcugcucaccaauguucugaaggcuaucgggguguggggcucuugggucauugcccccgugaagcugauguucgcuaucaugaaaaagcucaugagauccguuagcugucugaugggaaaacuuauggaucggggcagacaagugauccaugaagaaauuggggagaaccgcgagggaaaucaggacgauguccggaucgaaauggccagaccucgccgggugagacacuggauguauucucccgugauucugaccauccucgccguuggccuggcugaggggugcgacgaaaugguccaugcggauagcaaacuuguguccuguaagcagggaagcggcaacaugaaggagugcgugacaacggggcgcgcccugcucccugcugucaaucccggccaggaggccugucugcacuuuaccgccccgggaucuccugacuccaagugccugaaaauuaaggugaaaaagaucaaccucaaauguaaaaagagcuccucuuacuucguucccgaugcucggagcagaugcacauccgugcgccgguguagaugggccggcgacugccaaucugggugcccuagccauuuuaccuccaauucuuucagcgacgauugggcgggaaagauggaccgcgcuggccugggguuuuccggauguagcgauggcugcgggggcgccgccuguggaugcuucaacgcugcccccucuuguauuuucuggcggaagugggucgaaaauccucacggcaucaucuggaaagugucccccugcgcugccuggguuccgagcgcggugauugagcuuacaaugccuucuggggaagucagaaccuuccaccccauguccggaauccccacacagguguucaagggcguuagcgugacguaucuggggucugacauggaggucuccggacucaccgaucugugugaaauugaggagcugaaaagcaagaaacuugcccucgcuccuugcaaccaggccggcaugggcgugguggggaaggucggagaaauccaguguuccagcgaggaaucugcucggaccauuaagaaagacggcugcaucuggaacgccgaucugguugggaucgagcugcgcguggacgaugcgguguguuacagcaagauuacauccgucgaagccguggcuaauuauucugccaucccgaccacaauuggaggccucagauuugagcggagccaugacucccaagggaaaaucucuggaagcccccuggauauuacggcuaucagaggcuccuucucuguuaacuaccgcggccuucggcugagccucuccgagaucaccgccacaugcaccggggaagugacaaaugucagcggaugcuacucuuguaugaccggcgccaagguguccauuaaacugcacagcaacaaaaauucuacggcucauguuagaugcaagggggacgagaccgcguuuuccgugcuggaaggaguccacagcuauacagugucccuuucuuucgaucacgccguuguggacgagcagugucagcucaacugcggcgggcaugaaagccaggucacccugaagggaaaucugaucuuucucgacgugccuaaguucguggauggcuccuacaugcaaacauaucacagcucuguccccaccggcgcuaacauuccuucccccacggacuggcugaaugcccuuuuugggaacggacugagccgcuggauccucggcguuauuggggugcugcugggaggccuugcccucuucuuucugaucaugucucuguucaaacucgggacaaaacagguguuuagaagccggaccaagcuggcuuga

SEQ ID NO: 14829 - RNA, 3222 nt, Artificial Sequence
  derived and/or modified CDS sequence (opt5) from SFTSV(SPL062A)__AB985297.1__GP
augaugaaggugaucugguucagcucccugauuugccucgucaucagauguucuggcgggaccggacccauuaucugcgccggcccuauucacagcaacaaauccgcuaauaucccgcaucugcuuggguacucugagaagaucugucagauugaccggcugauccacguuagcuccuggcuccgcaaccauucucaauuucagggauaugugggccagagagggggacggagccagguguccuacuuccccgccgaaaauagcuauucucgcugguccggccugcuuagcccuugcgaugcggacuggcugggcaugcucgucgugaaaaaggcuagagggucugauaugauuguucccggaccuuccuacaaaggcaagguguuuuucgagcggcccacauuugacggguaugucggauggggcugugggagcggaaagucucgcacggaauccggcgagcugugcagcuccgauucuggcaccagcuccgggcugcucccuagcgacagagugcuguggaucggagauguugccugucaaccgaugacacccauuccugaagagaccuuccuugagcugaaaucuuuuucccagagcgaguuccccgacaucugcaagauugauggcaucguguuuaaccagugugaaucugaaagccucccucagcccuucgacgucgccuggauggauguggggcacucccauaaaaucauuaugcgggagcacaagacaaaaugggugcaagagucuagcuccaaggacuuugucugcuacaaggaaggaaccggcccguguagcgagucugaagagaaaacaugcaagaccuccgggagcugccgcggagauaugcaguucuguaaaguugcuggcugcgaacacggcgaggaggccucugaagcuaaguguagaugcucccuggugcauaaaccuggggagguggucgugagcuauggaggcaugcggguucgccccaaguguuacggguuuuccagaaugauggccacgcuugaagugaauccucccgagcagcggaucggacagugcaccggcugucaccuggaaugcauuaacgggggcguccgccucaucacacugaccucugagcugaaaagcgcgacagugugugccucccauuucugcucuagcgcuaccuccggaaagaaaagcacggagauucaauuccacucuggcucccucguugggaagacagccauccacgugaagggagcucuggucgacggcaccgaauuuacauucgaggggagcuguauguuucccgacggaugcgaugccguggacugcaccuucuguagagaauuucuuaaaaauccucagugcuacccggcgaagaaauggcuguucaucauuaucgccauucuccugggcuaugcugggcuuaugcugcucaccaacguccugaaggccaucggcguguggggaucuuggguuauugcucccgugaagcugauguuugccaucaucaaaaagcucaugcgguccgucagcugucugaugggcaaacuuauggauagagggcgccaggugauucaugaggaaaucggagagaaucgggagggcaaccaagacgauguuagaauugaaauggcccgcccucggagagugcgccacuggauguacucucccgucauccugacaauucucgcuaucgggcuggcggagggaugcgacgaaauggugcaugccgauagcaaacuuguguccuguaagcagggcagcgggaauaugaaggagugcguuacgaccggccgggcucugcucccugccgucaaccccggacaggaggccugucugcacuucacagcuccgggcucuccugacuccaagugccugaaaauuaaggugaaaagaaucaaucucaaguguaaaaagagcuccucuuauuuugugcccgaugcccgcagccggugcaccuccgucagacgcugucggugggcgggggacugccagucuggaugcccuagccauuucacauccaacucuuuuagcgaugacugggcuggcaagauggacagagccgggcugggauucuccggcuguagcgaugggugcggcggagccgcuuguggcugcuuuaaugccgcucccucuuguaucuucuggcggaaauggguggaaaacccucacgggauuaucuggaagguuucccccugcgccgcgugggugccgagcgccgucauugagcuuaccaugccuucuggagaagugcgcacguuccaccccauguccggcauccccacacaaguuuuuaaaggggugagcgucaccuaccugggaucugacauggagguguccggccucaccgaucugugugaaauugaggagcuuaagagcaaaaagcuggcucucgccccuugcaaccaggcuggcauggggguugugggaaaagucggcgaaauccaguguuccagcgaggaaucugccagaacaaucaagaaggacgggugcauuuggaaugcggaucuggugggaaucgagcugcggguggacgaugccgucuguuauagcaaaauuaccuccguugaagcuguggccaacuacucugcuaucccgacaacgauuggcgggcucagauucgagcgcagccaugacucccagggaaagaucucuggcagcccccuggauaucaccgccauucggggcuccuuuucugugaauuauagagggcuucgccugagccucuccgagaucacagcuaccugcacaggagaagucaccaacgugagcggcugcuacucuuguaugacgggggccaaaguuuccauuaagcugcacagcucuaaaaauuccaccgcgcaugugagaugcaagggagacgagacagccuucagcguccuggaaggcgugcacuccuacaccguuucucuuagcuuugaucacgcuguggucgacgagcaaugucagcucaacugcgggggacaugaaucccaggugacacugaagggcaaucugaucuuccucgauguuccuaaauuuguggacggcagcuauaugcagaccuaccacucuuccguccccacgggggccaacauuccuagccccacagacuggcugaaugcccuuuucggaaacggccugucucgguggauccucggggugaucggagugcugcugggcgggcuugcucucuuuuuccugauuaugagccuguuuaagcucggaaccaaacaagucuuccgcuccagaacaaagcuggccuga

SEQ ID NO: 14830 - RNA, 3222 nt, Artificial Sequence
  derived and/or modified CDS sequence (opt5) from SFTSV(SPL066A)__AB985298.1__GP
augaugaaggugaucugguucagcucccugauuugccucgucauccaguguucuggcgacgccagccccauuaucugcgcugggccuauucacuccaacaaaucugccaauaucccgcaucugcuuggauacagcgagaagaucugucaaauugauagacugauccacguuuccucuuggcuccggaaccauagccaguuucagggcuauguggggcagcgcggaggcagaucccaagugagcuacuuccccgcggaaaauucuuauucccgguggagcgggcugcuuucuccuugcgacgcugauuggcugggaaugcucgucgugaaaaaggccaaaggcuccgacaugauuguucccggcccuagcuacaaggggaagguguuuuucgagcgccccaccuuugauggauaugucggcuggggguguggaucuggcaaauccagaacagaaagcggggagcugugcuccucugacagcggaacguccagcggccugcucccuucugaucgggugcuguggaucggcgacguugccugucagccgaugacccccauuccugaagagacauuccuugagcugaaguccuuuagccagucugaguuccccgauaucugcaaaauugacgggaucguguuuaaccagugugaaagcgaaucccucccucaacccuucgaugucgcuuggauggacgugggacacucucauaagaucauuaugcgcgagcacaaaaccaagugggugcaggagagcuccagcaaggauuuugucugcuacaaagaaggcacagggccguguucugaguccgaagagaagaccugcaaaacaagcggaucuugcagaggcgacaugcaguucuguaagguugccgggugcgaacacggagaggaggcuuccgaagccaaaugucggugcagccuggugcauaagccuggcgagguggucguguccuauggcgggaugcgcguuagacccaaauguuacggauuuucucggaugauggcgacccuugaagugaauccucccgagcagcgcaucggccaaugcacggggugucaccuggaaugcauuaacggaggcgucagacucaucacccugacaagcgagcugaaguccgccaccgugugugcuucucauuucugcagcuccgccacaagcgggaagaaaucuaccgagauucaguuccacuccggcagccucguuggaaaggcugccauccacgugaaaggcgcgcuggucgacgggacggaauuuacauucgagggaucuuguauguuucccgauggcugcgacgccguggauugcaccuucugucgggaauuucuuaagaauccucagugcuacccggcuaaaaaguggcuguucaucauuaucgucauucuccugggguaugccggacuuaugcugcucacaaacgugcugaaggcuaucggcguuuggggguccugggugauugcccccgucaaacugauguuugccaucaucaagaaacucauucgcagcgugucuugucugaugggcaagcugauggacagaggacggcaaguuauccaugaggaaauuggcgagaauggggagggaaaccaggaugacgugagaaucgaaauggcucgcccucggagaguccgccacuggauguacagccccgugauucuuaccauccucgcgauuggccuggccgaggggugcgaugaaauggugcaugcugacuccaaacuuguuagcuguaagcagggaucuggcaauaugaaggagugcgucaccacagggcgggcccugcucccugccgugaaccccggccaggaggcuugucugcacuucacggccccgggauccccugauagcaaaugccugaagaucaaagugaagagaaucaaucucaaauguaagaaguccucuagcuauuuuguccccgacgcgcgcucccggugcaccucugugagacgcugucggugggcuggcgauugccaaagcgggugcccuucccauuucacaucuaacagcuuuuccgacgacugggccggaaaaauggauagagccggccugggguucagcggauguucugacggcugcgggggcgcugccuguggaugcuuuaaugcugcccccuccuguauuuucuggcgcaaguggguugaaaacccucacggcaucauuuggaaagugagccccugcgcggccugggucccgucugcugugaucgagcuuaccaugccuuccggggaaguucggacauuccaccccaugagcggcauucccacccagaucuuuaagggagugucugucacguaccugggguccgauauggaggugagcggacucacagaccugugugaaaucgaggagcugagauccaaaaagcucgcccuugcuccuugcaaccaggccggcaugggcguuguggggaaagucggagaaauucaguguagcucugaggaaagcgcgcggaccaucaagaaggauggcugcauuuggaaugccgaccugguggggaucgagcugcgcguggaugacgcugucuguuauuccaaaauuaccucuguugaagccguggcuaacuacagcgccaucccgacaaccaucggaggccucagauucgagcggucccaugauucucaagggaagauuagcggaucuccccuggacaucacagccauuagaggcuccuuuagcgugaauuaucgcggccuucggcugucccucagcgagaucacggcuaccugcacaggggaagucaccaacgugucuggaugcuacuccuguaugacaggcgcgaaaguuagcauuaagcugcacucuuccaaaaauagcaccgcccaugugagaugcaagggggaugagacggcuuucuccguccuggaaggagugcacucuuacaccguuagccuuuccuuugaccacgccguggucgaugagcagugucagcucaacugcggcgggcaugaaagccaggugacacugaagggaaaucugaucuuccucgacguuccuaaauuuguggacggcucuuauaugcaaaccuaccacuccagcguccccacaggcgccaacaucccuucucccaccgauuggcugaaugcucuuuucgggaacggacugagccgcuggauucucggcgugaucggggugcugcugggaggccuugcccucuuuuuccugauuaugucccuguuuaagcucgggacgaaacaggucuucagaucucggacaaagcuggcguga

SEQ ID NO: 14831 - RNA, 3222 nt, Artificial Sequence
  derived and/or modified CDS sequence (opt5) from SFTSV(SPL070A)__AB985301.1__GP
augaugaaggugaucugguucagcucccugauuugccucgucauccaguguucuggcgacaccgggcccauuaucugcgccggaccuauucacagcaacaaauccgcuaauaucccgcaucugcuuggcuacucugagaagaucugucaaauugauagacugauccacguuagcuccuggcuccggaaccauucucaguuucagggguaugugggacagcgcggcgggagaagccaaguguccuacuuccccgccgaaaauagcuauucucggugguccggacugcuuagcccuugcgacgcggauuggcugggcaugcucgucgugaaaaaggcuaaaggcucugacaugauuguucccgggccuuccuacaagggaaagguguuuuucgagcgccccacauuugauggcuaugucggguggggauguggcagcgggaaaucuagaacggaauccggagagcugugcagcuccgacucuggcaccagcuccggccugcucccuagcgaucgggugcuguggaucggggacguugccugucagccgaugacacccauuccugaagagaccuucauggagcuuaagucuuuuucccagagcgaauuucccgauaucugcaaaauugacggaaucguguuuaaccagugugagucugaaagccugccucaacccuucgaugucgccuggauggacgugggccacucccauaagaucauuaugcgcgagcacaaaacaaagugggugcaggagucuagcuccaaggauuuugucugcuacaaagaagggaccggaccguguagcgagucugaagagaagacaugcaaaaccuccggcagcugcagaggggacaugcaguucuguaagguugcuggaugcgaacacggcgaggaggccucugaagcuaaaugucggugcucccucgugcauaagccuggcgagguggucgugagcuaugggggaaugcgcguuagacccaaauguuacggcuuuucccggaugauggccacgcuggaagugucuccucccgagcagcgcaucgggcaaugcaccggaugucaccuugaaugcauuaauggcggggucagacugaucacacucaccagcgagcugaaguccgcgacagugugugccucucauuucugcagcuccgcuaccagcggcaagaaaucuacggagauucaguuccacuccggaagccugguuggcaagacagccauccacgugaaaggggcucucauggacggaaccgaauuuacauucgagggcucuuguauguuucccgaugggugcgacgccgucgauugcaccuucugucgggaauuucugaagaacccucagugcuacccggcgaaaaaguggcuuuucaucauuaucgugauucugcucggauaugccggccugaugcuucugaccaauguccucaaggcuaucgggguguggggcuccuggguuauugcccccgugaaacugauguuugcuaucaucaagaaacugaugcgcagcgucucuugucucaugggaaagcugauggacagaggccggcaagugauucaugaggaaaucggggagaacggagagggcaaucaggaugacguuagaauugaaauggcccgcccucggagagugcgccacuggauguacagccccgucauccuuacaauucuggccaucgggcucgcugagggaugcgaugaaauggugcaugcggacuccaaacuggugagcuguaagcagggcucugggaacaugaaggagugcguuacgaccggccgggcccuucugccugcugucaaucccggacaggaggccugucuccacuucacagccccgggcuccccugauagcaaaugccugaagauuaaagugaagagaaucaaccugaaauguaagaaguccucuagcuauuuugugcccgacgcucgcucccggugcaccucugucagacgcugucggugggccggggauugccaaagcggaugcccuucccauuucacaucuaauagcuuuuccgacgacugggcgggcaaaauggauagagcugggcucggauucagcggcuguucugacgggugcggcggagccgccuguggcugcuuuaacgcugcccccuccuguaucuucuggcgcaaguggguggaaaauccucacgggauuaucuggaaaguuagccccugcgcugccugggugccgucugcggucauugagcugaccaugccuuccggagaagugcggacguuccaccccaugagcggcauccccacacagguuuuuaagggggugucugucaccuaccuuggauccgauauggaggugaccggccugacagaccucugugaaauugaggagcugaaaagcaagaaacuggcccuugcuccuugcaaccaggccggcauggggguugugggaaaggucggcgaaauccaguguuccagcgaggaaucugcuagaaccaucaagaaagaugggugcauuuggaacgccgaccucgugggaaucgagcugcggguggaugacgcggucuguuauagcaagauuacauccguugaagccguggcuaauuacucugccaucccgacgaccauuggcgggcugcgcuucgagagaagccaugauucccaaggaaaaaucucuggcagcccccucgacaucacagcuauucggggcuccuuuucugugaacuauagagggcugcgccuuagccuguccgagaucaccgccacaugcaccggagaagucacgaaugugagcggcugcuacucuuguaugaccggggccaagguuuccauuaaacuccacagcucuaagaacuccacagcucaugugcggugcaagggagaugagaccgcguucagcguccuggaaggcgugcacuccuacacaguuucucugagcuuugaccacgccguggucgaugagcagugucagcuuaauugcgggggacaugaaucccaggugacccucaaaggcaaccugaucuuccuggacguuccuaaguuuguggacggcagcuauaugcaaacguaccacucuuccguccccacaggggcuaauauuccuagccccaccgauuggcucaacgcccuguucggaaauggccuuucuagauggauccugggggugaucggagugcuccugggcgggcuggcccuuuucuuccucauuaugagccuguuuaaacugggaacaaagcaggucuuccgcccuagaaccaaacucgcuuga

SEQ ID NO: 14832 - RNA, 3222 nt, Artificial Sequence
  derived and/or modified CDS sequence (opt5) from SFTSV(SPL071A)__AB985302.1__GP
augaugaaggugaucugguucagcucccugauuugccucaucauucaguguucuggcgacaccgggcccaucauuugcgccggaccuauccacagcaacaaauccgcuaauaucccgcaucugcuuggcuacucugagaagauuugucaaaucgauagacugauucacgucagcuccuggcuccggaaccauucucaguuucagggguauguuggacagcgcggcgggagaagccaaguguccuacuuccccgccgaaaauagcuauucucggugguccggacugcuuagcccuugcgacgcggauuggcugggcaugcucguggucaaaaaggcuaaaggcucugacaugaucgugcccgggccuuccuacaagggaaagguuuucuucgagcgccccacauuugauggcuaugugggguggggauguggcagcgggaaaucuagaacggaauccggagagcugugcagcuccgacucuggcaccagcuccggccugcucccuagcgaucggguccuguggauuggggacguggccugucagccgaugacacccaucccugaagagaccuuccuugagcugaagucuuuuucccagagcgaauuucccgauauuugcaaaaucgacggaaucguuuuuaaccagugugagucugaaagccucccucaacccuucgauguggccuggauggacgucggccacucccauaagauuaucaugcgcgagcacaaaacaaagugggugcaggagucuagcuccaaggauuuugugugcuacaaagaagggaccggaccguguagcgagucugaagagaagacaugcaaaaccuccggcagcugcagaggggacaugcaguucuguaaggucgcuggaugcgaacacggcgaggagacgucugaagccaaaugucggugcucccugguucauaagccuggcgaggugguggucagcuaugggggaaugcgcgugagacccaaauguuacggcuuuucccggaugauggcuacccuugaaguuaauccucccgagcagcgcauugggcaaugcacaggaugucaccuggaaugcaucaacggcggggugagacucauuacccugacaucugagcuuaagagcgccaccgucugugcgucccauuucugcucuagcgccacguccggcaagaaaagcacagagauccaguuccacucuggaucccucgugggcaagaccgcuauccacguuaaaggggcccugguggacggaacagaauuuaccuucgagggcagcuguauguuucccgaugggugcgacgcugucgauugcaccuucugucgggaauuucuuaagaauccucagugcuacccggccaaaaaguggcuguucauuaucauugugauccuccugggauaugcgggccuuaugcugcucacaaacguccugaaggccauugggguguggggcucuuggguuaucgcucccgugaaacugauguuugccaucauuaagaaacucaugcgcuccgucagcugucugaugggaaagcugauggacagaggccggcaagugauccaugaggaaauuggggagaauagagagggaaaccaggaugacguucgcaucgaaauggcucggccuagacgcgugcggcacuggauguacucucccgucauucuggccauccucgccauuggccuggcugaggggugcgaugaaauggugcaugcggacagcaaacuuguguccuguaagcagggaagcggcaauaugaaggagugcguuacgaccgggagagcccugcucccugcugucaaccccggccaggaggccugucugcacuucacagccccgggaucuccugauuccaaaugccugaagaucaaagugaagcgcaucaaucucaaauguaaaaagagcuccucuuauuuugugcccgacgcucggagcagaugcaccuccguccgccgguguagaugggccggcgauugccaaucugggugcccuagccauuucacauccaacucuuuuagcgacgacugggcgggaaagauggaucgcgcuggccugggguucuccggauguagcgacggcugcgggggcgccgccuguggaugcuuuaaugcugcccccucuuguauuuucuggcggaaguggguggaaaacccucacggcaucauuuggaaaguuucccccugcgcugccugggugccgagcgcggucaucgagcuuaccaugccuucuggggaagugagaacguuccaccccauguccggcauucccacacagguuuuuaagggagugagcgucaccuaccuggggucugauauggagguguccggacucaccgaccugugugaaaucgaggagcugaaaagcaagaaacuugcccucgcuccuugcaaccaggccggcaugggcguuguggggaaggucggagaaauccaguguuccagcgaggaaucugcucggacaauuaagaaagauggcugcaucuggaaugccgaccugguggggauugagcugcgcguggaugacgcggucuguuauagcaagaucaccuccguugaagccguggcuaacuacucugccauuccgacaacgaucggaggccucagauucgagcggagccaugauucccaagggaaaaucucuggaagcccccuggacauuaccgcuaucagaggcuccuuuucugugaauuaucgcggccuucggcugagccucuccgagauuacagcuaccugcacaggggaagucaccaacgugagcggaugcuacucuuguaugacgggcgccaagguuuccaucaaacugcacagcucuaaaaauuccaccgcccaugugagaugcaagggggaugagacagcguucagcguccuggaaggagugcacuccuacaccguuucucuuagcuuugaccacgccguggucgaugagcagugucagcucaacugcggcgggcaugaaucccaggugacacugaagggaaaucugauuuuccucgacguuccuaaguuuguggacggcagcuauaugcaaaccuaccacucuuccguccccacgggcgcuaacaucccuagccccacagauuggcugaaugcccuuuucgggaacggacugucucgcuggauccucggcgugauuggggugcugcugggaggccuugcccucuuuuuccugaucaugagccuguuuaaacucgggaccaagcaggucuucagaucccggacaaaacuggcuuga

SEQ ID NO: 14833 - RNA, 3222 nt, Artificial Sequence
  derived and/or modified CDS sequence (opt5) from SFTSV(SPL077A)__AB985304.1__GP
augaugaaggugaucugguucagcucccugauuugccucgucacccaguguucuggcgacacagggcccaucauuugcgccggaccuauccacagcaacaaauccgcuaauauuccgcaucugcuuggcuacucugagaagaucugucaaaucgauagacugauucacguuagcuccuggcuccggaaccauucucaguuucagggguaugugggacagcgcggcgggagaagccaaguguccuacuuccccgccgaaaauagcuauucucggugguccggacugcuuagcccuugcgacgcggauuggcugggcaugcucgucgugaaaaaggcuaaaggcucugacaugaucguucccgggccuuccuacaagggaaagguguuuuucgagcgccccacguuugauggcuaugucggguggggauguggcagcgggaaaucuagaaccgaauccggagagcugugcagcuccgacucuggcacaagcuccggccugcucccuagcgaucgggugcuguggauuggggacguugccugucagccgaugacccccaucccugaagagacauuccuugagcugaagucuuuuucccagagcgaguuccccgauauuugcaaaaucgacggaauuguguuuaaccagugugaaucugaaagccucccucaacccuucgaugucgccuggauggacgugggccacucccauaagaucaucaugcgcgagcacaaaaccaagugggugcaggagucuagcuccaaggauuuugucugcuacaaagaagggacaggaccguguagcgagucugaagagaagaccugcaaaacguccggcagcugcagaggggacaugcaguucuguaagguugcuggaugcgaacacggcgaggaggccucugaagcuaaaugucggugcucccuggugcauaagccuggcgagguggucgugagcuaugggggaaugcgcguuagacccaaauguuacggcuuuucccggaugauggccacccuugaagugaauccucccgagcagcgcauugggcaaugcacaggaugucaccuggaaugcaucaacggcggggucagacucauuacccugacaucugagcugaaguccgcgaccgugugugccucccauuucugcucuagcgcuacguccggcaagaaaagcacagagauccaguuccacucuggaucccucguuggcaagaccgccauucacgugaaaggggcucuggucgacggaacagaauuuaccuucgagggcagcuguauguuucccgaugggugcgacgccguggauugcaccuucugucgggaauuucuuaagaauccucagugcuacccggcgaaaaaguggcuguucaucaucauugucauccuccugggauaugccggccuuaugcugcucacaaacgugcugaaggcuauugggguuuggggcucuugggugaucgcccccgucaaacugauguuugcuauucucaagaaacugaugcgcuccgugagcugucuuaugggaaagcugauggacagaggccggcaaguuauccaugaggaaaucggggagaauagagagggaaaccaggaugacgugcgcauugaaauggcccggccuagacgcguccggcacuggauguacucucccgugauccucacgauucuggccaucggccuugcugaggggugcgaugaaauggugcaugcggacagcaaacugguuuccuguaagcagggaagcggcaauaugaaggagugcgucaccacagggagagcccuccugccugcugugaaccccggccaggaggccugucugcacuucaccgccccgggaucuccugauuccaaaugccucaagauuaaagugaagcgcaucaaucugaaauguaaaaagagcuccucuuauuuuguccccgacgcucggagcagaugcacauccgugcgccgguguagaugggccggcgauugccaaucugggugcccuagccauuucaccuccaacucuuuuagcgacgacugggcgggaaagauggaucgcgcuggccuuggguucuccggauguagcgacggcugcgggggcgccgccuguggaugcuuuaaugcugcccccucuuguauuuucuggcggaaguggguugaaaacccucacggcaucaucuggaaagugucccccugcgcugccugggucccgagcgcggugauugagcugacgaugccuucuggggaaguuagaacauuccaccccauguccagcauccccacccagguguuuaagggagucucugugaccuaccucggcuccgauauggagguuagcgggcugacagaccugugugaaauugaggagcuuaaauccaagaaacucgcccuggcuccuugcaaccaggccggaaugggcguggucggcaaggugggggaaauccaguguagcucugaggaaagcgcucggaccauuaagaaagauggaugcaucuggaaugccgaccuggugggcaucgagcuccgcgucgaugacgcgguuuguuauuccaagauuacaucuguggaagccguggcuaacuacagcgccaucccgacgaccauugggggacugagauucgagcggucccaugauucucaaggcaaaaucagcgggagcccccuugacauuacagcuaucagaggaucuuuuagcgucaauuaucgcggccugcggcucucccugagcgagaucaccgccacaugcaccggcgaagugacgaacguuucugggugcuacuccuguaugaccggagccaaggugagcauuaaacugcacucuuccaagaauagcacagcucaugucagaugcaagggcgaugagaccgcguucuccgugcuugaagggguucacucuuacacagugagccucuccuuugaccacgccgucguggaugagcagugucagcugaacugcggaggccaugaaagccagguuacccugaaagggaaucucaucuuccuggacgugccuaaguuugucgacggaucuuauaugcaaacguaccacuccagcgugcccacaggcgcuaacauuccuucucccaccgauuggcuuaaugcccuguucggcaacgggcucagccgcuggauccugggagugauuggcguccugcuugggggacucgcccuguuuuuccugaucaugucccucuuuaaacagggcacaaagcagguuuucagaucucggaccaaacuggcuuga

SEQ ID NO: 14834 - RNA, 3222 nt, Artificial Sequence
  derived and/or modified CDS sequence (opt5) from SFTSV(SPL084A)__AB985307.1__GP
augaugaaggugaucugguucagcucccugauuugccucgucauccaguguucuggcgacaccgggcccauuaucugcgccggaccuauucacagcaacaaauccgcuaauaucccgcaucugcuuggcuacucugagaagaucugucaaauugauagacugauccacguuagcuccuggcuccggaaccauucucaguuucagggguaugugggacagcgcggcgggagaagccaaguguccuacuuccccgccgaaaauagcuauucucggugguccggacugcuuagcccuugcgacgcggauuggcugggcaugcucgucgugaaaaaggcuaaaggcucugacaugauuguucccgggccuuccuacaagggaaagguguuuuucgagcgccccacauuugauggcuaugucggguggggauguggcagcgggaaaucuagaacggaauccggagagcugugcagcuccgacucuggcaccagcuccggccugcucccuagcgaucgggugcuguggaucggggacguugccugucagccgaugacacccauuccugaagagaccuuccuugagcugaagucuuuuucccagagcgaguuccccgauaucugcaaaauugacggaaucguguuuaaccagugugaaucugaaagccucccucaacccuucgaugucgccuggauggacgugggccacucccauaagaucauuaugcgcgagcacaaaacaaagugggugcaggagucuagcuccaaggauuuugucugcuacaaagaagggaccggaccguguagcgagucugaagagaagacaugcaaaaccuccggcagcugcagaggggacaugcaguucuguaagguugcuggaugcgaacacggcgaggaggccucugaagcuaaaugucggugcucccuggugcauaagccuggcgagguggucgugagcuaugggggaaugcgcguuagacccaaauguuacggcuuuucccggaugauggccacgcuugaagugaauccucccgagcagcgcaucgggcaaugcaccggaugucaccuggaaugcauuaacggcggggucagacucaucacacugaccucugagcugaaguccgcgacagugugugccucccauuucugcucuagcgcuaccuccggcaagaaaagcacggagauucaguuccacucuggaucccucguuggcaagacagccauccacgugaaaggggcucuggucgacggaaccgaauuuacauucgagggcagcuguauguuucccgaugggugcgacgccguggauugcaccuucugucgggaauuucuuaagaauccucagugcuacccggcgaaaaaguggcuguucaucauuaucgucauucuccugggauauaccggccuuaugcugcucacaaacgugcugaaggccaucgggguuuggggcucuugggugauugcucccgucaaacugauguuugccauccucaagaaacugaugcgcuccgugagcugucuuaugggaaagcugauggacagaggccggcaaguuauccaugaggaaauuggggagaauagagagggaaaccaggaugacgugcgcaucgaaauggcucggccuagacgcguccggcacuggauguacucucccgugauucucacgauccuggccauuggccuugccgaggggugcgaugaaauggugcaugcugacagcaaacugguuuccuguaagcagggaagcggcaauaugaaggagugcgucaccacagggagagcgcuccugccugccgugaaccccggccaggaggcuugucugcacuucaccgccccgggaucuccugauuccaaaugccucaagaucaaagugaagcgcauuaaucugaaauguaaaaagagcuccucuuauuuuguccccgacgcccggagcagaugcacauccgugcgccgguguagaugggcuggcgauugccaaucugggugcccuagccauuucaccuccaacucuuuuagcgacgacugggccggaaagauggaucgcgcgggccuuggguucuccggauguagcgacggcugcgggggcgcugccuguggaugcuuuaaugccgcucccucuuguaucuucuggcggaaguggguugaaaacccucacggcaucauuuggaaagugucccccugcgccgcuugggucccgagcgccgugaucgagcugacgaugccuucuggggaaguuagaacauuccaccccauguccggcauucccacccagguguuuaagggagucagcgugaccuaccucgggucugauauggagguuuccggacugacagaccugugugaaaucgaggagcuuaaaagcaagaaacucgcgcuggccccuugcaaccaggcuggcaugggcguggucgggaaggugggagaaauucaguguuccagcgaggaaucugcccggaccaucaagaaagauggcugcaucuggaaugcugaccugguggggauugagcuccgcgucgaugacgccguuuguuauagcaagaucacauccguggaagcgguggccaacuacucugcuauuccgacgaccaucggaggccugagauucgagcggagccaugauucccaagggaaaauuucuggaagcccccuugacaucacagccaucagaggcuccuuuucugucaauuaucgcggccugcggcucagccuguccgagauuaccgcuacaugcaccggggaagugacgaacguuagcggaugcuacucuuguaugaccggcgccaagguguccaucaaacugcacagcucuaagaauagcacagcccaugucagaugcaagggggaugagaccgcuuucagcgugcaggaaggaguucacuccuacacagugucucuuagcuuugaccacgcggucguggaugagcagugucagcucaacugcggcgggcaugaaucccaaguuacccugaaaggaaaucugauuuuccucgacgugccuaaguuugucgacggcagcuauaugcagacguaccacucuuccgugcccacaggcgccaacaucccuagccccaccgauuggcugaaugcucuuuucgggaacggacugucucgcuggauucucggcgugaucgggguccugcugggaggccuugcccucuuuuuccugaucaugagccuguuuaaacucgggacaaagcagguuuucagaucccggaccaaacuggccuga

SEQ ID NO: 14835 - RNA, 3222 nt, Artificial Sequence
  derived and/or modified CDS sequence (opt5) from SFTSV(SPL086A)__AB985308.1__GP
augaugaaggugaucugguucagcucccugauuugccucgucauccaguguucuggcgacaccgggcccauuaucugcgccggaccuauucacagcaacaaauccgcuaauaucccgcaucugcuuggcuacucugagaagaucugucaaauugauagacugauccacguuagcuccuggcuccggaaccauucucaguuucagggguaugugggacagcgcggcgggagaagccaaguguccuacuuccccgccgaaaauagcuauucucggugguccggacugcuuagcccuugcgacgcggauuggcugggcaugcucgucgugaaaaaggcuaaaggcucugacaugauuguucccgggccuuccuacaagggaaagguguuuuucgagcgccccacauuugauggcuaugucggguggggauguggcagcgggaaaucuagaacggaauccggagagcugugcagcuccgacucuggcaccagcuccggccugcucccuagcgaucgggugcuguggaucggggacguugccugucagccgaugacacccauuccugaagagaccuuccuugagcugaagucuuuuucccagagcgaguuccccgauaucugcaaaauugacggaaucguguuuaaccagugugaaucugaaagccucccucaacccuucgaugucgccuggauggacgugggccacucccauaagaucauuaugcgcgagcacaaaacaaagugggugcaggagucuagcuccaaggauuuugucugcuacaaagaagggaccggaccguguagcgagucugaagagaagacaugcaaaaccuccggcagcugcagaggggacaugcaguucuguaagguugcuggaugcgaacacggcgaggaggccucugaagcuaaaugucggugcucccuggugcauaagccuggcgagguggucgugagcuaugggggaaugcgcguuagacccaaauguuacggcuuuucccggaugauggccacgcuugaagugaauccucccgagcagcgcaucgggcaaugcaccggaugucaccuggaaugcauuaacggcggggucagacucaucacacugaccucugagcuuaagagcgcgacagugugugccucccauuucugcucuagcgcuaccuccggcaagaaaagcacggagauucaguuccacucuggaucccucguuggcaagacagccauccacgugaaaggggcucuggucgacggaaccgaauuuacauucgagggcagcuguauguuucccgaugggugcgacgccguggauugcaccuucugucgggaauuucuuaagaauccucagugcuacccggcgaaaaaguggcuguucaucauuaucgucauucuccugggauaugccggccuuaugcugcucaccaacgugcugaaggcuaucgggguuuggggcucuugggugauugcccccgucaaacugauguuugcuaucaucaagaaacucaugcgcuccgugagcugucugaugggaaagcugauggacagaggccggcaaguuauucaugaggaaaucggggagaauagagagggaaaccaggaugacgugcgcauugaaauggcccggccuagacgcguccggcacuggauguacucucccgugauccugacaauucucgccaucggccuggcugaggggugcgaugaaauggugcaugcggacagcaaacuuguuuccuguaagcagggaagcggcaauaugaaggagugcgucacgaccgggagagcccugcucccugcugugaaccccggccaggaggccugucugcacuucacagccccgggaucuccugauuccaaaugccugaagauuaaagugaagcgcaucaaucucaaauguaaaaagagcuccucuuauuuuguccccgacgcucggagcagaugcaccuccgugcgccgguguagaugggccggcgauugccaaucugggugcccuagccauuucacauccaacucuuuuagcgacgacugggcgggaaagauggaucgcgcuggccugggguucuccggauguagcgacggcugcgggggcgccgccuguggaugcuuuaaugcugcccccucuuguaucuucuggcggaaguggguugaaaacccucacggcauuaucuggaaagugucccccugcgcugccugggucccgagcgcggugauugagcuuaccaugccuucuggggaaguuagaacguuccaccccauguccggaauccccacacagguguuuaagggcgucagcgugaccuaccuggggucugauauggagguuuccggacucaccgaccugugugaaauugaggagcugaaaagcaagaaacuugcccucgcuccuugcaaccaggccggcaugggcguggucgggaaggugggagaaauccaguguuccagcgaggaaucugcucggacaaucaagaaagauggcugcauuuggaaugccgaccugguggggaucgagcugcgcgucgaugacgcgguuuguuauagcaagauuaccuccguggaagccguggcuaacuacucugccaucccgacaacgauuggaggccucagauucgagcggagccaugauucccaagggaaaaucucuggaagcccccuggacaucaccgcuauuagaggcuccuuuucugucaauuaucgcggccuucggcugagccucuccgagaucacagcuaccugcacaggggaagugaccaacguuagcggaugcuacucuuguaugacgggcgccagaguguccauuaagcugcacagcucuaaaaauuccaccgcccauguccgcugcaagggggaugagacagcguucagcgugcuggaaggaguucacuccuacaccgugucucuuagcuuugaccacgccgucguggaugagcagugucagcucaacugcggcgggcaugaaucccagguuacacugaagggaaaucugaucuuccucgacgugccuaaauuugucgacggcagcuauaugcaaaccuaccacucuuccgugcccacgggcgcuaacauuccuagccccacagauuggcugaaugcccuuuucgggaacggacugucuagauggauccucggcgugaucgggguccugcugggaggccuugcccucuuuuuccugauuaugagccuguuuaagcucgggaccaaacagguuuuccggucccgcacaaagcuggcuuga

SEQ ID NO: 14836 - RNA, 3222 nt, Artificial Sequence
  derived and/or modified CDS sequence (opt5) from SFTSV(SPL087A)__AB985309.1__GP
augaugaaggugaucugguucagcucccugauuugccucgucauccaguguucuggcgacagcgggcccauuaucugcgccggaccuauucacuccaacaaaucugcugauaucccgcaucugcuuggcuacagcgagaagaucugucaaauugacagacugauccacguuuccucuuggcuccggaaucauagccaguuucagggguaugugggacagcgcggcgggagaucccaagugagcuacuaucccgccgaaaacucuuacucccgguggagcggacugcuuucuccuugcgaugcggacuggcugggcaugcucgucgugaaaaaggcuaaaggcuccgauaugauuguucccgggccuagcuauaagggaaagguguucuuugagcgccccaccuucgacggcuacgucggguggggauguggcucugggaaauccagaagcgaauccggagagcugugcucuagcgauuccggcacaagcucuggccugcucccuuccgaccgggugcuguggaucggggauguugccugucagccgaugacgcccauuccugaagagaccuuucuugagcuuaagagcuucucucagagcgaauuucccgacaucugcaaaauugauggaaucguguucaaucagugugagggcgaaucccucccucaacccuuugacgucgccuggauggauguggggcacucucauaagaucauuaugcgcgagcacaaaacaaagugggugcaggagagcuccagcaaggacuucgucugcuauaaagaaggaaccggcccguguucugaguccgaagagaagacaugcaaaaccagcgggucuugcagaggagacacacaguuuuguaagguugcuggcugcgaacacggcgaggaggccuccgaagcuaaaugucggugcagccuggugcauaagccuggggagguggucguguccuacggaggcaugcgcguuagacccaaauguuacggguucucucggaugauggccacccuugaagugagcccucccgagcagcgcaucggacaaugcacgggcugucaccuggaaugcauuaacgggggcgucagacucaucacccugacauccgagcugaagucugcgaccgugugugccagccauuuuugcuccagcgcuacaucuggaaagaaauccaccgagauucaguuccacagcggcucucucguugggaagacggccauccacgugaaaggagcucuggucgauggcacagaauuuaccuuugagggguccuguauguuccccgacggaugcgaugccguggacugcacauuuugucgggaguuccuuaagaauccucagugcuauccggcgaaaaaguggcuguuuaucauuaucgucauucuccugggcuacgccgggcuuaugcugcucaccaacgugcugaaggcuaucggcguuuggggaagcugggugauugcccccgucaaacugauguucgcuaucaucaagaaacucaugcgcaccgugucuugucugaugggcaagcugauggauagagggcggcaaguuauucaugaagaaaucggagagaauagagagggcaaccgcgacgauauucggaucgaaauggccagaccucgccgggugagacacuggauguauagccccgucauucugacaauccucgccauugggcuggcugagggaugcgacgaaauggugcaugcggauuccaaacuugugagcugucgccagggcucugggaauaugaaggagugcguuacgaccggccgggcccugcucccugcugucaaccccggacaggaggccugucugcacuuuacagccccgggcuccccugacagcaagugccugaaaaucaaggugaaaagaaucaaucucaaguguaaaaaguccucuagcuacuucgugcccgaugcucgcucccggugcaccucugucagacgcugucggugggccggggacugccagagcggaugcccuccccauuuuacauccaacucuuucagcgacgauugggcgggcaagauggacagagcugggcugggauuuuccggcuguagcgaugggugcggcggagccgccuguggcugcuucaaugcugccccuucuuguauuuucuggcggaaauggguggaaaacccccacgggaucauuuggaagguuuccccgugcgcugccugggugccuagcgcggucaucgagcuuaccaugcccucuggagaagugcgcacguuccaccccauguccggcauuccuacacaaguuuucaaaggggugagcgucaccuaucugggaucugacauggagguguccggccucaccgaucugugugaaaucgaggagcuuaagagcaaaaagcuggcccucgcuccgugcaaucaggccggcauggggguugugggaaaagucggcgaaauccaguguuccagcgaggaaucugcuagaacaauuaagaaggacgggugcaucuggaacgccgaucuggugggaauugagcugcggguggacgaugcggucuguuacagcaaaaucaccuccguugaagccguggcuaacuauucugccauucccacaacgaucggcgggcucagauuugagcgcagccaugacucccagggaaagaucucuggcagcccucuggauauuaccgcuauccggggcuccuucucugugaauuacagagggcuucgccugagccucuccgagauuacagcuaccugcacaggagaagucaccaacgugagcggcugcuacucuuguaugacgggggccaaaguuuccaucaagcugcacagcucuaaaaauuccaccgcccaugugagaugcaagggagacgagacagcguuuagcguccuggaaggcgugcacuccuauaccguuucucuuagcuucgaucacgccguggucgacgagcggugucaacucaacugcgggggacaugaaucccaggugacacugaagggcaaucugauuuuucucgacguucccaaauucguggauggcagcuacaugcagaccuaucacucuacggucccuacaggggcuaacauccccuccccuaccgacuggcugaaugcccuuuuuggaaacggccugagccgcuggauccucggggugauuggagugcugcugggcgggcuugcccucuucuuucugaucaugucucuguucaagcucggaacaaaacaggucuuuagaagccggaccaagcuggcuuga

SEQ ID NO: 14837 - RNA, 3222 nt, Artificial Sequence
  derived and/or modified CDS sequence (opt5) from SFTSV(SPL090A)__AB985311.1__GP
augaugaaggugaucugguuccccagccugauuugccucgucaucagauguuccggcgggaccggaccuauuaucugcgccggcccgauucacucuaacaaaagcgcuaauaucccccaucugcuuggguacuccgagaagaucugucagauugaccggcugauccacguuucuagcuggcuccgcaaccauucccaauuucagggauaugugggccagagagggggacggucucaggugagcuacuucccugccgaaaauuccuauagccgcuggucuggccugcuuucccccugcgaugcggacuggcugggcaugcucgucgugaaaaaggcuagagggagcgauaugauuguuccuggacccucuuacaaaggcaagguguuuuucgagcggccuacauuugacggguaugucggauggggcuguggguccggaaagagccgcacggaaucuggcgagcugugcuccagcgauuccggcaccucuagcgggcugcucccguccgacagagugcuguggaucggagauguugccugucaacccaugacaccuauucccgaagagaccuuccuugagcugaaaucuuuuagccaguccgaguucccugacaucugcaagauugauggcaucguguuuaaccagugugaaagcgaaucucucccccagccguucgacgucgccuggauggauguggggcacagccauaaaaucauuaugcgggagcacaagacaaaaugggugcaagaguccucuagcaaggacuuugucugcuacaaggaaggaaccggcccuuguuccgagagcgaagagaaaacaugcaagaccucuggguccugccgcggagauaugcaguucuguaaaguugcuggcugcgaacacggcgaggaggccagcgaagcuaaguguagaugcucucuggugcauaaacccggggagguggucguguccuauggaggcaugcggguucgcccuaaguguuacggguuuagcagaaugauggccacgcuugaagugaauccucccgagcagcggaucggacagugcaccggcugucaccuggaaugcauuaacgggggcguccgccucaucacacugaccuccgagcugaaaucugcgacagugugugccagccauuucugcuccucugcuaccagcggaaagaaguccacggagauucaauuccacagcggcucucucguugggaaaacagccauccacgugaagggagcucuggucgacggcaccgaauuuacauucgagggguccuguauguuucccgacggaugcgaugccguggacugcaccuucuguagagaauuucuuaaaaauccgcagugcuaccccgcgaagaaauggcuguucaucauuaucgccauucuccugggcuaugcugggcuuaugcugcucaccaacguccugaaggccaucggcguguggggaagcuggguuauugcuccugugaagcugauguuugccaucaucaaaaagcucaugcggucugucuccugucugaugggcaaacuuauggauagagggcgccaggugauucaugaggaaaucggagagaaucgggagggcaaccaagacgauguuagaauugaaauggcccgcccccggagagugcgccacuggauguacagcccugucauccugacaauucucgcuaucgggcuggcggagggaugcgacgaaauggugcaugccgauucuaaacuugugagcuguaagcagggcuccgggaauaugaaggagugcguuacgaccggccgggcucugcuccccgccgucaacccgggacaggaggccugucugcacuucacagcuccuggcagccccgacucuaagugccugaaaauuaaggugaaaagaaucaaucucaaguguaaaaaguccagcuccuauuuugugccugaugcccgcucucggugcaccagcgucagacgcugucggugggcgggggacugccaguccggaugccccucucauuucacaagcaacuccuuuucugaugacugggcuggcaagauggacagagccgggcugggauucagcggcuguuccgaugggugcggcggagccgcuuguggcugcuuuaaugccgcuccuagcuguaucuucuggcggaaauggguggaaaacccccacgggauuaucuggaagguuucuccgugcgccgcgugggugccuuccgccgucauugagcuuaccaugcccagcggagaagugcgcacguuccaccccaugucuggcaucccuacacaaguuuuuaaagggguguccgucaccuaccugggaagcgacauggaggugucuggccucaccgaucugugugaaauugaggagcugaaguccaaaaagcucgcucuugccccgugcaaccaggcuggcauggggguugugggaaaagucggcgaaauccaguguagcuccgaggaaagcgccagaacaaucaagaaggacgggugcauuuggaaugcggaucuggugggaaucgagcugcggguggacgaugccgucuguuauucuaaaauuaccagcguugaagcuguggccaacuacuccgcuauccccacaacgauuggcgggcucagauucgagcgcucucaugacagccagggaaagaucuccggcucuccucuggauaucaccgccauucggggcagcuuuuccgugaauuauagagggcuucgccugucucucagcgagaucacagcuaccugcacaggagaagucaccaacguguccggcugcuacagcuguaugacgggggccaaaguuucuauuaagcugcacuccagcaaaaauucuaccgcgcaugugagaugcaagggagacgagacagccuucuccguccuggaaggcgugcacagcuacaccguuucccuuucuuuugaucacgcuguggucgacgagcaaugucagcucaacugcgggggacaugaaagccaggugacacugaagggcaaucugaucuuccucgauguucccaaauuuguggacggcuccuauaugcagaccuaccacagcucugucccuacgggggccaacauucccuccccuacagacuggcugaaugcccuuuucggaaacggccugagccgguggauccucggggugaucggagugcugcugggcgggcuugcucucuuuuuccugauuaugucucuguuuaagcucggaaccaaacaagucuuccgcagcagaacaaagcuggccuga

SEQ ID NO: 14838 - RNA, 3222 nt, Artificial Sequence
  derived and/or modified CDS sequence (opt5) from SFTSV(SPL097A)__AB985312.1__GP
augaugaaggugaucugguucagcucccugauuugccucgucauccaguguucuggcgacaccgggcccauuaucugcgccggaccuauucacagcaacaaguccgcugauaucccgcaucugcuuggcuacucugagaagaucugucaaauugacagacugauccacguuagcuccuggcuccggaaucauucucaguuucagggguaugugggacagcgcggcgggagaagccaaguguccuacuaucccgccgaaaacagcuacucucggugguccggacugcuuagcccuugcgaugcggacuggcugggcaugcucgucgugaaaaaggcuaaaggcucugauaugauuguucccgggccuuccuauaagggaaagguguucuuugagcgccccacauucgacggcuacgucggguggggauguggcagcgggaaaucuagaacggaauccggagagcugugcagcuccgauucuggcaccagcuccggccugcucccuagcgaccgggugcuguggaucggggauguugccugucagccgaugacacccauuccugaagagaccuuucuugagcugaagucuuucucccagagcgaauuucccgacaucugcaaaauugauggaaucguguucaaucagugugagucugaaagccucccucaacccuuugacgucgccuggauggaugugggccacucccauaagaucauuaugcgcgagcacaaaacaaagugggugcaggagucuagcuccaaggacuucgucugcuauaaacaggggaccggaccguguccugaaagcgaggaaaagacaugcaaaaccucuggcuccugcagaggggacaugcaguuuuguaagguugcuggaugcgagcacggcgaagaggccagcgaggcuaaaugucggugcucucuggugcauaagcccggcgaaguggucguguccuacgggggaaugcgcguuagaccuaaauguuacggcuucagccggaugauggccacgcuugaggugaacccucccgaacaacgcaucgggcagugcaccggaugucaccuggagugcgucaauggcggggugagacucauuacacugaccuccgaacugaagucugcgacaguuugugccagccauuuuugcuccucugcuaccagcggcaagaaaaacacggagauccaguuccacuccggaagccucgugggcaagacagccauucacgucaaaggggcucugcuugauggaaccgaguucacauuugaaggcucuuguauguuccccgacgggugcgaugccguggacugcaccuuuugucgggaguuccugaagaauccgcaaugcuaucccgcgaaaaaguggcucuuuaucaucauugucauccugcuuggauacgccggccugaugcuccugaccaacgugcugaaggcuauugggguuuggggcuccugggugaucgccccugucaaacucauguucgcuauuaucaagaaacugaugcgcagcgugucuugucuuaugggaaagcugauggauagaggccggcagguuauccaugaagagauuggggaaaauagagagggaaaccaggacgaugugcgcaucgagauggcccggcccagacgcguccggcacuggauguauuccccugugauucucacaauccuggccgugggccuugcugaagggugcgacgagaugguucaugcggauagcaaacuggucucuuguaagcagggaagcggcaauaugaaggaaugcgugacgaccgggagagcccuccugcccgcugugaacccgggccaagaggccugucugcacuuuacagccccuggaucccccgacagcaaaugccucaagauuaaagucaagaaaaucaaucugaaguguaagaaaucuuccagcuacuucgugccugaugcucgcucccggugcaccucuguuagacgcugucggugggccggcgacugccagagcgggugccccucccauuuuacaucuaacagcuucuccgacgauugggcgggaaagauggacagagcuggccuuggguuuucuggauguagcgauggcugcgggggcgccgccuguggaugcuucaaugcugccccuuccuguaucuuuuggcgcaaauggguggagaacccccacggcauuaucuggaaggucagcccgugcgcugccugggugccuucugcgguuauugaacugaccaugcccuccggggaggugcggacguuccaccccaugagcggaaucccuacacaggucuucaaaggcgugucuguuaccuaucucggguccgacauggaagugagcggacugaccgaucugugugagauugaggaacuuaagucuaaaaagcucgcccuggcuccgugcaaccaggccggcaugggcgucguggggaaggugggagagauccaauguuccagcgaagaguccgcuagaacaauuaaaaaggacggcugcaucuggaaugccgaucuggucgggaucgaacuccggguugacgaugcgguguguuacagcaaaauuaccucuguggaggccgucgcuaacuauagcgccauccccacaacgauuggaggccugcgcuuugaaagaucccaugacucucaggggaagaucagcggauccccucuugauauuaccgcuauccggggcucuuucagcgugaauuacagaggccugcgccucucccugucugagaucacagcuaccugcacaggggagguuaccaacgugagcggaugcuacuccuguaugacgggcgccaaagucagcauuaagcugcacucuaauaagaacuccaccgcccaugugcggugcaaaggggacgaaacagcguuuagcguucuugagggagugcacucuuauaccgucucccucagcuucgaucacgccgugguugacgaacagugucagcugaauugcggcgggcaugagucccaagugacacugaagggaaaccucaucuuucuggacguccccaaauucguggauggcucuuacaugcagaccuaucacagcuccgugccuacgggcgcuaauauucccagcccuacagacuggcuuaacgcccuguuugggaauggacucucuagauggauccugggcgucauugggguucugcuuggaggccucgcccuguucuuucugaucaugucccucuucaagcuggggaccaaacagguguuucgcagcagaacaaaacuugcuuga

SEQ ID NO: 14839 - RNA, 3222 nt, Artificial Sequence
  derived and/or modified CDS sequence (opt5) from SFTSV(SPL100A)__AB985313.1__GP
augaugaaggugaucugguucagcucccugauuugccucgucauccaguguucuggcgacaccgggcccauuaucugcgccggaccuauucacagcaacaaauccgcugauaucccgcaucugcuuggcuacucugagaagaucugucaaauugacagacugauccacguuagcuccuggcuccggaaucauucucaguuucagggguaugugggacagcgcggcgggagaagccaaguguccuacuaucccgccgaaaacagcuacucucggugguccggacugcuuagcccuugcgaugcggacuggcugggcaugcucgucgugaaaaaggcuaaaggcucugauaugauuguucccgggccuuccuauaagggaaagguguucuuugagcgccccacauucgacggcuacgucggguggggauguggcagcgggaaaucuagaacggaauccggagagcugugcagcuccgauucuggcaccagcuccggccugcucccuagcgaccgggugcuguggaucggggauguugccugucagccgaugacacccauuccugaagagaccuuucuugagcugaagucuuucucccagagcgaauuucccgacaucugcaaaauugauggaaucguguucaaucagugugagucugaaagccucccucaacccuuugacgucgccuggauggaugugggccacucccauaagaucauuaugcgcgagcacaaaacaaagugggugcaggagucuagcuccaaggacuucgucugcuauaaacaggggaccggaccguguagcgaaucugaggaaaagacaugcaaaaccuccggcagcugcagaggggacaugcaguuuuguaagguugcuggaugcgagcacggcgaagaggccucugaggcuaaaugucggugcucccuggugcauaagccuggcgaaguggucgugagcuacgggggaaugcgcguuagacccaaauguuacggcuucucccggaugauggccacgcuugaggugaacccucccgaacaacgcaucgggcagugcaccggaugucaccuggagugcgucaauggcggggugagacucauuacacugaccucugaacuuaagagcgcgacaguuugugccucccauuuuugcucuagcgcuaccuccggcaagaaaagcacggagauccaguuccacucuggaucccucgugggcaagacagccauucacgucaaaggggcucugcuugauggaaccgaguucacauuugaaggcagcuguauguuccccgacgggugcgaugccguggacugcaccuuuugucgggaguuccugaagaacccucaaugcuauccggcgaaaaaguggcucuuuaucaucauugucauccugcuuggauacgccggccugaugcuccugaccaaugugcugaaggcuauugccguuugggggucuugggugaucgcucccgucaaacucauguucgccauuaucaagaaacugaugcgcuccgugagcugucuuaugggcaagcugauggauagaggacggcagguuauccaugaagagauuggcgaaaacagagaggggaaucaggacgaugugcgcaucgagauggcccggccuagacgcguccggcacuggauguauucucccgugauucucacagugcuggcuguuggacuugcggaaggcugcgacgagaugguccaugccgauagcaaacugguguccuguaagcaggggagcggaaacaugaaggaaugcgugacgaccggcagagcucuccugccugccgucaaucccgggcaagaggccugucugcacuuuacagcuccgggcucuccugacuccaaaugccucaagaucaaagugaagaaaauuaaccugaaguguaagaaaagcuccucuuacuucguucccgaugcccgcagccggugcaccuccgugagacgcugucggugggcgggagacugccagucuggcugcccuagccauuuuacauccaauucuuucagcgacgauugggcugggaagauggacagagccggacuuggcuuuuccggguguagcgauggaugcggcggggccgcuuguggcugcuucaacgccgcucccucuuguaucuuuuggcgcaaaugggucgagaauccucacggaauuaucuggaaggugucccccugcgccgcguggguuccgagcgccgugaucgaacugaccaugccuucuggcgagguccggacguuccaccccauguccgggauucccacacagguguucaaaggaguuagcgugaccuaucucggcucugacauggaagucuccgggcugaccgaucugugugagaucgaggaacuuaagagcaaaaagcucgcucuggccccuugcaaccaggcuggaaugggcguggugggcaaggucggggagauucaauguuccagcgaagagucugccagaacaaucaaaaaggacggaugcauuuggaacgcggaucugguuggcaucgaacuccggguggacgaugccguguguuacagcaaaaucaccuccgucgaggcuguggccaauuauucugcuauuccgacaacgaucgggggacugcgcuuugaaagaagccaugacucccagggcaagauuucugggagcccccuugauaucaccgccauucggggauccuucucuguuaacuacagaggccugcgccucagccuguccgagaucacagcuaccugcacaggcgaggugaccaaugucagcgggugcuacucuuguaugacgggagccaaaguguccaucaagcugcacagcaacaaaaauucuaccgcgcauguucggugcaagggcgacgaaacagccuuuuccgugcuugaggggguccacagcuauaccgugucccucucuuucgaucacgcuguuguggacgaacagugucagcugaacugcggaggccaugagagccaagucacacugaaggggaaucucauuuuucuggacgugccuaaauucguggauggauccuacaugcagaccuaucacagcucuguccccacgggcgccaacaucccuucccccacagacuggcuuaaugcccuguuuggcaacgggcucagcagauggauucugggaguuaucggcgugcugcuugggggacucgcucuguucuuucugauuaugucucucuucaagcugggcaccaaacagguguuucgcagcagaacaaagcuggccuga

SEQ ID NO: 14840 - RNA, 3222 nt, Artificial Sequence
  derived and/or modified CDS sequence (opt5) from SFTSV(SPL106A)__AB985316.1__GP
augaugaaggugaucugguucagcucccugauuugccucgucauccaguguucuggcgacaccgggcccauuaucugcgccggaccuauucacagcaacaaauccgcuaauaucccgcaucugcuuggcuacucugagaagaucugucaaauugauagacugauccacguuagcuccuggcuccggaaccauucucaguuucagggguaugugggacagcgcggcgggagaagccaaguguccuacuuccccgccgaaaauagcuauucucggugguccggacugcuuagcccuugcgacgcggauuggcugggcaugcucgucgugaaaaaggcuaaaggcucugacaugauuguucccgggccuuccuacaagggaaagguguuuuucgagcgccccacauuugauggcuaugucggguggggauguggcagcgggaaaucuagaacggaauccggagagcugugcagcuccgacucuggcaccagcuccggccugcucccuagcgaucgggugcuguggaucggggacguugccugucagccgaugacacccauuccugaagagaccuuccuugagcugaagucuuuuucccagagcgaguuccccgauaucugcaaaauugacggaaucguguuuaaccagugugaaucugaaagccucccucaacccuucgaugucgccuggauggacgugggccacucccauaagaucauuaugcgcgagcacaaaacaaagugggugcaggagucuagcuccaaggauuuugucugcuacaaagaagggaccggaccguguagcgagucugaagagaagacaugcaaaaccuccggcagcugcagaggggacaugcaguucuguaagguugcuggaugcgaacacggcgaggaggccucugaagcuaaaugucggugcucccuggugcauaagccuggcgagguggucgugagcuaugggggaaugcgcguuagacccaaauguuacggcuuuucccggaugauggccacgcuugaagugaauccucccgagcagcgcaucgggcaaugcaccggaugucaccuggaaugcauuaacggcggggucagacucaucacacugaccucugagcugaaguccgcgacagugugugccucccauuucugcucuagcgcuaccuccggcaagaaaagcacggagauucaguuccacucuggaucccucguuggcaagacagccauccacgugaaaggggcucuggucgacggaaccgaauuuacauucgagggcagcuguauguuucccgaugggugcgacgccguggauugcaccuucugucgggaauuucuuaagaauccucagugcuacccggcgaaaaaguggcuguucaucauuaucgucauucuccugggauaugccggccuuaugcugcucaccaacgugcugaaggcuaucgggguuuggggcucuugggugauugcccccgucaaacugauguuugcuauccucaagaaacugaugcgcuccgugagcugucuuaugggaaagcugauggacagaggccggcaaguuauccaugaggaaauuggggagaauagagagggaaaccaggaugacgugcgcaucgaaauggcccggccuagacgcguccggcacuggauguacucucccgugauucucacaauccuggccauuggccuugcugaggggugcgaugaagugguucaugcggacagcaaacuggucuccuguaagcagggaagcggcaauaugaaggagugcgugacgaccgggagagcccuccugccugcugugaaccccggccaggaggccugucugcacuucacagccccgggaucuccugauuccaaaugccucaagaucaaagucaagcgcauuaaucugaaauguaaaaagagcuccucuuauuuugugcccgacgcucggagcagaugcaccuccguucgccgguguagaugggccggcgauugccaaucugggugcccuagccauuucacauccaacucuuuuagcgacgacugggcgggaaagauggaucgcgcuggccuuggguucuccggauguagcgacggcugcgggggcgccgccuguggaugcuuuaaugcugcccccucuuguaucuucuggcggaaguggguggaaaacccucacggcaucauuuggaaagucucccccugcgcugccugggugccgagcgcgguuaucgagcugaccaugccuucuggggaagugagaacguuccaccccauguccggcauucccacacaggucuuuaagggagugagcguuaccuaccucgggucugauauggagguguccggacugaccgaccugugugaaaucgaggagcuuaaaagcaagaaacucgcccuggcuccuugcaaccaggccggcaugggcgucguggggaaggugggagaaauucaguguuccagcgaggaaucugcucggacaaucaagaaagauggcugcaucuggaaugccgaccuggucgggauugagcuccgcguugaugacgcgguguguuauagcaagaucaccuccguggaagccgucgcuaacuacucugccauuccgacaacgaucggaggccugagauucgagcggagccaugauucccaagggaaaauuucuggaagcccccuugacaucaccgcuaucagaggcuccuuuucugugaauuaucgcggccugcggcucagccuguccgagauuacagcuaccugcacaggggaaguuaccaacgugagcggaugcuacucuuguaugaucggcgccaaggucuccauuaaacugcacagcucuaagaauagcacggcccaugugagaugcaagggggaugagaccgcguucagcguucuugaaggagugcacuccuacacagucucucucagcuuugaccacgccgugguugaugagcagugucagcugaacugcggcgggcaugaaucccaggugacccugaaaggaaaucucaucuuccuggacgucccuaaguuuguggacggcagcuauaugcaaacauaccacucuuccgugcccaccggcgcuaacauuccuagccccacggauuggcuuaaugcccuguucgggaacggacucucucgcuggauccugggcgucaucgggguucugcuuggaggccucgcccuguuuagccugauuaugucccucuucaaacuggggacaaaacaggugcuuagaucucggaccaagcuggcuuga

SEQ ID NO: 14841 - RNA, 3222 nt, Artificial Sequence
  derived and/or modified CDS sequence (opt5) from SFTSV(SPL117A)__AB985321.1__GP
augaugaaggugaucugguucagcucccugauuugccucgucauccaguguucuggcgacaccgggcccauuaucugcgccggaccuauucacagcaacaaauccgcuaauaucccgcaucugcuuggcuacucugagaagaucugucaaauugauagacugauccacguuagcuccuggcuccggaaccauucucaguuucagggguaugugggacagcgcggcgggagaagccaaguguccuacuuccccgccgaaaauagcuauucucggugguccggacugcuuagcccuugcgacgcggauuggcugggcaugcucgucgugaaaaaggcuaaaggcucugacaugauuguucccgggccuuccuaccgcggaaagguguuuuucgagagacccacauuugauggcuaugucggguggggauguggcagcgggaagucucggacggaauccggagagcugugcagcuccgacucuggcaccagcuccggccugcucccuagcgaucgcgugcuguggaucggggacguugccugucagccgaugacacccauuccugaagagaccuuccuugagcugaaaucuuuuucccagagcgaguuccccgauaucugcaagauugacggaaucguguuuaaccagugugaaucugaaagccucccucaacccuucgaugucgccuggauggacgugggccacucccauaaaaucauuaugagagagcacaagacaaaaugggugcaggagucuagcuccaaggauuuugucugcuacaaggaagggaccggaccguguagcgagucugaagagaaaacaugcaagaccuccggcagcugccgcggggacaugcaguucuguaaaguugcuggaugcgaacacggcgaggaggccucugaagcuaagugucggugcucccuggugcauaaaccuggcgagguggucgugagcuaugggggaaugagaguucggcccaaguguuacggcuuuucccgcaugauggccacgcuugaagugaauccucccgagcagagaaucgggcaaugcaccggaugucaccuggaaugcauuaacggcgggguccggcucaucacacugaccucugagcugaaaagcgcgacagugugugccucccauuucugcucuagcgcuaccuccggcaaaaagagcacggagauucaguuccacucuggaucccucguuggcaagacagccauccacgugaagggggcucuggucgacggaaccgaauuuacauucgagggcagcuguauguuucccgaugggugcgacgccguggauugcaccuucugucgcgaauuucuuaaaaauccucagugcuacccggcgaagaaauggcuguucaucauuaucgucauucuccugggauaugccggccuuaugcugcucaccaacgugcugaaggcuaucgggguuuggggcucuugggugauugcccccgucaagcugauguuugcuaucaucaaaaagcucaugagauccgugagcugucugaugggaaaacuuauggaccggggcagacaaguuauucaugaggaaaucggggagaaucgcgagggaaaccaggaugacgugcggauugaaauggccagaccucgccgggucagacacuggauguacucucccgugauccugacaauucucgccaucggccuggcugaggggugcgaugaaauggugcaugcggacagcaaacuuguuuccuguaagcagggaagcggcaauaugaaggagugcgucacgaccgggcgcgcccugcucccugcugugaaccccggccaggaggccugucugcacuucacagccccgggaucuccugauuccaagugccugaaaauuaaggugaaacggaucaaucucaaguguaaaaagagcuccucuuauuuuguccccgacgcuagaagccgcugcaccuccgugcggagaugucgcugggccggcgauugccaaucugggugcccuagccauuucacauccaacucuuuuagcgacgacugggcgggaaagauggaucgggcuggccugggguucuccggauguagcgacggcugcgggggcgccgccuguggaugcuuuaaugcugcccccucuuguaucuucuggagaaaauggguugaaaacccucacggcauuaucuggaaggugucccccugcgcugccugggucccgagcgcggugauugagcuuaccaugccuucuggggaaguucggacguuccaccccauguccggaauccccacacagguguuuaaaggcgucagcgugaccuaccuggggucugauauggagguuuccggacucaccgaccugugugaaauugaggagcuuaagagcaaaaagcuggcccucgcuccuugcaaccaggccggcaugggcguggucgggaaagugggagaaauccaguguuccagcgaggaaucugcucgcacaaucaagaaggauggcugcauuuggaaugccgaccugguggggaucgagcugagagucgaugacgcgguuuguuauagcaaaauuaccuccguggaagccguggcuaacuacucugccaucccgacaacgauuggaggccuccgguucgagagaagccaugauucccaagggaagaucucuggaagcccccuggacaucaccgcuauucgcggcuccuuuucugucaauuaucggggccuuagacugagccucuccgagaucacagcuaccugcacaggggaagugaccaacguuagcggaugcuacucuuguaugacgggcgccaaaguguccauuaagcugcacagcucuaaaaauuccaccgcccauguccgcugcaagggggaugagacagcguucagcgugcuggaaggaguucacuccuacaccgugucucuuagcuuugaccacgccgucguggaugagcagugucagcucaacugcggcgggcaugaaucccagguuacacugaagggaaaucugaucuuccucgacgugccuaaauuugucgacggcagcuauaugcaaaccuaccacucuuccgugcccacgggcgcuaacauuccuagccccacagauuggcugaaugcccuuuucgggaacggacugucuagauggauccucggcgugaucgggguccugcugggaggccuugcccucuuuuuccugauuaugagccuguuuaagcucgggaccaaacagguuuuccggucccgcacaaagcuggcuuga

SEQ ID NO: 14842 - RNA, 3222 nt, Artificial Sequence
  derived and/or modified CDS sequence (opt5) from SFTSV(SPL120A)__AB985322.1__GP
augaugaaggugaucugguucagcucccugauuugccucgucauccaguguucuggcgacaccgggcccauuaucugcgccggaccuauucacagcaacaaauccgcuaauaucccgcaucugcuuggcuacucugagaagaucugucagauugauagacugauccacguuagcuccuggcuccggaaccauucucaguuucagggguaugugggacagcgcggcgggagaagccaaguguccuacuuccccgccgaaaauagcuauucucggugguccggacugcuuagcccuugcgacgcggauuggcugggcaugcucgucgugaaaaaggcuaaaggcucugacaugauuguucccgggccuuccuacaagggaaagguguuuuucgagcgccccacauuugauggcuaugucggguggggauguggcagcgggaaaucuagaacggaauccggagagcugugcagcuccgacucuggcaccagcuccggccugcucccuagcgaucgggugcuguggaucggggacguugccugucagccgaugacacccauuccugaagagaccuuccuugagcugaagucuuuuucccagagcgaguuccccgauaucugcaaaauugacggaaucguguuuaaccagugugaaucugaaagccucccucaacccuucgaugucgccuggauggacgugggccacucccauaagaucauuaugcgcgagcacaaaacaaagugggugcaggagucuagcuccaaggauuuugucugcuacaaagaagggaccggaccguguagcgagucugaagagaagacaugcaaaaccuccggcagcugcagaggggacaugcaguucuguaagguugcuggaugcgaacacggcgaggaggccucugaagcuaaaugucggugcucccuggugcauaagccuggcgagguggucgugagcuaugggggaaugcgcguuagacccaaauguuacggcuuuucccggaugauggccacgcuugaagugaauccucccgagcagcgcaucgggcaaugcaccggaugucaccuggaaugcauuaacggcggggucagacucaucacacugaccucugagcugaaguccgcgacagugugugccucccauuucugcucuagcgcuaccuccggcaagaaaagcacggagauucaguuccacucuggaucccucguuggcaagacagccauccacgugaaaggggcucuggucgacggaaccgaauuuacauucgagggcagcuguauguuucccgaugggugcgacgccguggauugcaccuucugucgggaauuucuuaagaauccucagugcuacccggcgaaaaaguggcuguucaucauuaucgucauucuccugggauaugccggccuuaugcugcucaccaacgugcugaaggcuaucgggguuuggggcucuugggugauugcccccgucaaacugauguuugcuauccucaagaaacugaugcgcuccgugagcugucuuaugggaaagcugauggacagaggccggcaaguuauccaugaggaaauuggggagaauagagagggaaaccaggaugacgugcgcaucgaaauggcccggccuagacgcguccggcacuggauguacucucccgugauucucacaauccuggccauuggccuugcugaggggugcgaugaagugguucaugcggacagcaaacuggucuccuguaagcagggaagcggcaauaugaaggagugcgugacgaccgggagagcccuccugccugcugugaaccccggccaggaggccugucugcacuucacagccccgggaucuccugauuccaaaugccucaagaucaaagucaagcgcauuaaucugaaauguaaaaagagcuccucuuauuuugugcccgacgcucggagcagaugcaccuccguucgccgguguagaugggccggcgauugccaaucugggugcccuagccauuucacauccaacucuuuuagcgacgacugggcgggaaagauggaucgcgcuggccuuggguucuccggauguagcgacggcugcgggggcgccgccuguggaugcuuuaaugcugcccccucuuguaucuucuggcggaaguggguggaaaacccucacggcaucauuuggaaagucucccccugcgcugccugggugccgagcgcgguuaucgagcugaccaugccuucuggggaagugagaacguuccaccccauguccggcauucccacacaggucuuuaagggagugagcguuaccuaccucgggucugauauggagguguccggacugaccgaccugugugaaaucgaggagcuuaaaagcaagaaacucgcccuggcuccuugcaaccaggccggcaugggcgucguggggaaggugggagaaauucaguguuccagcgaggaaucugcucggacaaucaagaaagauggcugcaucuggaaugccgaccuggucgggauugagcuccgcguugaugacgcgguguguuauagcaagaucaccuccguggaagccgucgcuaacuacucugccauuccgacaacgaucggaggccugagauucgagcggagccaugauucccaagggaaaauuucuggaagcccccuugacaucaccgcuaucagaggcuccuuuucugugaauuaucgcggccugcggcucagccuguccgagauuacagcuaccugcacaggggaaguuaccaacgugagcggaugcuacucuuguaugacgggcgccaaggucuccaucaaacugcacagcucuaagaauagcaccgcccaugugagaugcaagggggaugagacagcguucagcguucuugaaggagugcacuccuacaccgucucucucagcuuugaccacgccgugguugaugagcagugucagcugaacugcggcgggcaugaaucccaggugacacugaaaggaaaucucauuuuccuggacgucccuaaguuuguggacggcagcuauaugcaaaccuaccacucuuccgugcccacgggcgcuaacaucccuagccccacagauuggcuuaaugcccuguucgggaacggacucucucgcuggauucugggcgucaucgggguucugcuuggaggccucgcccuguuuagccugaucaugucccucuucaaacuggggaccaagcaaguguuuagaucucggacaaaacuugcuuga

SEQ ID NO: 14843 - RNA, 3222 nt, Artificial Sequence
  derived and/or modified CDS sequence (opt5) from SFTSV(SPL121A)__AB985323.1__GP
augaugaaggugaucugguucagcucccugauuugccucgucauccaguguucuggcgacaccgggcccauuaucugcgccggaccuauucacagcaacaaauccgcuaauaucccgcaucugcuuggcuacucugagaagaucugucaaauugauagacugauccacguuagcuccuggcuccggaaccauucucaguuucagggguaugugggacagcgcggcgggagaagccaaguguccuacuuccccgccgaaaauagcuauucucggugguccggacugcuuagcccuugcgacgcggauuggcugggcaugcucgucgugaaaaaggcuaaaggcucugacaugauuguucccgggccuuccuacaagggaaagguguuuuucgagcgccccacauuugauggcuaugucggguggggauguggcagcgggaaaucuagaacggaauccggagagcugugcagcuccgacucuggcaccagcuccggccugcucccuagcgaucgggugcuguggaucggggacguugccugucagccgaugacacccauuccugaagagaccuuccuugagcugaagucuuuuucccagagcgaguuccccgauaucugcaaaauugacggaaucguguuuaaccagugugaaucugaaagccucccucaacccuucgaugucgccuggauggacgugggccacucccauaagaucauuaugcgcgagcacaaaacaaagugggugcaggagucuagcccgaaggauuuugucugcuacaaagaagggaccggaccuuguuccgagagcgaagagaagacaugcaaaaccucuggcuccugcagaggggacaugcaguucuguaagguugcuggaugcgaacacggcgaggaggccagcgaagcuaaaugucggugcucucuggugcauaagcccggcgagguggucguguccuaugggggaaugcgcguuagaccuaaauguuacggcuuuagccggaugauggccacgcuugaagugaauagccccgagcagcgcaucgggcaaugcaccggaugucaccuggaaugcauuaacggcggggucagacucaucacacugaccucugagcuuaagagcgcgacagugugugccucccauuucugcucuagcgcuaccuccggcaagaaaagcacggagauucaguuccacucuggaucccucguuggcaagacagccauccacgugaaaggggcucuggucgacggaaccgaauuuacauucgagggcagcuguauguuucccgaugggugcgacgccguggauugcaccuucugucgggaauuucuuaagaauccucagugcuacccggcgaaaaaguggcuguucaucauuaucgucauucuccugggauaugccggccuuaugcugcucaccaacgugcugaaggcuaucgggguuuggggcucuugggugauugcccccgucaaacugauguuugcuaucaucaagaaacucaugcgcuccgugagcugucugaugggaaagcugauggacagaggccggcaaguuauucaugaggaaaucggggagaauagagagggaaaccaggaugacgugcgcauugaaauggcccggccuagacgcguccggcacuggauguacucucccgugauccugacaauucucgccaucggccuggcugaggggugcgaugaaauggugcaugcggacagcaaacuuguuuccuguaagcagggaagcggcaauaugaaggagugcgucacgaccgggagagcccugcucccugcugugaaccccggccaggaggccugucugcacuucacagccccgggaucuccugauuccaaaugccugaaggugaaagucaagcgcauuaaucucaaauguaagaaguccuccucuuauuuugugcccgacgcucggagcagaugcaccuccguucgccgguguagaugggccggcgauugccaaucugggugcccuagccauuucacauccaacucuuuuagcgacgacugggcgggaaaaauggaucgcgcuggccugggguucuccggauguagcgacggcugcgggggcgccgccuguggaugcuuuaaugcugcccccucuuguaucuucuggcggaaguggguggaaaacccucacggcaucauuuggaaagucucccccugcgcugccugggugccgagcgcgguuaucgagcuuaccaugccuucuggggaagugagaacguuccaccccauguccggcauucccacacaggucuuuaagggagugagcguuaccuaccuggggucugauauggagguguccggacucaccgaccugugugaaauggaggagcugaaaagcaagaaacuugcccucgcuccuugcaaccaggccggcaugggcgucguggggaaggugggagaaauccaguguuccagcgaggaaucugcucggacaauuaagaaagauggcugcaucuggaaugccgaccuggucgggaucgagcugcgcguugaugacgcgguguguuauagcaagauuaccuccguggaagccgucgcuaacuacucugccaucccgacaacgauuggaggccucagauucgagcggagccaugauucccaagggaaaaucucuggaagcccccuggacauuaccgcuaucagaggcuccuuuucugugaauuaucgcggccuucggcugagccucuccgagaucacagcuaccugcacaggggaaguuaccaacgugagcggaugcuacucuuguaugacgggcgccagagucuccauuaagcugcacagcucuaaaaauuccaccgcccaugugcgcugcaagggggaugagacagcguucagcguucuggaaggagugcacuccuacaccgucucucuuagcuuugaccacgccgugguugaugagcagugucagcucaacugcggcgggcaugaaucccaggugacacugaagggaaaucugaucuuccucgacgucccuaaauuuguggacggcagcuauaugcaaaccuaccacucuuccgugcccacgggcgcuaacauuccuagccccacagauuggcugaaugcccuuuucgggaacggacugucuagauggauccucggcgucauugggguucugcugggaggccuugcccucuuuuuccugaucaugagccuguuuaagcucgggaccaaacagguguuccggucccgcacaaagcuggcuuga

SEQ ID NO: 14844 - RNA, 3222 nt, Artificial Sequence
  derived and/or modified CDS sequence (opt5) from SFTSV(SPL124A)__AB985324.1__GP
augaugaaggugaucugguucagcucccugauuugccucgucauccaguguucuggcgacaccgggcccauuaucugcgccggaccuauucacagcaacaaauccgcuaauaucccgcaucugcuuggcuacucugagaagaucugucaaauugauagacugauccacguuagcuccuggcuccggaaccauucucaguuucagggguaugugggacagcgcggcgggagaagccaaguguccuacuuccccgccgaaaauagcuauucucggugguccggacugcuuagcccuugcgacgcggauuggcugggcaugcucgucgugaaaaaggcuaaaggcucugacaugauuguucccgggccuuccuacaagggaaagguguuuuucgagcgccccacauuugauggcuaugucggguggggauguggcagcgggaaaucuagaacggaauccggagagcugugcagcuccgacucuggcaccagcuccggccugcucccuagcgaucgggugcuguggaucggggacguugccugucagccgaugacacccauuccugaagagaccuuccuugagcugaagucuuuuucccagagcgaguuccccgauaucugcaaaauugacggaaucguguuuaaccagugugaaucugaaagccucccucaacccuucgaugucgccuggauggacgugggccacucccauaagaucauuaugcgcgagcacaaaacaaagugggugcaggagucuagcuccaaggauuuugucugcuacaaagaagggaccggaccguguagcgagucugaagagaagacaugcaaaaccuccggcagcugcagaggggacaugcaguucuguaagguugcuggaugcgaacacggcgaggaggccucugaagcuaaaugucggugcucccuggugcauaagccuggcgagguggucgugagcuaugggggaaugcgcguuagacccaaauguuacggcuuuucccggaugauggccacgcuugaagucaauucuccugagcagcgcaucgggcaaugcaccggaugucaccuggaaugcauuaacggcggggugagacucaucacacugaccagcgagcugaaguccgcgacagugugugccucucauuucugcagcuccgcuaccagcggcaagaaaucuacggagauucaguuccacuccggaagccucguuggcaagacagccauccacgugaaaggggcucuggucgacggaaccgaauuuacauucgagggcucuuguauguuucccgaugggugcgacgccguggauugcaccuucugucgggaauuucuuaagaauccccagugcuacccugcgaaaaaguggcuguucaucauuaucgucauucuccugggauaugccggccuuaugcugcucaccaacgugcugaaggcuaucgggguuuggggcuccugggugauugccccggucaaacugauguuugcuaucaucaagaaacucaugcgcagcgugucuugucugaugggaaagcugauggacagaggccggcaaguuauucaugaggaaaucggggagaauagagagggaaaccaggaugacgugcgcauugaaauggcccggcccagacgcguccggcacuggauguacagcccugugauccuuacaauucucgccaucggccuggcugaggggugcgaugaaauggugcaugcggacuccaaacuuguuagcuguaagcagggaucuggcaauaugaaggagugcgucacgaccgggagagcccugcuccccgcugugaacccuggccaggaggccugucugcacuucacagcccccggauccccggauagcaaaugccugaagauucgcgugaaacggaucaaucucaaguguaaaaaguccucuagcuauuuugucccugacgcuagaucccgcugcaccucugugcggagaugucgcugggccggcgauugccaaagcgggugccccucccauuucacaucuaacagcuuuuccgacgacugggcgggaaagauggaucgggcuggccugggguucagcggauguucugacggcugcgggggcgccgccuguggaugcuuuaaugcugccccuuccuguaucuucuggagaaaauggguugaaaacccccacggcauuaucuggaaggugagcccuugcgcugccuggguccccucugcggugauugagcuuaccaugccguccggggaaguucggacguuccacccuaugagcggaauccccacacagguguuuaaaggcgucucugugaccuaccugggguccgauauggagguuagcggacucaccgaccugugugaaauugaggagcugaaguccaaaaagcucgcccuugcucccugcaaccaggccggcaugggcguggucgggaaagugggagaaauccaguguagcucugaggaaagcgcucgcacaaucaagaaggauggcugcauuuggaaugccgaccugguggggaucgagcugagagucgaugacgcgguuuguuauuccaaaauuaccucuguggaagccguggcuaacuacagcgccaucccuacaacgauuggaggccuccgguucgagagaucccaugauucucaagggaagaucagcggauccccgcuggacaucaccgcuauucgcggcucuuuuagcgucaauuaucggggccuuagacugucccucagcgagaucacagcuaccugcacaggggaagugaccaacguuucuggaugcuacuccuguaugacgggcgcccgcgugagcauuaaacugcacucuuccaagaauagcaccgcccaugucagaugcaaaggggaugagacagcguucuccgugcuggaaggaguucacucuuacaccgugagccuuuccuuugaccacgccgucguggaugagcagugucagcucaacugcggcgggcaugaaagccagguuacacugaagggaaaucugaucuuccucgacgugcccaaguuugucgacggcucuuauaugcaaaccuaccacuccagcgugccuacgggcgcuaacauucccucuccuacagauuggcugaaugcccuuuucgggaacggacugagccgguggauccucggcgugaucgggguccugcugggaggccuugcccucuuuuuccugauuaucucccuguuuaaacucgggaccaagcagguuuuccgcucuagaacaaaacuggcuuga

SEQ ID NO: 14845 - RNA, 3222 nt, Artificial Sequence
  derived and/or modified CDS sequence (opt5) from SFTSV(SPL128A)__AB985325.1__GP
augaugaaggugaucugguucagcucccugauuugccucgucauccaguguucuggcgacaccgggcccauuaucugcgccggaccuauucacagcaacaaauccgcuaauaucccgcaucugcuuggcuacucugagaagaucugucaaauugauagacugauccacguuagcuccuggcuccggaaccauucucaguuucagggguaugugggacagcgcggcgggagaagccaaguguccuacuuccccgccgaaaauagcuauucucggugguccggacugcuuagcccuugcgacgcggauuggcugggcaugcucgucgugaaaaaggcuaaaggcucugacaugauuguucccgggccuuccuacaagggaaagguguuuuucgagcgccccacauuugauggcuaugucggguggggauguggcagcgggaaaucuagaacggaauccggagagcugugcagcuccgacucuggcaccagcuccggccugcucccuagcgaucgggugcuguggaucggggacguugccugucagccgaugacacccauuccugaagagaccuuccuugagcugaagucuuuuucccagagcgaguuccccgauaucugcaaaauugacggaaucguguuuaaccagugugaaucugaaagccucccucaacccuucgaugucgccuggauggacgugggccacucccauaagaucauuaugcgcgagcacaaaacaaagugggugcaggagucuagcuccaaggauuuugucugcuacaaagaagggaccggaccguguagcgagucugaagagaagacaugcaaaaccuccggcagcugcagaggggacaugcaguucuguaagguugcuggaugcgaacacggcgaggaggccucugaagcuaaaugucggugcucccuggugcauaagccuggcgagguggucgugagcuaugggggaaugcgcguuagacccaaauguuacggcuuuucccggaugauggccacgcuugaagucaauucuccugagcagcgcaucgggcaaugcaccggaugucaccuggaaugcauuaacggcggggugagacucaucacacugaccagcgagcugaaguccgcgacagugugugccucucauuucugcagcuccgcuaccagcggcaagaaaucuacggagauucaguuccacuccggaagccucguuggcaagacagccauccacgugaaaggggcucuggucgacggaaccgaauuuacauucgagggcucuuguauguuucccgaugggugcgacgccguggauugcaccuucugucgggaauuucuuaagaauccccagugcuacccugcgaaaaaguggcuguucaucauuaucgucauucuccugggauaugccggccuuaugcugcucaccaacgugcugaaggcuaucgggguuuggggcuccugggugauugccccggucaaacugauguuugcuaucaucaagaaacucaugcgcagcgugucuugucugaugggaaagcugauggacagaggccggcaaguuauucaugaggaaaucggggagaauagagagggaaaccaggaugacgugcgcauugaaauggcccggcccagacgcguccggcacuggauguacagcccugugauccuuacaauucucgccaucggccuggcugaggggugcgaugaaauggugcaugcggacuccaaacuuguuagcuguaagcagggaucuggcaauaugaaggagugcgucacgaccgggagagcccugcuccccgcugugaacccuggccaggaggccugucugcacuucacagcccccggauccccggauagcaaaugccugaagauucgcgugaaacggaucaaucucaaguguaaaaaguccucuagcuauuuugucccugacgcuagaucccgcugcaccucugugcggagaugucgcugggccggcgauugccaaagcgggugccccucccauuucacaucuaacagcuuuuccgacgacugggcgggaaagauggaucgggcuggccugggguucagcggauguucugacggcugcgggggcgccgccuguggaugcuuuaaugcugccccuuccuguaucuucuggagaaaauggguugaaaacccccacggcauuaucuggaaggugagcccuugcgcugccuggguccccucugcggugauugagcuuaccaugccguccggggaaguucggacguuccacccuaugagcggaauccccacacagguguuuaaaggcgucucugugaccuaccugggguccgauauggagguuagcggacucaccgaccugugugaaauugaggagcugaaguccaaaaagcucgcccuugcucccugcaaccaggccggcaugggcguggucgggaaagugggagaaauccaguguagcucugaggaaagcgcucgcacaaucaagaaggauggcugcauuuggaaugccgaccugguggggaucgagcugagagucgaugacgcgguuuguuauuccaaaauuaccucuguggaagccguggcuaacuacagcgccaucccuacaacgauuggaggccuccgguucgagagaucccaugauucucaagggaagaucagcggauccccgcuggacaucaccgcuauucgcggcucuuuuagcgucaauuaucggggccuuagacugucccucagcgagaucacagcuaccugcacaggggaagugaccaacguuucuggaugcuacuccuguaugacgggcgcccgcgugagcauuaaacugcacucuuccaagaauagcaccgcccaugucagaugcaaaggggaugagacagcguucuccgugcuggaaggaguucacucuuacaccgugagccuuuccuuugaccacgccgucguggaugagcagugucagcucaacugcggcgggcaugaaagccagguuacacugaagggaaaucugaucuuccucgacgugcccaaguuugucgacggcucuuauaugcaaaccuaccacuccagcgugccuacgggcgcuaacauucccucuccuacagauuggcugaaugcccuuuucgggaacggacugagccgguggauccucggcgccaucggggugcugcugggaggccuugcucucuuuuuccugauuaucucccuguuuaaacucgggaccaagcaggucuuccgcucuagaacaaaacuggccuga

SEQ ID NO: 14846 - RNA, 3222 nt, Artificial Sequence
  derived and/or modified CDS sequence (opt5) from SFTSV(SPL129A)__AB985326.1__GP
augaugaaggugaucugguucagcucccugauuugccucgucauccaguguucuggcgacaccgggcccauuaucugcgccggaccuauucacagcaacaaauccgcuaauaucccgcaucugcuuggcuacucugagaagaucugucaaauugauagacugauccacguuagcuccuggcuccggaaccauucucaguuucagggguaugugggacagcgcggcgggagaagccaaguguccuacuaucccgccgaaaauagcuacucucggugguccggacugcuuagcccuugcgacgcggauuggcugggcaugcucgucgugaaaaaggcuaaaggcucugacaugauuguucccgggccuuccuauaagggaaagguguucuuugagcgccccacauucgauggcuacgucggguggggauguggcagcgggaaaucuagaacggaauccggagagcugugcagcuccgacucuggcaccagcuccggccugcucccuagcgaucgggugcuguggaucggggacguugccugucagccgaugacacccauuccugaagagaccuuucuugagcugaagucuuucucccagagcgaauuucccgauaucugcaaaauugacggaaucguguucaaccagugugagucugaaagccucccucaacccuuugaugucgccuggauggacgugggccacucccauaagaucauuaugcgcgagcacaaaacaaagugggugcaggagucuagcuccaaggauuucgucugcuauaaagaagggaccggaccguguagcgagucugaagagaagacaugcaaaaccuccggcagcugcagaggggacaugcaguuuuguaagguugcuggaugcgaacacggcgaggaggccucugaagcuaaaugucggugcucccuggugcauaagccuggcgagguggucgugagcuacgggggaaugcgcguuagacccaaauguuacggcuucucccggaugauggccacgcuugaagugaauccucccgagcagcgcaucgggcaaugcaccggaugucaccuggaaugcauuucuggcggggucagacucaucacacugaccagcgagcugaaguccgcgacagugugugccucucauuuuugcagcuccgcuaccagcggcaagaaaucuacggagauucaguuccacuccggaagccucguuggcaaggccgcuauccacgugaaaggggcccuggucgacggaacagaguucaccuuugaaggcucuuguauguuccccgaugggugcgacgcgguggauugcacauuuugucgggaguuccuuaagaacccucagugcuauccggccaaaaaguggcuguuuaucauuaucgucauucuccugggauacgcuggccuuaugcugcucaccaaugugcugaaggccaucgggguuuggggcuccugggugauugcucccgucaaacugauguucgccaucaugaagaaacucaugcgcagcgugucuugucugaugggaaagcugauggacagaggccggcaaguuauccaugaagaaauuggggagaacagagagggaaaucgcgaugacgugcggaucgaaauggccagaccucgccgggucagacacuggauguauagccccgugauucugaccauccucgcuauuggccuggcggaggggugcgaugaaauggugcaugccgacuccaaacuuguuagcugucgccagggaucuggcaacaugaaggagugcgucacaacggggcgggcucugcucccugccgugaaucccggccaggaggccugucugcacuuuaccgcuccgggauccccugauagcaagugccugaaaaucaaggugaaaagaauuaaccucaaguguaaaaaguccucuagcuacuucguccccgacgcccgcucccggugcacaucugugagacgcugucggugggcgggcgauugccagagcgggugcccuucccauuuuaccucuaauagcuucuccgacgacugggcuggaaagauggauagagccggccugggguuuagcggauguucugacggcugcgggggcgccgcuuguggaugcuucaacgccgcucccuccuguaucuuuuggcggaaauggguugaaaauccucacggcaucauuuggaaggugagccccugcgccgcgugggucccgucugccgugaucgagcuuacaaugccuuccggggaaguucgcaccuuccaccccaugagcggcauucccacgcaaguguucaaaggagucucugugacauaucugggguccgauauggagguuagcggacucaccgaccugugugaaaucgaggagcugaaguccaaaaagcucgcucuugccccuugcaaccaggcuggcaugggcguggucgggaaagugggagaaauucaguguagcucugaggaaagcgccagaaccaucaagaaggauggcugcaucuggaacgcggaccugguggggauugagcugcgggucgaugacgccguuuguuacuccaaaaucacaucuguggaaaccguggcuaauuauagcgccauuccgacaacgaucggaggccucagauuugagcgcucccaugauucucaggggaagauuagcggaucuccccuggacaucaccgcuauccggggcuccuucagcgucaacuacagaggccuucgccugucccucagcgagauuacagcuaccugcacaggggaagugaccaauguuucuggaugcuacuccuguaugacgggcgccaaagugagcaucaagcugcacucuuccaaaaacagcaccgcccaugucagaugcaaggaggaugaaacagcguuuuccgugcuggaggggguucacucuuauaccgugagccuuuccuucgaccacgccgucguggaugaacaaugucagcucaauugcggaggccaugagagccacguuacacugaaggggaaccugauuuuucucgacgugccuaaauucgucgacggaucuuacaugcagaccuaucauuccagcgugcccacgggcgcuaauaucccuucucccacagauuggcugaacgcccuuuuuggcaaugggcugagccgguggauucucggagugaugggcguccugcuugggggacuugcccucuucuuucugaucaugucccuguucaagcucggcaccaaacagguuuuucgcucuagaacaaagcuggcuuga

SEQ ID NO: 14847 - RNA, 3222 nt, Artificial Sequence
  derived and/or modified CDS sequence (opt5) from SFTSV(YG1)__AB817987.1__GP
augaugaaggugaucugguucagcucccugauuugccucgucauccaguguucuggcgacaccgggcccauuaucugcgccggaccuauucacagcaacaaauccgcuaauaucccgcaucugcuuggcuacucugagaagaucugucaaauugauagacugauccacguuagcuccuggcuccggaaccauucucaguuucagggguaugugggacagcgcggcgggagaagccaaguguccuacuuccccgccgaaaauagcuauucucggugguccggacugcuuagcccuugcgacgcggauuggcugggcaugcucgucgugaaaaaggcuaaaggcucugacaugauuguucccgggccuuccuacaagggaaagguguuuuucgagcgccccacauuugauggcuaugucggguggggauguggcagcgggaaaucuagaacggaauccggagagcugugcagcuccgacucuggcaccagcuccggccugcucccuagcgaucgggugcuguggaucggggacguugccugucagccgaugacacccauuccugaagagaccuuccuugagcugaagucuuuuucccagagcgaguuccccgauaucugcaaaauugacggaaucguguuuaaccagugugaaucugaaagccucccucaacccuucgaugucgccuggauggacgugggccacucccauaagaucauuaugcgcgagcacaaaacaaagugggugcaggagucuagcuccaaggauuuugucugcuacaaagaagggaccggaccguguagcgagucugaagagaagacaugcaaaaccuccggcagcugcagaggggacaugcaguucuguaagguugcuggaugcgaacacggcgaggagacgucugaagccaaaugucggugcucccuggugcauaagccuggcgagguggucgugagcuaugggggaaugcgcguuagacccaaauguuacggcuuuucccggaugauggcuacccuugaagugaauccucccgagcagcgcaucgggcaaugcacaggaugucaccuggaaugcauuaacggcggggucagacucaucacccugacaucugagcuuaagagcgccaccgugugugcgucccauuucugcucuagcgccacguccggcaagaaaagcacagagauucaguuccacucuggaucccucguuggcaagaccgcuauccacgugaaaggggcccuggucgacggaacagaauuuaccuucgagggcagcuguauguuucccgaugggugcgacgcuguggauugcaccuucugucgggaauuucuuaagaauccucagugcuacccggccaaaaaguggcuguucaucauuaucgucauucuccugggauaugcgggccuuaugcugcucacaaacgugcugaaggccaucgggauuuggggcucuuggguuaucgcucccgugaaacugauguuugccaucauuaagaaacucaugcgcuccgucagcugucugaugggaaagcugauggacagaggccggcaagugauccaugaggaaauuggggagaauagagagggaaaccaggaagauguucgcaucgagauggcucggccuagacgcgugcggcacuggauguacucucccgucauucuggccauccucgccauuggccuggcugaagggugcgacgagauggugcaugcggauagcaaacuuguguccuguaagcagggaagcggcaauaugaaggagugcguuacgaccgggagagcccugcucccugcugucaaccccggccaggaagccugucugcacuucacagccccgggaucuccugacuccaaaugccugaagaucaaagugaagcgcaucaaucucaaauguaagaaguccuccucuuauuuugugcccgaugcucggagcagaugcaccuccguccgccgguguagaugggccggcgacugccaaucugggugcccuagccauuucacauccaacucuuuuagcgaugacugggcgggaaaaauggaccgcgcuggccugggguucuccggauguagcgauggcugcgggggcgccgccuguggaugcuuuaaugcugcccccucuuguauuuucuggcggaaguggguggagaacccucacggcaucauuuggaaaguuucccccugcgcugccugggugccgagcgcggucaucgaacuuaccaugccuucuggggaggugagaacguuccaccccauguccggcauucccacacagguuuuuaagggagugagcgucaccuaccuggggucugacauggaaguguccggacucaccgaucugugugagaucgaggaacugaaaagcaagaaacuugcccucgcuccuugcaaccaggccggcaugggcguuguggggaaggucggagagauccaguguuccagcgaagagucugcucggacaauuaagaaagacggcugcaucuggaaugccgaucugguggggauugaacugcgcguggacgaugcggucuguuauagcaagaucaccuccguugaggccguggcuaacuacucugccauuccgacaacgaucggaggccucagauucgagcggagccaugacucccaagggaaaaucucuggaagcccccuggauauuaccgcuaucagaggcuccuuuucugugaauuaucgcggccuucggcugagccucuccgaaauuacagcuaccugcacaggggaggucaccaacgugagcggaugcuacucuuguaugacgggcgccaagguuuccaucaaacugcacagcucuaagaauagcaccgcccaugugagaugcaagggggacgaaacagcguucagcguccuggagggagugcacuccuacaccguuucucuuagcuuugaucacgccguggucgacgaacagugucagcucaacugcggcgggcaugagucccaggugacacugaaaggaaaucugauuuuccucgauguuccuaaguuuguggacggcagcuauaugcaaaccuaccacucuuccguccccacgggcgcuaacaucccuagccccacagacuggcugaaugcccuuuucgggaacggacugucucgcuggauccucggcgugauuggggugcugcugggaggccuugcccucuuuuuccugaucaugagccuguuuaaacucgggaccaagcaggucuucagaucccggacaaaacuggcuuga

SEQ ID NO: 14848 - RNA, 3222 nt, Artificial Sequence
  derived and/or modified CDS sequence (opt5) from SFTSV(SDTA_1)__KX641913.1__GP
augaugaaggugaucugguucagcucccugauuugccucgucauccaguguucuggcgacagcgggcccauuaucugcgccggaccuauucacuccaacaaaucugcuggcaucccgcaucugcuuggguacagcgagaagaucugucaaauugauagacugauccacguuuccucuuggcuccggaaucauagccaguuucagggauaugugggccagcgcgggggaagaucccaagugagcuacuaucccgccgaaaacucuuacucccgguggagcggccugcuuucuccuugcgacgcggauuggcugggcaugcucgucgugaaaaaggcucgcgaguccgacaugauuguucccgggccuagcuauaaaggaaagguguucuuugaaagacccaccuucgauggcuacgucggguggggauguggcucugggaagucccggacagagagcggagaacugugcuccucugacagcggcacguccagcggccugcucccuucugaucgcgugcuguggaucggggacguugccugucagcuuaugaccccgauucccgaggagacauuucuggaacucaaauccuucagccagucugaguuuccugauaucugcaagauugacggaaucguguucaaucagugugaaggcgagagccugccccaaccuuuugaugucgccuggauggacguggggcacucccauaaaaucauuaugagagagcacaagaccaaaugggugcaggaaucuagcuccaaggauuucgucugcuauaaggagggaacaggccccuguagcgaaucugaggaaaaggcuugcaagaccuccgggagcugccggggagacaugcaguuuuguaaaguugccggcugcgagcacggcgaggaaacaucugaggcuaagugucgcugcucccuugugcauaaaccgggggaaguggucgugagcuacggaggcaugagaguucggccuaaguguuacggguucucccgcaugauggccacccuggaggugaaucccccugaacagagaaucggacaaugcacgggcugucaccucgagugcauuaacgggggcguccggcugaucacccugacaucugagcuccgcagcgcgaccgugugugccucccauuuuugcucuagcgcuuccagcggcaaaaagucuacagaaauucacuuccacuccggaagccugguugggaagaccgccauccaugugaaaggagcucuugucgacggcacggaguucacauuugaagggucuuguauguuccccgauggaugcgacgccguggauugcaccuuuuguagagaguuccugaagaacccccagugcuauccugcgaaaaaguggcucuuuaucauuaucgucauucugcuuggcuacgccgggcugaugcuccugacaaaugugcugaaagcuaucggcguuuggggauccugggugauugccccggucaagcucauguucgcuaucaucaagaaacugaugcggaccgugagcugucuuguuggcaagcugauggacagagggcgccaggugauucacgaagagaucggagagaacggcgaagggaaucaagaugacguccggauugagaucgccagaccccgccgggugagacauuggauguauucuccugugauucucaccauccuggccauuggacuugcugaaggcugcgaugagaugguucacgcggacagcaaacuggucuccugucgccaggggagcggcaacaugaaggagugcaucacaacgggacgggcccuccugcccgcugugaauccuggccaggaagccugucugcauuuuaccgcccccgggucuccggauuccaaaugccucaagaucaaggugaaaagaauuaaccugaaguguaaaaagagcuccucuuacuucgucccugacgcucgcagccggugcacauccgugagacgcugucggugggccggagauugccagucuggcugucccccucacuuuaccagcaauuccuucucugacgacugggcggggaaaauggauagagcuggacuuggcuuuagcgggugcuccgacggcugcggaggcgccgccugugggugcuucaacgcugcccccagcuguaucuuuuggcggaaguggguugagaauccucacggaauuaucuggaaggugucucccugcgcugccugggucccguccgcggugauugaacugacaaugccuagcggcgagguucgcaccuuccaucccaugucugggauccccacgcaaguguucaaaggagucuccgugacauaucucggcagcgauauggaaguuucuggccugaccgaccugugugagaucgaggaacuuaaguccaaaaagcucgcccuggcuccuugcaaccaggccgggaugggaguggucggcaaagugggggagauucaguguagcuccgaagagagcgcuagaaccaucaagaaagauggaugcauuuggaacgccgaccuggugggcaucgaacuccgggucgaugacgcgguuuguuacucuaagauuacaagcguggaggccguggcuaauuauuccgccaucccgaccacaaucgggggacugagauuugagcgcucucacgauagccagggcaagauuuccggcucuccccuugacaucacggcuauucgggggagcuucuccgucaacuacagaggacugcgccucucucugagcgaaaucaccgccacaugcaccggcgaggugacaaauguuuccgggugcuacagcuguaugaccggagccaaagugucuauuaagcugcauuccagcaaaaacucuacggcucacgucagaugcaagggcgaugaaaccgcguuuuccgugcuugaggggguucacagcuauaucgugucccucucuuucgaccaugccgucguggaugaacaaugucagcugaauugcggaggccacgagagccagguuacacugaaaggcaaccucaucuuucuggacgugccuaaguucgucgacggguccuacaugcagaccuaucauagcacagugcccaccggagcuaauauuccuucucccacggauuggcuuaacgcccuguuuggcaaugggcucucccgguggauccugggagugauuggcguccugcuugggggacucgcccuguucuuucugaucauguuccuccugaaacuuggcacaaaacaaguuuuucgcagcagaaccaagcuggcuuga

SEQ ID NO: 14849 - RNA, 3222 nt, Artificial Sequence
  derived and/or modified CDS sequence (opt5) from SFTSV(SDTA_2)__KX641914.1__GP
augaugaaggugaucugguucagcucccugauuugccucgucauccaguguucuggcgacagcgggcccauuaucugcgccggaccuauucacuccaacaaaucugcuggcaucccgcaucugcuuggguacagcgagaagaucugucaaauugauagacugauccacguuuccucuuggcuccggaaucauagccaguuucagggauaugugggccagcgcgggggaagaucccaagugagcuacuaucccgccgaaaacucuuacucccgguggagcggccugcuuucuccuugcgacgcggauuggcugggcaugcucgucgugaaaaaggcuaaagaguccgacaugauuguucccgggccuagcuauaagggaaagguguucuuugaacgccccaccuucgauggcuacgucggguggggauguggcucugggaaauccagaacagagagcggagaacugugcuccucugacagcggcacguccagcggccugcucccuucugaucgggugcuguggaucggggacguugccugucagccgaugacccccauuccugaggagacauuucuugaacugaaguccuucagccagucugaguuucccgauaucugcaaaauugacggaaucguguucaaucagugugaaggcgagagccucccucaacccuuugaugucgccuggauggacguggggcacucccauaagaucauuaugcgcgagcacaaaaccaagugggugcaggaaucuagcuccaaggauuucgucugcuauaaagagggaacaggcccguguagcgaaucugaggaaaaggcuugcaaaaccuccgggagcugcagaggagacaugcaguuuuguaagguugccggcugcgagcacggcgaggaagccucugaggccaaaugucggugcucccuggugcauaagccuggggaaguggucgugagcuacggaggcaugcgcguuagacccaaauguuacggguucucccggaugauggcgacacuugaggugaacccucccgaacacaugaucggacagugcaccggcugucaucuggagugcauuaaugggggcguccgccucaucacgcugaccucugagcugagaagcgccacagugugugcuucccacuuuugcucuagcgccuccagcggaaagaagucuaccgaaauucacuuccauuccggcagccucguugggaaaacagcuauccacgugaagggagcccuggucgacggcaccgaguucacguuugaagggucuuguauguuccccgauggaugcgacgcgguggauugcacauuuugucgggaguuccuuaaaaacccucaaugcuauccggccaagaaauggcuguuuaucauuaucgucauucuccugggcuacgcugggcuuaugcugcucaccaaugugcugaaggccaucggcguuuggggauccugggugauugcucccgucaagcugauguucgccaucaucaaaaagcucaugcgcacagugagcugucugguuggcaaacuuauggacagagggagacaggugauucaugaagagaucggagagaacggcgaagggaaucaggaugacgucagaauugagauggcccgcccucggagagugcgccacuggauguauucucccgugauccugaccauucucgcuaucggacuggcggaaggcugcgaugagaugguucaugccgacagcaagcuggucuccugucggcaagggagcggcaacaugaaagagugcauuaccacaggacgggcucugcucccugccgugaaucccggccaggaagccugucugcacuuuacggcuccggggucuccugauuccaagugccugaagaucaaagugaagcgcaucaaccucaaauguaagaaaagcuccucuuacuucguccccgacgcccggagcagaugcaccuccgugcgccgguguagaugggcgggagauugccagucuggcugcccuccccacuuuacaagcaauuccuucucugacgacugggcugggaagauggaucgcgccggacugggcuuuagcggguguuccgacggcugcggaggcgccgcuugugggugcuucaacgccgcuccuagcuguaucuuuuggcggaaguggguugagaauccccauggaauuauuuggaaagugucuccgugcgccgcgugggucccuuccgccgugaucgaacuuaccaugcccagcggcgagguuagaacauuccaccccaugucugggauuccuacccagguguucaagggagucuccgugacguaucugggcagcgauauggaaguuucuggccucacagaccugugugagaucgaggaacugaaauccaagaaacuugcucucgccccgugcaaccaagcugggaugggaguggucggcaaggugggggagauccaguguagcuccgaagagagcgcccggaccauuaaaaaggauggaugcaucuggaacgcggaccuggugggcauugaacugcgcgucgaugacgccguuuguuacucuaagaucaccagcguggaggcuguggccaauuauuccgcuauucccacaaccaucgggggacucagauuugagcggucucaugauagccagggcaaaaucuccggcucuccucuggacauuacagccaucagagggagcuucuccgucaacuaccgcggacuucggcugucucucagcgaaauuacggcuaccugcacaggcgaggugaccaauguuuccgggugcuacagcuguaugacaggagcuaaggugucuaucaaacugcacuccagcaagaacucuaccgcgcacgucagaugcaaaggcgaugaaacggccuuuuccgugcuggaggggguucauagcuauauugugucccuuucuuucgaccacgcugucguggaugaacagugucaacucaauugcggaggccaugagagccagguuacccugaagggcaaccugaucuuucucgacgugcccaaguucgucgacggguccuacaugcagacauaucacagcaccgugccuacaggagccaauauccccucuccuaccgauuggcugaacgcccuuuuuggcaaugggcugucccgcuggauucucggagugaucggcguccugcuugggggacuugcucucuucuuucugauuauguuccugcucaaacugggcacgaagcagguuuuuagaagccggacaaaacuugccuga

SEQ ID NO: 14850 - RNA, 3222 nt, Artificial Sequence
  derived and/or modified CDS sequence (opt5) from SFTSV(SDTA_3)__KX641915.1__GP
augaugaaggugaucugguucagcucccugauuugccucgucauccaguguucuggcgacagcgggcccauuaucugcgccggaccuauucacuccaacaaaucugcuggcaucccgcaucugcuuggguacagcgagaagaucugucaaauugauagacugauccacguuuccucuuggcuccggaaucauagccaguuucagggauaugugggccagcgcgggggaagaucccaagugagcuacuaucccgccgaaaacucuuacucccgguggagcggccugcuuucuccuugcgacgcggauuggcugggcaugcucgucgugaaaaaggcuaaagaguccgacaugauuguucccgggccuagcuauaagggaaagguguucuuugaacgccccaccuucgauggcuacgucggguggggauguggcucugggaaauccagaacagagagcggagaacugugcuccucugacagcggcacguccagcggccugcucccuucugaucgggugcuguggaucggggacguugccugucagccgaugacccccauuccugaggagacauuucuugaacugaaguccuucagccagucugaguuucccgauaucugcaaaauugacggaaucguguucaaucagugugaaggcgagagccucccucaacccuuugaugucgccuggauggacguggggcacucccauaagaucauuaugcgcgagcacaaaaccaagugggugcaggaaucuagcuccaaggauuucgucugcuauaaagagggaacaggcccguguagcgaaucugaggaaaaggcuugcaaaaccuccgggagcugcagaggagacaugcaguuuuguaagguugccggcugcgagcacggcgaggaagccucugaggccaaaugucggugcucccuggugcauaagccuggggaaguggucgugagcuacggaggcaugcgcguuagacccaaauguuacggguucucccggaugauggcgacacuugaggugaacccucccgaacagcgcaucggacaaugcaccggcugucaccuggagugcauuaaugggggcgucagacucaucacgcugaccucugagcugcggagcgccacagugugugcuucccauuuuugcucuagcgccuccagcggaaagaagucuaccgaaauucacuuccacuccggcagccucguugggaaaacagcuauccaugugaagggagcccuggucgacggcaccgaguucacguuugaagggucuuguauguuccccgauggaugcgacgcgguggauugcacauuuugucgcgaguuccuuaaaaacccucagugcuauccggccaagaaauggcuguuuaucauuaucgucauucuccugggcuacgcugggcuuaugcugcucaccaaugugcugaaggccaucggcguuuggggauccugggugauugcucccgucaagcugauguucgccaucaucaaaaagcucaugagaacagugagcugucugguuggcaaacuuauggaccgggggagacaggugauucacgaagagaucggagagaacggcgaagggaaucaagaugacguccgcauugagguggcccggccuagacgcgugcggcauuggauguauucucccguuauccugaccauucucgcuaucggacuggcggaaggcugcgaugagaugguccacgccgacagcaagcugguguccuguagacaggggagcggcaacaugaaagagugcauuaccacaggacgcgcucugcucccugccgugaaucccggccaggaagccugucugcauuuuacggcuccggggucuccugauuccaagugccugaagaucaaagucaagcggaucaaccucaaauguaagaaaagcuccucuuacuucgugcccgacgccagaagccgcugcaccuccguucggagaugucgcugggcgggagauugccagucuggcugcccuccccacuuuacaagcaauuccuucucugacgacugggcugggaagauggaucgggccggacugggcuuuagcggguguuccgacggcugcggaggcgccgcuugugggugcuucaacgccgcuccuagcuguaucuuuuggagaaaguggguggagaauccccacggaauuauuuggaaagucucuccgugcgccgcgugggugccuuccgccguuaucgaacuuaccaugcccagcggcgaggugcggacauuccaucccaugucugggauuccuacccaagucuucaagggaguguccguuacguaucugggcagcgauauggaagugucuggccucacagaccugugugagaucgaggaacugaaauccaagaaacuugcucucgccccgugcaaccaggcugggaugggagucgugggcaaggugggggagauccaguguagcuccgaagagagcgcccgcaccauuaaaaaggauggaugcaucuggaacgcggaccuggucggcauugaacugagaguugaugacgccguguguuacucuaagaucaccagcguggaggcugucgccaauuauuccgcuauucccacaaccaucgggggacuccgguuugagagaucucacgauagccagggcaaaaucuccggcucuccucuggacauuacagccauccgcgggagcuucuccgugaacuaccggggacuuagacugucucucagcgaaauuacggcuaccugcacaggcgagguuaccaauguguccgggugcuacagcuguaugacaggagcuaaggucucuaucaaacugcauuccagcaagaacucuaccgcgcacgugcgcugcaaaggcgaugaaacggccuuuuccguucuggagggggugcacagcuauauugucucccuuucuuucgaccaugcugugguugaugaacaaugucagcucaauugcggaggccacgagagccaggugacccugaagggcaaccugaucuuucucgacguccccaaguucguggacggguccuacaugcagacauaucauagcaccgugccuacaggagccaauauccccucuccuaccgauuggcugaacgcccuuuuuggcaaugggcuguccagauggauucucggagucaucggcguucugcuugggggacuugcucucuucuuucugauuauguuccugcucaaacugggcacgaagcaaguguuucggagccgcacaaaacuugccuga

SEQ ID NO: 14851 - RNA, 3222 nt, Artificial Sequence
  derived and/or modified CDS sequence (opt5) from SFTSV(SDTA_4)__KX641916.1__GP
augaugaaggugaucugguucagcucccugauuugccucgucauccaguguucuggcgacagcgggcccauuaucugcgccggaccuauucacuccaacaaaucugcuggcaucccgcaucugcuuggguacagcgagaagaucugucaaauugauagacugauccacguuuccucuuggcuccggaaucauagccaguuucagggauaugugggccagcgcgggggaagaucccaagugagcuacuaucccgccgaaaacucuuacucccgguggagcggccugcuuucuccuugcgacgcggauuggcugggcaugcucgucgugaaaaaggcuaaagaguccgacaugauuguucccgggccuagcuauaagggaaagguguucuuugaacgccccaccuucgauggcuacgucggguggggauguggcucugggaaauccagaacagagagcggagaacugugcuccucugacagcggcacguccagcggccugcucccuucugaucgggugcuguggaucggggacguugccugucagccgaugacccccauuccugaggagacauuucuugaacugaaguccuucagccagucugaguuucccgauaucugcaaaauugacggaaucguguucaaucagugugaaggcgagagccucccucaacccuuugaugucgccuggauggacguggggcacucccauaagaucauuaugcgcgagcacaaaaccaagugggugcaggaaucuagcuccaaggauuucgucugcuauaaagagggaacaggcccguguagcgaaucugaggaaaaggcuugcaaaaccuccgggagcugcagaggagacaugcaguuuuguaagguugccggcugcgagcacggcgaggaagcuagcgaggccaaaugucggugcucccuggugcauaagccuggggaaguggucgugagcuacggaggcaugcgcguuagacccaaauguuacggguucucccggaugauggcgacacuugaggugaacccucccgaacagcgcaucggacaaugcaccggcugucaccuggagugcauuaaugggggcgucagacucaucacgcugaccucugagcugcggagcgccacagugugugcuucccauuuuugcucuagcgccaccuccggaaagaagucuacagaaauucacuuccacucuggcucccucguugggaaaaccgcuauccaugugaagggagcccuggucgacggcacggaguucacauuugaagggagcuguaucuuccccgauggaugcgacgcgguggauugcaccuuuugucgcgaguuccuuaaaaacccucagugcuauccggccaagaaauggcuguuuauuaucauugucauccuccugggcuacgcugggcuuaugcugcucacaaaugugcugaaggccauuggcguuuggggaucuugggugaucgcucccgucaagcugaucuucgccauuaugaaaaagcucaugagaaccguguccugucugguuggcaaacuuauggaccgggggagacaggugauccacgaagagauuggagagaacggcgaagggaaucaagaugacguccgcaucgagauggcccggccuagacgcgugcggcauuggauguauagccccgugauucugaccauccucgcuauuggacuggcggaaggcugcgaugagaugguucacgccgacucuaaacuugucagcuguagacagggguccggcaacaugaaggagugcaucacaacgggaggcgcucugcucccugccgugaaucccgggcaggaagccugucugcauuuuaccgcuccgggaagcccugauucuaagugccugaagaucaaagugaagcgcauuaaccucaaauguaagaaauccagcuccuacuucguccccgacgcccggucuagaugcacaagcgugcgccgguguagaugggcgggcgauugccaguccgggugcccuccccacuuuaccucuaauagcuucuccgacgacugggcuggaaagauggaucgcgccggccugggguuuucuggcuguagcgacggaugcggcggggccgcuuguggaugcuucaacgccgcuccuuccuguaucuuuuggcggaaguggguugagaauccccacggcauuaucuggaaagugagcccgugcgccgcgugggucccuucugccgugauugaacuuacaaugcccuccggggagguuagaaccuuccaucccaugagcggaaucccuacgcaaguguucaagggcgucucugugacauaucugggcuccgauauggaaguuagcgggcucaccgaccugugugagaucgaggaacugaaaucuaagaaacuugcucucgccccgugcaaccaggcuggaaugggcguggucgggaaggugggagagauucaguguuccagcgaagaguccgcccggaccaucaaaaaggauggcugcauuuggaacgcggaccugguggggaucgaacugcgcgucgaugacgccguuuguuacagcaagauuacaucuguggaggcuguggccaauuauagcgcuauccccaccacaaucggaggccucagauuugagcggucccacgauucucagggcaaaauuagcggguccccucuggacaucacggccauuagaggaucuuucagcgucaacuaccgcggccuucggcugucccucucugaaaucaccgccacaugcaccggggaggugacaaauguuagcggaugcuacuccuguaugaccggcgcuaaggugagcauuaaacugcauucuuccaagaacagcacggcgcacgucagaugcaaaggggaugaaaccgccuuuucugugcuggagggaguucacuccuauaucgugagccuuuccuucgaccaugcugucguggaugaacaaugucagcucaauugcggcggccacgagucucagguuacacugaaggggaaccugaucuuucucgacgugcccaaguucgucgacggaagcuacaugcagaccuaucauuccacagugccuaccggcgccaauauucccagcccuacggauuggcugaacgcccuuuuugggaauggacugucucgcuggauccucggcgugauugggguccugcugggaggccuugcucucuucuuucugaucauguuccugcucaaacugggcacaaagcaaguuuuuagaucccggaccaaacuugccuga

SEQ ID NO: 14852 - RNA, 3222 nt, Artificial Sequence
  derived and/or modified CDS sequence (opt5) from SFTSV(HBGS13_human_2015)__KY440773.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucuaaucgggugcucuggaucggggacguugccugucagccgaugacccccauuccugaagagacauuccuggagcuuaaguccuuuagccagucugaguuccccgauaucugcaaaauugacggaaucguguuuaaccagugugaaggcgaaagccugccucaacccuucgaugucgccuggauggacguggggcacucccauaagaucauuaugcgcgagcacaaaaccaagugggugcaggagucuagcuccaaggauuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcguuagacccaaauguuacggguuuucccggaugauggccacccuggaagugaaucagccugagcaacgcaucggacagugcacgggcugucaccuugaaugcauuaacgggggcgucagacugaucacccucacaucugagcugaagucugcgaccgugugugccucccauuucugcucuagcgcuacauccggaaagaaaagcaccgagauucaguuccacucuggcucccugguugggaagacggccauccacgugaaaggagcucucgucgacggcacagaauuuaccuucgaggggagcuguauguuucccgauggaugcgacgccguggauugcacauucugucgggaauuucugaagaauccccaaugcuauccugcgaaaaaguggcuuuucaucauuaucgucauucugcucggcuacgccgggcugaugcuucugaccaacgugcucaaggcuaucggcauuuggggaucuuggguuaucgccccggugaaacugaucuuugcuauuaucaagaaacugaugcgcaccgucuccugucucaugggcaagcugauggacagagggagacaggugauucaugaggaaaucggagagaaucgggagggcaaccaggaugacguucgcauugaaauggcccggcccagacgcgugcggcacuggauguauagcccugucauccuuacaauucuggccaucgggaucgcugagucuugcgaugaaauggugcaugcggacagcaaacucguguccuguagacagggaagcggcaauaugaaggagugcguuacgaccgggcgcgcccugcuucccgcugucaacccuggccaagaggccugucugcacuucacagcccccggaucuccggauuccaagugccuccggauuaaagugaagagaaucaaucugaaauguaagaaaagcuccucuuacuuugugccugacgcucgcagccggugcaccuccgucagacgcugucggugggccggcgauugccagucugggugucccccucauuucacaagcaacuccuuuucugacgacugggcgggaaagauggauagagcuggccugggguucagcggaugcuccgacggcugcgggggcgccgccuguggaugcuuuaaugcugcccccagcuguauuuucuggcggaaguggguggaaaacccucacggcaucauuuggaaaguuucucccugcgcugccugggugccguccgcggucaucgagcucaccaugccuagcggggaagugcgcacguuccaccccaugucuggaauccccacacagguuuuuaagggcguguccgucaccuaucuggggagcgauauggaggugucuggacuuaccgaccugugugaaauugaggagcucaaauccaagaaacuggcccuggcuccuugcaaccaggccggcaugggcguuguggggaaggucggagaaauccaauguagcuccgaggaaagcgcuagaacaauuaaaaaggauggcugcaucuggaaugccgaccuuguggggauugagcuccggguggaugacgcggucuguuacucuaagaucaccagcguugaagccguggcuaacuauuccgccaucccgacaacgauuggaggccugagauucgagcgcucucaugauagccaggggaaaaucuccggaucuccccuggacauuaccgcuauccggggcagcuuuuccgugaauuacagaggccuccgccugucucuuagcgagauuacagcuaccugcacaggggaagucaccaacguguccggaugcuacagcuguaugacgggcgccaagguuucuaucaaacugcacuccagcaagaauagcaccgcccaugugagaugcaaaggggaugagacagcguucuccguccucgaaggagugcacagcuauaccguuucccugucuuuugaccacgccguggucgaugagcagugucagcugaacugcggcgggcaugaaagccaagugacacuuaagggaaaucucaucuuccuggacguuccuaaguuuguggacggcuccuacaugcagaccuaucacagcacgguccccacaggcgcuaacauuccuucucccaccgauuggcugaaugcccucuucgggaacggacugucccgguggauccuuggcgugaugggggugcugcucggaggccuggcccuguuuauuaucauuaugagccuuuucaaacucgggacaaagcaggucuuucgcucuagaaccaaacuggcuuga

SEQ ID NO: 14853 - RNA, 3222 nt, Artificial Sequence
  derived and/or modified CDS sequence (opt5) from SFTSV(HBMC16_human_2015)__KY440776.1__GP
augaugaaggugaucugguucagcucccuggucugccucguuauucaguguucuggcgacagcgggcccaucauuugcgccggaccuauccacuccaacaaaucugcuggcauuccgcaucugcuuggguacagcgagaagaucugucaaaucgauagacugauucacguguccucuuggcuccggaaucauagccaguuucagggauaugugggccagcgcgggggaagaucccaagucagcuacuaucccgccgaaaacucuuacucccgguggagcggccugcuuucuccuugcgacgcggauuggcugggcaugcucgugguuaaaaaggcuaaaggguccgacaugaucgugcccggaccuagcuauaagggcaaggucuucuuugagcgccccaccuucgauggguacgugggauggggcugugggucuggaaaauccagaacagaaagcggcgagcugugcuccucugacagcggcacguccagcgggcugcucccuucugaucggguucuguggauuggagacguggccugucagccgaugacccccaucccugaagagacauuucuugagcugaaguccuucagccagucugaauuucccgauauuugcaaaaucgacggcauugucuucaaucagugugagggggaaagccucccucaacccuuugauguggccuggauggacgugggacacucccauaagaucaucaugcgcgagcacaaaaccaaguggguccaggagucuagcuccaaggauuucguuugcuauaaagaaggcacagggccguguagcgagucugaagagaaggcuugcaaaaccuccggaagcugcagaggcgacaugcaguuuuguaagguggccggcugcgaacacggggaggaggcuucugaagccaaaugucggugcucccuggugcauaagccuggagaggucgugguuagcuacggcgggaugcgcgugagacccaaauguuacggauucucccggaugauggcgacaauggaagucaacccucccgagcagcgcauuggccaaugcaccgggugucaccuugaaugcaucaauggcggagugagacugauuacgcucaccucugagcucaagagcgccacaguuugugcuucccauuuuugcucuagcgccaccuccggcaagaaaagcacagagauccacuuccacucugggucccuggugggaaaggcugccauucaugucaaaggcgcgcugguggacgggaccgaauuuacguuugagggaagcuguauguuccccgauggcugcaacgccgucgacugcacauuuugucgggaguuccugaagaauccucagugcuauccggcuaaaaaguggcuuuuuaucaucauugugauccugcucggguacgccggccugaugcuucugaccaacguucucaaggcuauuggaguguggggcucuugggucaucgcccccgugaaacugauguucgccauuaugaagaaacugaugcgcacaguuuccugucucguggggaagcugauggauagaggacggcaggucauccacgaagaaaucggcgagaauggggagggaaaccaagacgaugugagaauugaaauggcucgcccucggagagugcgccauuggauguauagccccguuauccuuaccauucuggcgaucggccucgccgaggggugcgacgaaaugguccacgcugauucuaaacuggugagcugucggcagggcuccggaaauaugaaggagugcgugaccacaggcagagcccuucugccugccgucaaccccgggcaggaggcuugucuccauuuuacggccccgggaagcccugacucuaagugccugaaaauuaaggugaaacgcaucaaucugaaguguaaaaaguccagcuccuacuucguucccgaugcgcggucuagaugcaccagcgugcgccgguguagaugggcuggcgacugccaguccgggugcccuccccacuuuacaucuaacagcuucuccgaugacugggccggaaagauggaccgcgccggccucggguuuucuggcuguagcgauggaugcggcggggcugccuguggaugcuucaaugcugccccuuccuguauuuucuggcggaaaugggucgaaaacccccacggcaucaucuggaaggugagcccgugcgcggccuggguuccuucugcugugauugagcugaccaugcccuccggggaagucagaacauuccaucccaugagcggaaucccuacccaaguguucaaaggcguuucugugacguaucuuggcuccgacauggaggucagcgggcugacagaucucugugaaauugaggagcugaagucuaaaaagcuggcccuugcuccgugcaaccaggccggaaugggcgugguggggaaagucggagaaauccaguguuccagcgaggaauccgcgcggaccauuaagaaggacggcugcaucuggaaugccgaucucguugggaucgagcugcgcguggacgaugcuguguguuacagcaaaauuaccucugucgaagccguggcuaacuauagcgccauccccacaaccauuggaggccugagauuugagcggucccacgacucucagggcaagaucagcggguccccucucgauauuacagccaucagaggaucuuucagcguuaauuaccgcggccugcggcuuucccugucugagaucacggcuaccugcacaggggaagugaccaacgucagcggaugcuacuccuguaugacaggcgcgaaagugagcauuaagcuccauucuuccaaaaauagcaccgcccacguuagaugcaagggggacgagacggcuuuuucugugcuggaaggaguccacuccuauaccgugagccuguccuucgaucaugccguuguggacgagcaaugucagcuuaacugcggcggccacgaaucucaggucacacucaaggggaaucugaucuuucuggaugugcccaaauucguggacggaagcuacaugcagaccuaucauuccacagucccuaccggcgccaacauucccagcccuacggacuggcucaaugcucuguuugggaacggacuuucucgcuggauccugggcguuauuggggugcuccugggaggccuggcccuuuucuuucucaucauguuccuguuuaagcugggcacaaaacaaguguucagaucccggaccaagcucgcguga

SEQ ID NO: 14854 - RNA, 3222 nt, Artificial Sequence
  derived and/or modified CDS sequence (opt5) from SFTSV(HBMC5_human_2016)__KY440770.1__GP
augaugaaggugaucugguucagcucccuggucugccucguuauucaguguucuggcgacagcgggcccaucauuugcgccggaccuauccacuccaacaaaucugcuggcauuccgcaucugcuuggguacagcgagaagaucugucaaaucgauagacugauucacguguccucuuggcuccggaaucauagccaguuucagggauaugugggccagcgcgggggaagaucccaagucagcuacuaucccgccgaaaacucuuacucccgguggagcggccugcuuucuccuugcgacgcggauuggcugggcaugcucgugguuaaaaaggcuaaaggguccgacaugaucgugcccggaccuagcuauaagggcaagguccuguucgagcgccccaccuuugauggguacgugggauggggcugugggucuggaaaauccagaacagaaagcggcgagcugugcuccucugacagcggcacguccagcgggcuccugccuucugaucggguucuuuggauuggagacguggccugucagccgaugacccccaucccugaagagacauuccuggagcucaaguccuuuagccagucugaguuccccgauauuugcaaaaucgacggcauugucuuuaaucagugugaaggggaaagccugccucaacccuucgauguggccuggauggacgugggacacucccauaagaucaucaugcgcgagcacaaaaccaaguggguccaggagucuagcuccaaggauuuuguuugcuauaaagaaggcacagggccguguagcgagucugaagagaaggcuugcaaaaccuccggaagcugcagaggcgacaugcaguucuguaagguggccggcugcgaacacggggaggaggcuucugaagccaaaugucggugcucccuugugcauaagccuggagaggucgugguuagcuacggcgggaugcgcgugagacccaaauguuacggauuuucccggaugauggcgacaauggaagucaacccucccgagcagcgcauuggccaaugcaccgggugucaccuggaaugcaucaauggcggagugagacucauuacgcugaccucugagcuuaagagcgccacaguuugugcuucccauuucugcucuagcgccaccuccggcaagaaaagcacagagauccacuuucacucugggucccucgugggaaaggcugccauucaugucaaaggcgcgcugguggacgggaccgaguucacguucgaaggaagcuguauguuucccgauggcugcaacgccgucgacugcacauucugucgggaauuucuuaagaauccucagugcuauccggcuaaaaaguggcuguucaucaucauugugauccuccugggguacgccggccuuaugcugcucaccaacguucugaaggcuauuggaguguggggcucuugggucaucgcccccgugaaacugauguuugccauuaugaagaaacucaugcgcacaguuuccugucugguggggaagcugauggauagaggacggcaggucauccacgaggaaaucggcgagaauggggagggaaaccaagacgaugugagaauugaaauggcucgcccucggagagugcgccauuggauguauagccccguuauccugaccauucucgcgaucggccuggccgaggggugcgacgaaaugguccacgcugauucuaaacuugugagcugucggcagggcuccggaaauaugaaggagugcgugaccacaggcagagcccugcucccugccgucaaccccgggcaggaggcuugucugcauuucacggccccgggaagcccugacucuaagugccugaaaauuaaggugaaacgcaucaaucucaaguguaaaaaguccagcuccuacuuuguucccgaugcgcggucuagaugcaccagcgugcgccgguguagaugggcuggcgacugccaguccgggugcccuccccacuucacaucuaacagcuuuuccgaugacugggccggaaagauggaccgcgccggccugggguucucuggcuguagcgauggaugcggcggggcugccuguggaugcuuuaaugcugccccuuccuguauuuucuggcggaaaugggucgaaaacccccacggcaucaucuggaaggugagcccgugcgcggccuggguuccuucugcugugauugagcuuaccaugcccuccggggaagucagaacauuucaucccaugagcggaaucccuacccaaguguucaaaggcguuucugugacguaucugggcuccgacauggaggucagcgggcucacagaucugugugaaauugaggagcugaagucuaaaaagcucgcccuugcuccgugcaaccaggccggaaugggcgugguggggaaagucggagaaauccaguguuccagcgaggaauccgcgcggaccauuaagaaggacggcugcaucuggaaugccgaucugguugggaucgagcugcgcguggacgaugcuguguguuacagcaaaauuaccucugucgaagccguggcuaacuauagcgccauccccacaaccauuggaggccucagauucgagcggucccacgacucucagggcaagaucagcggguccccucuggauauuacagccaucagaggaucuuuuagcguuaauuaccgcggccuucggcugucccucucugagaucacggcuaccugcacaggggaagugaccaacgucagcggaugcuacuccuguaugacaggcgcgaaagugagcauuaagcugcauucuuccaaaaauagcaccgcccacguuagaugcaagggggacgagacggcuuucucugugcuggaaggaguccacuccuauaccgugagccuuuccuuugaucaugccguuguggacgagcaaugucagcucaacugcggcggccacgaaucucaggucacacugaaggggaaucugaucuuccucgaugugcccaaauuuguggacggaagcuacaugcagaccuaucauuccacagucccuaccggcgccaacauucccagcccuacggacuggcugaaugcucuuuucgggaacggacugucucgcuggauccucggcguuauuggggugcugcugggaggccuugcccucuuuuuccugaucauguuucuguucaagcucggcacaaaacaaguguuuagaucccggaccaagcuggcguga

SEQ ID NO: 14855 - RNA, 3222 nt, Artificial Sequence
  derived and/or modified CDS sequence (opt5) from SFTSV(HB29)__KP202164.1__GP
augaugaaggugaucugguucagcucccugauuugccucgucauccaguguucuggcgacagcgggcccauuaucugcgccggaccuauucacuccaacaaaucugcuggcaucccgcaucugcuuggguacagcgagaagaucugucaaauugauagacugauccacguuuccucuuggcuccggaaucauagccaguuucagggauaugugggccagcgcgggggaagaucccaagugagcuacuaucccgccgaaaacucuuacucccgguggagcggccugcuuucuccuugcgacgcggauuggcugggcaugcucgucgugaaaaaggcuaaagaguccgacaugauuguucccgggccuagcuauaagggaaagguguucuuugaacgccccaccuucgauggcuacgucggguggggauguggcucugggaaauccagaacagagagcggagaacugugcuccucugacagcggcacguccagcggccugcucccuucugaucgggugcuguggaucggggacguugccugucagccgaugacccccauuccugaggagacauuucuugaacugaaguccuucagccagucugaguuucccgauaucugcaaaauugacggaaucguguucaaucagugugaaggcgagagccucccucaacccuuugaugucgccuggauggacguggggcacucccauaagaucauuaugcgcgagcacaaaaccaagugggugcaggaaucuagcuccaaggauuucgucugcuauaaagagggaacaggcccguguagcgaaucugaggaaaaggcuugcaaaaccuccgggagcugcagaggagacaugcaguuuuguaagguugccggcugcgagcacggcgaggaagccucugaggccaaaugucggugcucccuggugcauaagccuggggaaguggucgugagcuacggaggcaugcgcguuagacccaaauguuacggguucucccggaugauggcgacacuugaggugaacccucccgaacagcgcaucggacaaugcaccggcugucaccuggagugcauuaaugggggcgucagacucaucacgcugaccucugagcugcggagcgccacagugugugcuucccauuuuugcucuagcgccuccagcggaaagaagucuaccgaaauucacuuccacuccggcagccucguugggaaaacagcuauccaugugaagggagcccuggucgacggcaccgaguucacguuugaagggucuuguauguuccccgauggaugcgacgcgguggauugcacauuuugucgcgaguuccuuaaaaacccucagugcuauccggccaagaaauggcuguuuaucauuaucgucauucaccucggcuacgcugggcugaugcuucugaccaaugugcucaaggccaucggcguuuggggauccugggugauugcucccgucaagcugauguucgccaucaucaaaaagcugaugagaacagugagcugucucguuggcaaacugauggaccgggggagacaggugauucaugaagagaucggagagaacggcgaagggaaucaagaugacguccgcauugagauggcccggccuagacgcgugcggcacuggauguauucucccgugauccuuaccauucuggcuaucggacucgcggaaggcugcgaugagaugguucaugccgacagcaagcuggucuccuguagacaggggagcggcaacaugaaagagugcauuaccacaggacgcgcucugcugccugccgugaaucccggccaggaagccugucuccacuuuacggcuccggggucuccugauuccaagugccugaagaucaaagugaagcggaucaaccugaaauguaagaaaagcuccucuuacuucguccccgacgccagaagccgcugcaccuccgugcggagaugucgcugggcgggagauugccagucuggcugcccuccccacuuuacaagcaauuccuucucugacgacugggcugggaagauggaucgggccggacucggcuuuagcggguguuccgacggcugcggaggcgccgcuugugggugcuucaacgccgcuccuagcuguaucuuuuggagaaaguggguugagaauccccauggaauuauuuggaaagugucuccgugcgccgcgugggucccuuccgccgugaucgaacugaccaugcccagcggcgagguucggacauuccaccccaugucugggauuccuacccaaguguucaagggagucuccgugacguaucuuggcagcgauauggaaguuucuggccugacagaccucugugagaucgaggaacugaaauccaagaaacuggcucuugccccgugcaaccaggcugggaugggaguggucggcaaggugggggagauccaguguagcuccgaagagagcgcccgcaccauuaaaaaggauggaugcaucuggaacgcggaccucgugggcauugaacugagagucgaugacgccguuuguuacucuaagaucaccagcguggaggcuguggccaauuauuccgcuauucccacaaccaucgggggacugcgguuugagagaucucaugauagccagggcaaaaucuccggcucuccucucgacauuacagccauccgcgggagcuucuccgucaacuaccggggacugagacuuucucugagcgaaauuacggcuaccugcacaggcgaggugaccaauguuuccgggugcuacagcuguaugacaggagcuaaggugucuaucaaacuccacuccagcaagaacaauaccgcgcacguccgcugcaaaggcgaugaaacggccuuuucugugcuggaggggguucauuccuauauugugagccuguccuucgaccacgcugucguggaugaacaaugucagcuuaacugcggaggccaugagucucagguuacccucaagggcaaucugaucuuucuggacgugcccaaguucgucgacgggagcuacaugcagacauaucacuccaccgugccuacaggagccaacauccccagcccuaccgauuggcucaaugcccuguuuggcaacgggcuuucuagauggauucugggagugaucggcguccuccuugggggacuggcucuuuucuuucucauuauguuccugcugaaacucggcacgaagcaaguuuuucggucccgcacaaaacuggccuga

SEQ ID NO: 14856 - RNA, 3222 nt, Artificial Sequence
  derived and/or modified CDS sequence (opt5) from SFTSV(HNXY_115)__KC292312.1__GP
augaugaaggugaucugguucagcucccugauuuacuuugucauccagugcucuggcgacagcggguccauuaucugugccggacccauucacucuaacaaaagcgcugauaucccucaucuccugggcuauuccgagaagaucugccaaauugacagacuuauccacguuucuagcuggcugcggaaucauucccaguuccagggguacgugggacagcgcggcgggagaagccaagugucuuauuacccggccgaaaacuccuauagccgguggucuggacuccugucccccugugaugcggacuggcuuggcaugcuggucgugaaaaaggcuaaaggcagcgauaugauuguuccugggcccucuuacaagggaaagguguuuuucgagcgcccuaccuuugacggcuaugucggguggggaugcggcuccgggaaaagcagaacagaauccggagagcucuguucuagcgauuccggcacgagcucuggccugcugcccuccgaccgggugcucuggaucggggauguugccugccagccuaugaccccgauucccgaagagacauuccuggagcuuaagagcuuuucucagagcgaguucccugacaucuguaaaauugauggaaucguguuuaaucagugcgaaggcgaaucccugccccaaccuuucgacgucgccuggauggauguggggcacucucauaagaucauuaugcgcgagcacaaaaccaagugggugcaggagagcuccagcaaggacuuugucuguuacaaagaaggaacaggccccugcucugaguccgaagagaagaccuguaaaacaagcgggucuugcagaggagacaugcaguucugcaagguugcuggcugugaacacggcgaggaggccuccgaagcuaaaugccgguguagccucgugcauaagccgggggagguggucguguccuacggaggcaugcgcguuagaccuaaaugcuauggguuuucucggaugauggccacccuggaagugaaccagcccgagcaacgcaucggacaguguacgggcugccaccuugaauguauuaaugggggcgucagacugaucacccucacaagcgagcugaaguccgcgaccgugugcgccucucauuucuguagcuccgcuacaagcggaaagaaaucuaccgagauucaguuccacuccggcagccugguugggaagacggccauccacgugaaaggagcucucgucgauggcacagaauuuaccuucgaggggucuugcauguuuccugacggaugugaugccguggacugcacauucugccgggaauuucugaagaacccccaauguuaccccgcgaaaaaguggcuuuucaucauuaucgucauucugcucggcuaugccgggcugaugcuucugaccaaugugcucaaggcuaucggcauuuggggauccuggguuaucgccccugugaaacugaucuuugcuauuaucaagaaacugaugcgcaccgucagcugccucaugggcaagcugauggauagagggagacaggugauucaugaggaaaucggagagaaccgggagggcaaucaggacgauguucgcauugaaauggcccggccgagacgcgugcggcacuggauguacucucccgucauccuuacaauucuggccaucgggcucgcugagagcugugacgaaauggugcaugcggauuccaaacuggugagcugcagacagggaucuggcaacaugaaggaguguguuacgaccgggcgcgcccuucugccugcugucaaucccggccaagaggccugccuccacuucacagccccuggaucccccgacagcaagugucugaaaaucaaggugaaacggauuaaccugaagugcaaaaaguccucuagcuauuuugugccggaugcuagaucccgcuguaccucuguccggagaugccgcugggccggcgacugucagagcgggugcccuccccauuucacauccaauucuuuuagcgacgauugggcgggaaagauggaccgggcuggccucggguucuccggaugcagcgauggcugugggggcgccgccugcggauguuuuaacgcugccccuucuugcaucuucuggagaaaauggguggaaaauccccacggcauuaucuggaagguuuccccuugugcugccugggugcccagcgcggucauugagcugaccaugccgucuggggaagugcggacguuccacccuauguccggaauccccacacagguuuuuaaaggcgugagcgucaccuaccuugggucugacauggagguguccggacugaccgaucucugcgaaaucgaggagcuuaagagcaaaaagcuggcccuugcucccuguaaccaggccggcaugggcguuguggggaaagucggagaaauucaaugcuccagcgaggaaucugcucgcacaaucaagaaggacggcuguauuuggaacgccgaucucguggggaucgagcugagaguggacgaugcggucugcuauagcaaaauuaccuccguugaagccguggcuaauuacucugccaucccuacaacgaucggaggccugcgguucgagagaagccaugacucccaggggaagauuucuggaagcccgcucgauaucaccgcuauucgcggcuccuuuucugugaacuaccggggccugagacuuagccuguccgagaucacagccaccuguacaggggaagucaccaaugugagcggaugcuauucuugcaugacgggcgccaaaguuuccauuaagcuccacagcucuaaaaacuccaccgcucaugugcgcuguaagggggacgagacagcguucagcguccuggaaggagugcacuccuacaccguuucucugagcuuugaucacgccguggucgacgagcagugccagcuuaauuguggcgggcaugaaucccaagugacacucaagggaaaccugaucuuccuggacguucccaaauuuguggauggcagcuauaugcagaccuaccacucuacggucccuacaggcgcuaauauccccuccccuaccgacuggcucaacgcccuguucgggaauggacuuagcagauggauucugggcgugaucggggugcuccugggaggccuggcccuguuuuucaugauuaugucucucuuuaagcuggggacaaaacaggucuuccggagccgcaccaagcuggcuuga

SEQ ID NO: 14857 - RNA, 3222 nt, Artificial Sequence
  derived and/or modified CDS sequence (opt5) from SFTSV(HNXY_144)__KC292307.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuccuggagcuuaaguccuuuagccagucugaguuccccgacaucugcaaaauugauggaaucguguuuaaucagugugaaggcgaaagccugccucaacccuucgacgucgccuggauggauguggggcacucccauaagaucauuaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcguuagacccaaauguuacggguuuucccggaugauggccacccuggaagugaaccagccugagcaacgcaucggacagugcacgggcugucaccuugaaugcauuaaugggggcgucagacugaucacccucacaucugagcuuaagagcgcgaccgugugugccucccauuucugcucuagcgcuacauccggaaagaaaagcaccgagauucaguuccacucuggcucccugguugggaagacggccauccacgugaaaggagcucucgucgauggcacagaauuuaccuucgaggggagcuguauguuucccgacggaugcgaugccguggacugcacauucugucgggaauuucugaagaacccccaaugcuauccugcgaaaaaguggcuuuucaucauuaucgucauucugcucggcuacgccgggcugaugcuucugaccaaugugcucaaggcuaucggcauuuggggaucuuggguuaucgccccggugaaacugaucuuugcuauuaucaagaaacugaugcgcaccgucuccugucucaugggcaagcugauggauagagggagacaggugauucaugaggaaaucggagagaaccgggagggcaaucaggacgauguucgcauugaaauggcccggcccagacgcgugcggcacuggauguauagcccugucauccuuacaauucuggccaucgggcucgcugagucuugcgacgaaauggugcaugcggauagcaaacugguguccuguagacagggaagcggcaacaugaaggagugcguuacgaccgggcgcgcccuucugcccgcugucaauccuggccaagaggccugucuccacuucacagcccccggaucuccggacuccaagugccugaaaaucaaggugaaacggauuaaccugaaguguaaaaagagcuccucuuacuuugugccugaugcuagaagccgcugcaccuccguccggagaugucgcugggccggcgacugccagucugggugucccccucauuucacaagcaauuccuuuucugacgauugggcgggaaagauggaccgggcuggccucggguucagcggaugcuccgauggcugcgggggcgccgccuguggaugcuuuaacgcugcccccagcuguaucuucuggagaaaauggguggaaaauccucacggcauuaucuggaagguuucucccugcgcugccugggugccguccgcggucauugagcugaccaugccuagcggggaagugcggacguuccaccccaugucuggaauccccacacagguuuuuaaaggcguguccgucaccuaucuugggagcgacauggaggugucuggacugaccgaucucugugaaaucgaggagcugaaguccaaaaagcuggcccuugcuccuugcaaccaggccggcaugggcguuguggggaaagucggagaaauucaauguagcuccgaggaaagcgcucgcacaaucaagaaggacggcugcauuuggaacgccgaucucguggggaucgagcugagaguggacgaugcggucuguuacucuaaaauuaccagcguugaagccguggcuaauuauuccgccaucccgacaacgaucggaggccugcgguucgagagaucucaugacagccaggggaagauuuccggaucuccccucgauaucaccgcuauucgcggcagcuuuuccgugaacuaccggggccugagacuuucucugagcgagaucacagcuaccugcacaggggaagucaccaauguguccggaugcuacagcuguaugacgggcgccaaaguuucuauuaagcuccacuccagcaaaaacucuaccgcccaugugcgcugcaagggggacgagacagcguucuccguccuggaaggagugcacagcuauaccguuucccugucuuuugaucacgccguggucgacgagcagugucagcuuaauugcggcgggcaugaaagccaagugacacucaagggaaaccugaucuuccuggacguuccuaaauuuguggauggcuccuacaugcagaccuaucacagcacgguccccacaggcgcuaauaucccuucucccaccgacuggcucaacgcccuguucgggaauggacuuuccagauggauucugggcgugaugggggugcuccugggaggccuggcccuguuuuucaugaucaugagccucuuuaagcuggggacaaaacaggucuuccggucucgcaccaagcuggcuuga

SEQ ID NO: 14858 - RNA, 3222 nt, Artificial Sequence
  derived and/or modified CDS sequence (opt5) from SFTSV(HNXY_157)__KC292305.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucuaaucgggugcucuggaucggggacguugccugucagccgaugacccccauuccugaagagacauuccuggagcuuaaguccuuuagccagucugaauuucccgauaucugcaaaauugacggaaucguguuuaaccagugugagggcgaaagccugccucaacccuucgaugucgccuggauggacguggggcacucccauaagaucauuaugcgcgagcacaaaaccaagugggugcaggagucuagcuccaaggauuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcguuagacccaaauguuacggguuuucccggaugauggccacccuggaagugaaucagccugagcaacgcaucggacagugcacgggcugucaccuugaaugcauuaacgggggcgucagacugaucacccucacaucugagcugaagucugcgaccgugugugccucccauuucugcucuagcgcuacauccggaaagaaaagcaccgagauucaguuccacucuggcucccugguugggaagacggccauccacgugaaaggagcucucgucgacggcacagaauuuaccuucgaggggagcuguauguuucccgauggaugcgacgccguggauugcacauucugucgggaauuucugaagaauccccaaugcuauccugcgaaaaaguggcuuuucaucauuaucgucauucugcucggcuacgccgggcugaugcuucugaccaacgugcucaaggcuaucggcauuuggggaucuuggguuaucgccccggugaaacugaucuuugcuauuaucaagaaacugaugcgcaccgucuccugucucaugggcaagcugauggacagagggagacaggugauucaugaggaaaucggagagaaucgggagggcaaccaggaugacguucgcauugaaauggcccggcccagacgcgugcggcacuggauguauagcccugucauccuuacaauucuggccaucgggcucgcugagucuugcgaugaaauggugcaugcggacagcaaacugguguccuguagacagggaagcggcaauaugaaggagugcguuacgaccgggcgcgcccuucugcccgcugucaacccuggccaagaggccugucuccacuucacagcccccggaucuccggauuccaagugccugcggaucaaagugaagagaauuaaucugaaauguaagaaaagcuccucuuacuuugugccugacgcucgcagccggugcaccuccgucagacgcugucggugggccggcgauugccagucugggugucccccucauuucacaagcaacuccuuuucugacgacugggcgggaaagauggauagagcuggccucggguucagcggaugcuccgacggcugcgggggcgccgccuguggaugcuuuaaugcugcccccagcuguaucuucuggcggaaguggguggaaaacccucacggcauuaucuggaaaguuucucccugcgcugccugggugccguccgcggucauugagcugaccaugccuagcggggaagugcgcacguuccaccccaugucuggaauccccacacagguuuuuaagggcguguccgucaccuaucuugggagcgauauggaggugucuggacugaccgaccucugugaaaucgaggagcugaaauccaagaaacuggcccuugcuccuugcaaccaggccggcaugggcguuguggggaaggucggagaaauucaauguagcuccgaggaaagcgcuagaacaaucaaaaaggauggcugcauuuggaaugccgaccucguggggaucgagcugcggguggaugacgcggucuguuacucuaagauuaccagcguugaagccguggcuaacuauuccgccaucccgacaacgaucggaggccugagauucgagcgcucucaugauagccaggggaaaauuuccggaucuccccucgacaucaccgcuauucggggcagcuuuuccgugaauuacagaggccugcgccuuucucugagcgagaucacagcuaccugcacaggggaagucaccaacguguccggaugcuacagcuguaugacgggcgccaagguuucuauuaaacuccacuccagcaagaauagcaccgcccaugugagaugcaaaggggaugagacagcguucuccguccuggaaggagugcacagcuauaccguuucccugucuuuugaccacgccguggucgaugagcagugucagcuuaacugcggcgggcaugaaagccaagugacacucaagggaaaucugaucuuccuggacguuccuaaguuuguggacggcuccuacaugcagaccuaucacagcacgguccccacaggcgcuaacaucccuucucccaccgauuggcucaaugcccuguucgggaacggacuuucccggugggugcugggcgugauggggguccuccugggaggccuggcccuuuucuucaugauuaugagccucuuuaaacuggggacaaagcagguuuuccgcucuagaaccaaacuggcuuga

SEQ ID NO: 14859 - RNA, 3222 nt, Artificial Sequence
  derived and/or modified CDS sequence (opt5) from SFTSV(HNXY_170)__KC292304.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucuaaucgggugcucuggaucggggacguugccugucagccgaugacccccauuccugaagagacauuccuggagcuuaaguccuuuagccagucugaauuucccgauaucugcaaaauugacggaaucguguuuaaccagugugagggcgaaagccugccucaacccuucgaugucgccuggauggacguggggcacucccauaagaucauuaugcgcgagcacaaaaccaagugggugcaggagucuagcuccaaggauuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcguuagacccaaauguuacggguuuucccggaugauggccacccuggaagugaaucagccugagcaacgcaucggacagugcacgggcugucaccuugaaugcauuaacgggggcgucagacugaucacccucacaucugagcugaagucugcgaccgugugugccucccauuucugcucuagcgcuacauccggaaagaaaagcaccgagauucaguuccacucuggcucccugguugggaagacggccauccacgugaaaggagcucucgucgacggcacagaauuuaccuucgaggggagcuguauguuucccgauggaugcgacgccguggauugcacauucugucgggaauuucugaagaauccccaaugcuauccugcgaaaaaguggcuuuucaucauuaucgucauucugcucggcuacgccgggcugaugcuucugaccaacgugcucaaggcuaucggcauuuggggaucuuggguuaucgccccggugaaacugaucuuugcuauuaucaagaaacugaugcgcaccgucuccugucucaugggcaagcugauggacagagggagacaggugauucaugaggaaaucggagagaaucgggagggcaaccaggaugacguucgcauugaaauggcccggcccagacgcgugcggcacuggauguauagcccugucauccuuacaauucuggccaucgggcucgcugagucuugcgaugaaauggugcaugcggacagcaaacugguguccuguagacagggaagcggcaauaugaaggagugcguuacgaccgggcgcgcccuucugcccgcugucaacccuggccaagaggccugucuccacuucacagcccccggaucuccggauuccaagugccugcggaucaaagugaagagaauuaaucugaaauguaagaaaagcuccucuuacuuugugccugacgcucgcagccggugcaccuccgucagacgcugucggugggccggcgauugccagucugggugucccccucauuucacaagcaacuccuuuucugacgacugggcgggaaagauggauagagcuggccucggguucagcggaugcuccgacggcugcgggggcgccgccuguggaugcuuuaaugcugcccccagcuguaucuucuggcggaaguggguggaaaacccucacggcauuaucuggaaaguuucucccugcgcugccugggugccguccgcggucauugagcugaccaugccuagcggggaagugcgcacguuccaccccaugucuggaauccccacacagguuuuuaagggcguguccgucaccuaucuugggagcgauauggaggugucuggacugaccgaccucugugaaaucgaggagcugaaauccaagaaacuggcccuugcuccuugcaaccaggccggcaugggcguuguggggaaggucggagaaauucaauguagcuccgaggaaagcgcuagaacaaucaaaaaggauggcugcauuuggaaugccgaccucguggggaucgagcugcggguggaugacgcggucuguuacucuaagauuaccagcguugaagccguggcuaacuauuccgccaucccgacaacgaucggaggccugagauucgagcgcucucaugauagccaggggaaaauuuccggaucuccccucgacaucaccgcuauucggggcagcuuuuccgugaauuacagaggccugcgccuuucucugagcgagaucacagcuaccugcacaggggaagucaccaacguguccggaugcuacagcuguaugacgggcgccaagguuucuauuaaacuccacuccagcaagaauagcaccgcccaugugagaugcaaaggggaugagacagcguucuccguccuggaaggagugcacagcuauaccguuucccugucuuuugaccacgccguggucgaugagcagugucagcuuaacugcggcgggcaugaaagccaaaucacacucaagggaaaucugaucuuccuggacgugccuaaguuuguugacggcuccuacaugcagaccuaucacagcacggugcccacaggcgcuaacauuccuucucccaccgauuggcucaaugcccuguucgggaacggacuuucccgguggguccugggcgugaucggggugcuccugggaggccuggcccuuuucuucaugauuaugagccucuuuaaacuggggacaaagcaggucuuccgcucuagaaccaaacuggcuuga

SEQ ID NO: 14860 - RNA, 3222 nt, Artificial Sequence
  derived and/or modified CDS sequence (opt5) from SFTSV(HNXY_174)__KC292306.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuccuggagcuuaaguccuuuagccagucugaguuccccgacaucugccgcauugauggaaucguguuuaaucagugugaaggcgaaagccugccucaacccuucgacgucgccuggauggauguggggcacucccauaaaaucauuaugagagagcacaagaccaaaugggugcaggagucuagcuccaaggacuuugucugcuauaaggaaggaacaggcccguguagcgagucugaagagaaaaccugcaagacauccgggagcugccggggagacaugcaguucuguaaaguugcuggcugcgaacacggcgaggaggccucugaagcuaagugucgcugcucccucgugcauaaaccuggggagguggucgugagcuacggaggcaugagaguucggcccaaguguuacggguuuucccgcaugauggccacccuggaagugaaccagccugagcaaagaaucggacagugcacgggcugucaccuugaaugcauuaaugggggcguccggcugaucacccucacaucugagcugaaaagcgcgaccgugugugccucccauuucugcucuagcgcuacauccggaaagaaaagcaccgagauucaguuccacucuggcucccugguugggaagacggccauccacgugaagggagcucucgucgauggcacagaauuuaccuucgaggggagcuguauguuucccgacggaugcgaugccguggacugcacauucugucgcgaauuucugaaaaacccccaaugcuauccugcgaagaaauggcuuuucaucauuaucgucauucugcucggcuacgccgggcugaugcuucugaccaaugugcucaaggcuaucggcauuuggggaucuuggguuaucgccccggugaagcugaucuuugcuauuaucaaaaagcugaugagaaccgucuccugucucaugggcaaacugauggaucgggggagacaggugauucaugaggaaaucggagagaaccgcgagggcaaucaggacgauguucggauugaaauggccagaccccgccgggugagacacuggauguauagcccugucauccuuacaauucuggccaucgggcucgcugagucuugcgacgaaauggugcaugcggauagcaagcugguguccugucgccagggaagcggcaacaugaaagagugcguuacgaccgggcgggcccuucugcccgcugucaauccuggccaagaggccugucuccacuucacagcccccggaucuccggacuccaagugccugagaaucaaggugaaacgcauuaaccugaaguguaaaaagagcuccucuuacuuugugccugaugcucggagcagaugcaccuccguccgccgguguagaugggccggcgacugccagucugggugucccccucauuucacaagcaauuccuuuucugacgauugggcgggaaaaauggaccgggcuggccucggguucagcggaugcuccgauggcugcgggggcgccgccuguggaugcuuuaacgcugcccccagcuguaucuucuggcgcaaguggguggaaaauccucacggcauuaucuggaagguuucucccugcgcugccugggugccguccgcggucauugagcugaccaugccuagcggggaagugagaacguuccaccccaugucuggaauccccacacagguuuuuaaaggcguguccgucaccuaucuugggagcgacauggaggugucuggacugaccgaucucugugaaaucgaggagcugaaguccaaaaagcuggcccuugcuccuugcaaccaggccggcaugggcguuguggggaaagucggagaaauucaauguagcuccgaggaaagcgcucggacaaucaagaaagacggcugcauuuggaacgccgaucucguggggaucgagcugagaguggacgaugcggucuguuacucuaagauuaccagcguugaagccguggcuaauuauuccgccaucccgacaacgaucggaggccugcgcuucgagcggucucaugacagccaggggaagauuuccggaucuccccucgauaucaccgcuauuagaggcagcuuuuccgugaacuaccgcggccugagacuuucucugagcgagaucacagcuaccugcacaggggaagucaccaauguguccggaugcuacagcuguaugacgggcgccaaaguuucuauuaagcuccacuccagcaaaaacucuaccgcccaugugcggugcaagggggacgagacagcguucuccguccuggaaggagugcacagcuauaccguuucccugucuuuugaucacgccguggucgacgagcagugucagcuuaauugcggcgggcaugaaagccaagugacacucaaaggaaaccugaucuuccuggacguuccuaaguuuguggauggcuccuacaugcagaccuaucacagcacgguccccacaggcgcuaauaucccuucucccaccgacuggcucaacgcccuguucgggaauggaaugucccgcuggauucuuggcgugaugggggugcugcucggaggccuggcccuguuuuucaugaucaugagccuuuuuaagcucgggacaaaacaggucuucagaucucggaccaagcuggcuuga

SEQ ID NO: 14861 - RNA, 3222 nt, Artificial Sequence
  derived and/or modified CDS sequence (opt5) from SFTSV(HNXY_182)__KC292324.1__GP
augaugaaggugaucugguucagcucccugauuugcuuugucauccaguguucuggcgacagcgggcccauuaucugcgccggaccuauucacuccaacaaaucugcugauaucccgcaucuccaaggcuacagcgagaagaucugucagauugacagacugauccacguuuccucuuggcuucggaaucauagccaguuccagggguaugugggacaacgcggcgggagaucccaggugagcuacuaucccgccgaaaacucuuacucccgguggagcggacugcucucuccuugcgaugcggacuggcugggcaugcuugucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcugugcuccucugauagcggcacguccagcggccuccugccuucugaccgggugcuguggaucggggauguugccugucagccgaugacccccauuccugaagagacauuccucgagcugaaguccuuuagccagucugaauuucccgacaucugcaaaauugauggaaucguguuuaaucaaugugagggcgaaagccuuccucagcccuucgacgucgccuggauggauguggggcacucccauaagaucauuaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccuggugcauaagccuggggagguggucgugagcuacggaggcaugcgcguuagacccaaauguuacggguuuucccggaugauggccacccucgaagugaaccaaccugagcagcgcaucggacagugcacgggcugucaccuggaaugcauuaaugggggcgucagacuuaucacccugacaucugagcucaagagcgcgaccgugugugccucccauuucugcucuagcgcuacauccggaaagaaaagcaccgagauucaauuccacucuggcucccugguugggaagacggccauccacgugaaaggagcucuggucgauggcacagaauuuaccuucgaggggagcuguauguuucccgacggaugcgaugccguggacugcacauucugucgggaauuucucaagaacccccagugcuauccugcgaaaaaguggcuguucaucauuaucgucauucuucugggcuacgccgggcucaugcugcuuaccaaugugcugaaggcuaucggcauuuggggaucuuggguuaucgccccggugaaacucaucuuugcuauuaucaagaaacugaugcgcaccgucuccugucugaugggcaagcucauggauagagggagacaggugauucaugaggaaaucggagagaaccgggagggcaaucaggacgauguucgcauugaaauggcccggcccagacgcgugcggcacuggauguauagcccugucauccugacaauucuugccaucgggcuggcugagucuugcgacgaaauggugcaugcggauagcaaacucguguccuguagacaaggaagcggcaacaugaaggagugcguuacgaccgggcgcgcccugcuucccgcugucaauccuggccaggaggccugucugcacuucacagcccccggaucuccggacuccaagugccucaaaaucaaggugaaacggauuaaccugaaguguaaaaagagcuccucuuacuuugugccugaugcuagaagccgcugcaccuccguccggagaugucgcugggccggcgacugccagucugggugucccccucauuucacaagcaauuccuuuucugacgauugggcgggaaagauggaccgggcuggccugggguucagcggaugcuccgauggcugcgggggcgccgccuguggaugcuuuaacgcugcccccagcuguaucuucuggagaaaauggguggaaaauccucacggcauuaucuggaagguuucucccugcgcugccugggugccguccgcggucauugagcucaccaugccuagcggggaagugcggacguuccaccccaugucuggaauccccacacagguuuuuaaaggcguguccgucaccuaucuggggagcgacauggaggugucuggacuuaccgaucugugugaaaucgaggagcucaaguccaaaaagcuggcccuggcuccuugcaaccaagccggcaugggcguuguggggaaagucggagaaauucaguguagcuccgaggaaagcgcucgcacaaucaagaaggacggcugcauuuggaacgccgaucuuguggggaucgagcucagaguggacgaugcggucuguuacucuaaaauuaccagcguugaagccguggcuaauuauuccgccaucccgacaacgaucggaggccugcgguucgagagaucucaugacagccaggggaagauuuccggaucuccccuggauaucaccgcuauucgcggcagcuuuuccgugaacuaccggggccucagacugucucuuagcgagaucacagcuaccugcacaggggaagucaccaauguguccggaugcuacagcuguaugacgggcgccaaaguuucuauuaagcugcacuccagcaaaaacucuaccgcccaugugcgcugcaagggggacgagacagcguucuccguccucgaaggagugcacagcuauaccguuucccugucuuuugaucacgccguggucgacgagcagugucaacugaauugcggcgggcaugaaagccaggugacacuuaagggaaaccucaucuuccuggacguuccuaaauuuguggauggcuccuacaugcagaccuaucacagcacgguccccacaggcgcuaauaucccuucucccaccgacuggcugaacgcccucuucgggaauggacuguccagauggauucuuggccugaucggggugcuccugggaggccuggcccuuuucuucaugauuaugagccucuuuaagcuggggacaaaacagguguuccggucucgcaccaagcuggcuuga

SEQ ID NO: 14862 - RNA, 3222 nt, Artificial Sequence
  derived and/or modified CDS sequence (opt5) from SFTSV(HNXY_188)__KC292301.1__GP
augaugaaggugaucugguucagcucccugauuugccucgucauccaguguggcgggggaaccggccccauuaucugcgccgggccuauucacucuaacaaaagcgcugacaucccgcaucugcuuggauacuccgagaagaucugucaaauugauagacugauccacguuucuagcuggcuccggaaucauucccaguuucagggcuauguggggcagcgcggaggcagaucucaagugagcuacuaucccgccgaaaacuccuacagccgguggucuggccugcuuuccccuugcgacgcggauuggcuggggaugcucgucgugaaaaaggcuaaaggaagcgacaugauuguucccggcccuucuuauaaggggaagguguucuuugagcgccccacauucgauggauacgucggcuggggguguggauccggcaaaagcagaacggaaucuggcgagcugugcuccagcgacuccgggaccucuagcggacugcucccuuccgaucgggugcuguggaucggcgacguugccugucagccgaugacacccauuccugaagagaccuuucuugagcuuaagagcuucucucaguccgaauuucccgauaucugcaaaauugacgggaucguguucaaucagugugagggagaaagccucccucaacccuuugaugucgccuggauggacgugggccacucucauaagaucauuaugcgcgagcacaaaacaaagugggugcaggagagcuccucuaaggauuucgucugcuauaaagaagggaccggaccguguagcgaguccgaagagaagacaugcaaaaccagcggcucuugcagaggcgacaugcaguuuuguaagguugcugggugcgaacacggagaggaggccuccgaagcuaaaugucggugcagccuggugcauaagccuggcgagguggucgugucuuacgggggaaugcgcguuagacccaaauguuacggcuucucccggaugauggccacgcuugaagugagccagccugagcaacgcaucgggcagugcaccggcugucaccuggaaugcauuaacggaggcgucagacucaucacacugaccuccgagcugaagucugcgacagugugugccagccauuuuugcuccucugcuaccagcgggaagaaauccacggagauucaguuccacagcggaucucucguuggcaagacagccauccacgugaaaggggcucuggucgacggaaccgaguucacauuugaaggcuccuguauguuccccgaugggugcgacgccguggauugcaccuuuugucgggaguuccuuaagaauccccaaugcuauccugcgaaaaaguggcuguuuaucauuaucgucauucuccugggcuacgccggacuuaugcugcucaccaacgugcugaaggcuaucggcguuugggggagcugggugauugccccggucaaacugguguucgcuaucaucaagaaacucaugcgcgccguuucuugucugaugggaaagcugauggacagaggcagacaggugauucaugaagaaaucggggagaaucgggagggaaaccaggaugacguccgcauugaaauggcccggcccagacgcgugcggcacuggauguauuccccugugauccugacaauucucgcuaucggccuggcggaggggugcgaugaaaugguucaugccgacagcaaacuugucucuuguagacagggcagcggaaauaugaaggagugcgugacgaccggccgcgcucugcuccccgccgugaacccugggcaagaggccugucugcacuuuacagcucccggauccccggauagcaagugccugaaaauuaaggucaaacggaucaaucucaaguguaaaaagucuuccagcuacuucgugccugacgccagaucccgcugcaccucuguucggagaugucgcugggcgggcgauugccagagcgggugucccccucauuuuacauccaacucuuucagcgacgacugggcuggaaagauggaucgggccggccugggguuuuccggcugcucugacggaugcggcggggccgcuuguggaugcuucaaugccgcucccagcuguaucuuuuggagaaaauggguggaaaacccucacggcauuaucuggaaggucucccccugcgccgcgugggugccgagcgccguuauugagcuuaccaugccuucuggggaagugcggacguuccaccccauguccggaauccccacacaggucuucaaaggcgugagcguuaccuaucugggcucugauauggagguguccgggcucaccgaccugugugaaauugaggagcuuaagagcaaaaagcuggcucucgccccuugcaaucaggcuggaaugggcgucguggggaaagugggagaaauccaauguucuuccgaggaaagcgcccgcacaaucaagaaggauggcugcauuuggaacgcggaccuggucgggaucgagcugagaguugaugacgccguguguuacuccaaaauuaccagcguggaagcugucgccaacuauucugcuaucccgacaacgauuggaggccuccgguuugagagaagccaugauucccagggcaagaucucugggagcccccuggacaucaccgccauucgcggauccuucucugugaauuaccggggccuuagacugagccucuccgagaucacagcuaccugcacaggggaaguuaccaacgugucuggaugcuacagcuguaugacgggcgccaaagucuccauuaagcugcacagcucuaaaaauuccaccgcgcaugugcgcugcaagggggaugagacagccuuuagcguucuggaaggagugcacucuuauuccgucagccuuuccuucgaccacgcugugguugaugagcagugucagcucaacugcggcggccaugaaucucaagugacccugagagggaaucugaucuuucucgacgucccuaaguucguggacggaagcuacaugcagacauaucacuccaccgugcccacgggcgccaacauuccuagccccacagauuggcugaaugcccuuuuugggaacggacugucucgguggauccucggcgucaucgggguucugcugggaggccuugcucucuucuuucugauuaugucccuguucaaacucggcaccaagcagaucuuucgcagcagaacaaaacuggccuga

SEQ ID NO: 14863 - RNA, 3222 nt, Artificial Sequence
  derived and/or modified CDS sequence (opt5) from SFTSV(HNXY_191)__KC292323.1__GP
augaugaaggugaucugguucagcucccugauuugccucgucauccaguguggcggggacaccggacccauuaucugcgccggcccuacacacucuaacaaaagcgcugauauuccgcaucugcuuggguacuccgagaagaucugucaaaucgacagacugauucacguuucuagcuggcuccggaaucauucccaguuucagggauaugugggccagcgcgggggaagaucucaagugagcuacuaucccgccgaaaacuccuacagccgguggucuggccugcuuuccccuugcgaugcggacuggcugggcaugcucgucgugaaaaaggcuaaagggagcgauaugaucguucccggaccuucuuauaagggcaagguguucuuugagcgccccacguucgacggguacgucggauggggcuguggguccggaaaaagcagaaccgaaucuggcgagcugugcuccagcgauuccggcacaucuagcgggcugcucccuuccgaccgggugcuguggauuggagauguugccugucagccgaugacccccaucccugaagagacauuucuugagcuuaagagcuucucucaguccgaauuucccgacauuugcaaaaucgauggcauuguguucaaucagugugagggggaaagccucccucaacccuuugacgucgccuggauggaugugggacacucucauaagaucaucaugcgcgagcacaaaaccaagugggugcaggagagcuccucuaaggacuucgucugcuauaaagaaggcacagggccguguagcgaguccgaagagaagaccugcaaaacgagcggaucuugcagaggcgacaugcaguuuuguaagguugcuggcugcgaacacggggaggaggccuccgaagcuaaaugucggugcagccuggugcauaagccuggagagguggucgugucuuacggcgggaugcgcguuagacccaaauguuacggauucucccggaugauggccacccuugaagugagccagccugagcaacgcauuggccagugcacagggugucaccuggaaugcaucaacggcggagucagacucauuacccugacauccgagcugaagucugcgaccgugugugccagccauuuuugcuccucugcuacgagcggcaagaaauccacagagauccaguuccacagcgggucucucguuggaaagaccgccauucacgugaaaggcgcucuggucgaugggacagaguucaccuuugaaggauccuguauguuccccgacggcugcgaugccguggacugcaccuuuugucgggaguuccuuaagaauccccaaugcuauccugcgaaaaaguggcuguuuaucaucauugucauccuccugggguacgccggccuuaugcugcucacaaacgugcugaaggcuauuggaguuuggggcagcugggugaucgccccggucaaacugguguucgcuauuaucaagaaacucaugcgcgccguuucuugucugauggggaagcugauggauagaggaagacaggugauccaugaagaaauuggcgagaaucgggaggggaaccaggacgauguccgcaucgaaauggcccggcccagacgcgugcggcacuggauguauuccccugugauucugacgauccucgcuauuggacuggcggagggcugcgacgaaaugguucaugccgauagcaaacuugucucuuguagacaggggagcggcaauaugaaggagugcgugaccacaggacgcgcucugcuccccgccgugaacccuggccaagaggccugucugcacuuuaccgcucccggguccccggacagcaagugccugaaaaucaaggucaaacggauuaaucucaaguguaaaaagucuuccagcuacuucgugccugaugccagaucccgcugcacaucuguucggagaugucgcugggcgggagacugccagagcggcugucccccucauuuuaccuccaacucuuucagcgacgauugggcugggaagauggaccgggccggacugggcuuuuccgggugcucugauggcugcggaggcgccgcuugugggugcuucaaugccgcucccagcuguaucuuuuggagaaaauggguggaaaacccucacggaaucauuuggaaggucucccccugcgccgcgugggugccgagcgccguuaucgagcuuacgaugccuucuggcgaagugcggacauuccaccccauguccgggauucccacccaggucuucaaaggagugagcguuaccuaucugggcucugacauggagguguccggccucacagaucugugugaaaucgaggagcuuaagagcaaaaagcuggcucucgccccuugcaaucaggcugggaugggagucgugggcaaagugggggaaauucaauguucuuccgaggaaagcgcccgcaccaucaagaaggacggaugcaucuggaacgcggaucuggucggcauugagcugagaguugacgaugccguguguuacuccaaaaucacaagcguggaagcugucgccaacuauucugcuauuccgacgaccaucgggggacuccgguuugagagaagccaugacucccagggcaagauuucuggcagcccccuggauaucacagccauccgcggguccuucucugugaauuaccggggacuuagacugagccucuccgagauuaccgccacaugcaccggcgaaguuacgaacgugucugggugcuacagcuguaugaccggagcuaaagucuccaucaagcugcacagcucuaaaaauuccacagcgcaugugcgcugcaagggcgacgagaccgccuuuagcguucuggaaggggugcacucuuauuccgucagccuuuccuucgaucacgcugugguugacgagcagugucagcucaacugcggaggccaugaaucucaagugacacugagaggcaaucugauuuuucucgacgucccuaaguucguggaugggagcuacaugcagaccuaucacuccacggugcccacaggagccaacaucccuagccccaccgacuggcugaaugcccuuuuuggcaacgggcugucucgguggauucucggagucaucggcguucugcuugggggacuggcucucuucuuucugaucaugucccuguucaaacucggcacaaagcagauuuuucgcagcagaaccaaacuggccuga

SEQ ID NO: 14864 - RNA, 3222 nt, Artificial Sequence
  derived and/or modified CDS sequence (opt5) from SFTSV(HNXY_195)__KC292326.1__GP
augaugaaggugaucugguucagcucccugauuugcuuugucauccaguguucuggcgacagcgggcccauuaucugcgccggaccuauucacuccaacaaaucugcugauaucccgcaucuccaaggcuacagcgagaagaucugucagauugacagacugauccacguuuccucuuggcuucggaaucauagccaguuccagggguaugugggacaacgcggcgggagaucccaggugagcuacuaucccgccgaaaacucuuacucccgguggagcggacugcucucuccuugcgaugcggacuggcugggcaugcuugucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcugugcuccucugauagcggcacguccagcggccuccugccuucugaccgggugcuguggaucggggauguugccugucagccgaugacccccauuccugaagagacauuccucgagcugaaguccuuuagccagucugaguuccccgacaucugcaaaauugauggaaucguguuuaaucaaugugaaggcgaaagccuuccucagcccuucgacgucgccuggauggauguggggcacucccauaagaucauuaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccuggugcauaagccuggggagguggucgugagcuacggaggcaugcgcguuagacccaaauguuacggguuuucccggaugauggccacccucgaagugaaccaaccugagcagcgcaucggacagugcacgggcugucaccuggaaugcauuaaugggggcgucagacuuaucacccugacaucugagcucaagagcgcgaccgugugugccucccauuucugcucuagcgcuacauccggaaagaaaagcaccgagauucaauuccacucuggcucccugguugggaagacggccauccacgugaaaggagcucuggucgauggcacagaauuuaccuucgaggggagcuguauguuucccgacggaugcgaugccguggacugcacauucugucgggaauuucucaagaacccccagugcuauccugcgaaaaaguggcuguucaucauuaucgucauucuucugggcuacgccgggcucaugcugcuuaccaaugugcugaaggcuaucggcauuuggggaucuuggguuaucgccccggugaaacucaucuuugcuauuaucaagaaacugaugcgcaccgucuccugucugaugggcaagcucauggauagagggagacaggugauucaugaggaaaucggagagaaccgggagggcaaucaggacgauguucgcauugaaauggcccggcccagacgcgugcggcacuggauguauagcccugucauccugacaauucuugccaucgggcuggcugagucuugcgacgaaauggugcaugcggauagcaaacucguguccuguagacaaggaagcggcaacaugaaggagugcguuacgaccgggcgcgcccugcuucccgcugucaauccuggccaggaggccugucugcacuucacagcccccggaucuccggacuccaagugccucaaaaucaaggugaaacggauuaaccugaaguguaaaaagagcuccucuuacuuugugccugaugcuagaagccgcugcaccuccguccggagaugucgcugggccggcgacugccagucugggugucccccucauuucacaagcaauuccuuuucugacgauugggcgggaaagauggaccgggcuggccugggguucagcggaugcuccgauggcugcgggggcgccgccuguggaugcuuuaacgcugcccccagcuguaucuucuggagaaaauggguggaaaauccucacggcauuaucuggaagguuucucccugcgcugccugggugccguccgcggucauugagcucaccaugccuagcggggaagugcggacguuccaccccaugucuggaauccccacacagguuuuuaaaggcguguccgucaccuaucuggggagcgacauggaggugucuggacuuaccgaucugugugaaaucgaggagcucaaguccaaaaagcuggcccuggcuccuugcaaccaagccggcaugggcguuguggggaaagucggagaaauucaguguagcuccgaggaaagcgcucgcacaaucaagaaggacggcugcauuuggaacgccgaucuuguggggaucgagcucagaguggacgaugcggucuguuacucuaaaauuaccagcguugaagccguggcuaauuauuccgccaucccgacaacgaucggaggccugcgguucgagagaucucaugacagccaggggaagauuuccggaucuccccuggauaucaccgcuauucgcggcagcuuuuccgugaacuaccggggccucagacugucucuuagcgagaucacagcuaccugcacaggggaagucaccaauguguccggaugcuacagcuguaugacgggcgccaaaguuucuauuaagcugcacuccagcaaaaacucuaccgcccaugugcgcugcaagggggacgagacagcguucuccguccucgaaggagugcacagcuauaccguuucccugucuuuugaucacgccguggucgacgagcagugucaacugaauugcggcgggcaugaaagccaggugacacuuaagggaaaccucaucuuccuggacguuccuaaauuuguggauggcuccuacaugcagaccuaucacagcacgguccccacaggcgcuaauaucccuucucccaccgacuggcugaacgcccucuucgggaauggacuguccagauggauucuuggcgugaucggggugcugcucggaggccuggcccuguuuuucaugauuaugagccuuuuuaagcucgggacaaaacaggucuuccggucucgcaccaagcuggcuuga

SEQ ID NO: 14865 - RNA, 3222 nt, Artificial Sequence
  derived and/or modified CDS sequence (opt5) from SFTSV(HNXY_2)__KC292318.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuccuggagcuuaaguccuuuagccagucugaguuccccgacaucugcaaaauugauggaaucguguuuaaucagugugaaggcgaaagccugccucaacccuucgacgucgccuggauggauguggggcacucccauaagaucauuaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcguuagacccaaauguuacggguuuucccggaugauggccacccuggaagugaaccagccugagcaacgcaucggacagugcacgggcugucaccuugaaugcauuaaugggggcgucagacugaucacccucacaucugagcucaagagcgcgaccgugugugccucccauuucugcucuagcgcuacauccggaaagaaaagcaccgagauucaguuccacucuggcucccugguugggaagacggccauccacgugaaaggagcucuggucgauggcacagaauuuaccuucgaggggagcuguauguuucccgacggaugcgaugccguggacugcacauucugucgggaauuucugaagaacccccaaugcuauccugcgaaaaaguggcuuuucaucauuaucgucauucugcucggcuacgccgggcugaugcuucugaccaaugugcucaaggcuaucggcauuuggggaucuuggguuaucgccccggugaaacugaucuuugcuauuaucaagaaacugaugcgcaccgucuccugucucaugggcaagcugauggauagagggagacaggugauucaugaggaaaucggagagaaccgggagggcaaucaggacgauguucgcauugaaauggcccggcccagacgcgugcggcacuggauguauagcccugucauccuuacaauucuggccaucgggcucgcugagucuugcgacgaaauggugcaugcggauagcaaacugguguccuguagacagggaagcggcaacaugaaggagugcguuacgaccgggcgcgcccuucugcccgcugucaauccuggccaagaggccugucuccacuucacagcccccggaucuccggacuccaagugccugaaaaucaaggugaaacggauuaaccugaaguguaaaaagagcuccucuuacuuugugccugaugcuagaagccgcugcaccuccguccggagaugucgcugggccggcgacugccagucugggugucccccucauuucacaagcaauuccuuuucugacgauugggcgggaaagauggaccgggcuggccucggguucagcggaugcuccgauggcugcgggggcgccgccuguggaugcuuuaacgcugcccccagcuguaucuucuggagaaaauggguggaaaauccucacggcauuaucuggaagguuucucccugcgcugccugggugccguccgcggucauugagcugaccaugccuagcggggaagugcggacguuccaccccaugucuggaauccccacacagguuuuuaaaggcguguccgucaccuaucuugggagcgacauggaggugucuggacugaccgaucucugugaaaucgaggagcugaaguccaaaaagcuggcccuugcuccuugcaaccaggccggcaugggcguuguggggaaagucggagaaauucaauguagcuccgaggaaagcgcucgcacaaucaagaaggacggcugcauuuggaacgccgaucucguggggaucgagcugagaguggacgaugcggucuguuacucuaaaauuaccagcguugaagccguggcuaauuauuccgccaucccgacaacgaucggaggccugcgguucgagagaucucaugacagccaggggaagauuuccggaucuccccucgauaucaccgcuauucgcggcagcuuuuccgugaacuaccggggccugagacuuucucugagcgagaucacagcuaccugcacaggggaagucaccaauguguccggaugcuacagcuguaugacgggcgccaaaguuucuauuaagcuccacuccagcaaaaacucuaccgcccaugugcgcugcaagggggacgagacagcguucuccguccuggaaggagugcacagcuauaccguuucccugucuuuugaucacgccguggucgacgagcagugucagcuuaauugcggcgggcaugaaagccaagugacacucaagggaaaccugaucuuccuggacguuccuaaauuuguggauggcuccuacaugcagaccuaucacagcacgguccccacaggcgcuaauaucccuucucccaccgacuggcucaacgcccuguucgggaauggaauguccagauggauucuuggcgugaucggggugcugcucggaggccuggcccuguuuuucaugauuaugagccuuuuuaagcucgggacaaaacaggucuuccggucucgcaccaagcuggcuuga

SEQ ID NO: 14866 - RNA, 3222 nt, Artificial Sequence
  derived and/or modified CDS sequence (opt5) from SFTSV(HNXY_202)__KC292325.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucuaaucgggugcucuggaucggggacguugccugucagccgaugacccccauuccugaagagacauuccuggagcuuaaguccuuuagccagucugaauuucccgauaucugcaaaauugacggaaucguguuuaaccagugugagggcgaaagccugccucaacccuucgaugucgccuggauggacguggggcacucccauaagaucauuaugcgcgagcacaaaaccaagugggugcaggagucuagcuccaaggauuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcguuagacccaaauguuacggguuuucccggaugauggccacccuggaagugaaucagccugagcaacgcaucggacagugcacgggcugucaccuugaaugcauuaacgggggcgucagacugaucacccucacaucugagcugaagucugcgaccgugugugccucccauuucugcucuagcgcuacauccggaaagaaaagcaccgagauucaguuccacucuggcucccugguugggaagacggccauccacgugaaaggagcucucgucgacggcacagaauuuaccuucgaggggagcuguauguuucccgauggaugcgacgccguggauugcacauucugucgggaauuucugaagaauccccaaugcuauccugcgaaaaaguggcuuuucaucauuaucgucauucugcucggcuacgccgggcugaugcuucugaccaacgugcucaaggcuaucggcauuuggggaucuuggguuaucgccccggugaaacugaucuuugcuauuaucaagaaacugaugcgcaccgucuccugucucaugggcaagcugauggacagagggagacaggugauucaugaggaaaucggagagaaucgggagggcaaccaggaugacguucgcauugaaauggcccggcccagacgcgugcggcacuggauguauagcccugucauccuuacaauucuggccaucgggcucgcugagucuugcgaugaaauggugcaugcggacagcaaacugguguccuguagacagggaagcggcaauaugaaggagugcguuacgaccgggcgcgcccuucugcccgcugucaacccuggccaagaggccugucuccacuucacagcccccggaucuccggauuccaagugccugcggaucaaagugaagaaaauuaaucugaaguguaaaagaagcuccucuuacuuugugccugacgcucgcagccggugcaccuccgucagacgcugucggugggccggcgauugccagucugggugucccccucauuucacaagcaacuccuuuucugacgacugggcgggaaagauggauagagcuggccucggguucagcggaugcuccgacggcugcgggggcgccgccuguggaugcuuuaaugcugcccccagcuguaucuucuggcggaaguggguggaaaacccucacggcauuaucuggaaaguuucucccugcgcugccugggugccguccgcggucauugagcugaccaugccuagcggggaagugcgcacguuccaccccaugucuggaauccccacacagguuuuuaagggcguguccgucaccuaucuugggagcgauauggaggugucuggacugaccgaccucugugaaaucgaggagcugaaauccaagaaacuggcccuugcuccuugcaaccaggccggcaugggcguuguggggaaggucggagaaauucaauguagcuccgaggaaagcgcuagaacaaucaaaaaggauggcugcauuuggaaugccgaccucguggggaucgagcugcggguggaugacgcggucuguuacucuaagauuaccagcguugaagccguggcuaacuauuccgccaucccgacaacgaucggaggccugagauucgagcgcucucaugauagccaggggaaaauuuccggaucuccccucgacaucaccgcuauucggggcagcuuuuccgugaauuacagaggccugcgccuuucucugagcgagaucacagcuaccugcacaggggaagucaccaacguguccggaugcuacagcuguaugacgggcgccaagguuucuauuaaacuccacuccagcaagaauagcaccgcccaugugagaugcaaaggggaugagacagcguucuccguccuggaaggagugcacagcuauaccguuucccugucuuuugaccacgccguggucgaugagcagugucagcuuaacugcggcgggcaugaaagccaagugacacucaagggaaaucugaucuuccuggacguuccuaaguuuguggacggcuccuacaugcagaccuaucacagcacgguccccacaggcgcuaacaucccuucucccaccgauuggcucaaugcccuguucgggaacggacuuucccgguggauucugggcgugaugggggugcuccugggaggccuggcccuuuucuucaugaucaugagccucuuuaaacuggggacaaagcaggucuuccgcucuagaaccaaacuggcuuga

SEQ ID NO: 14867 - RNA, 3222 nt, Artificial Sequence
  derived and/or modified CDS sequence (opt5) from SFTSV(HNXY_206)__KC292302.1__GP
augaugaaggugaucugguucagcucccugauuugccucgucauccaguguggcggggacaccggacccauuaucugcgccggcccuauucacucuaacaaaagcgcugauaucccgcaucugcuuggguacuccgagaagaucugucaaauugacagacugauccacguuucuagcuggcuccggaaucauucccaguuucagggauaugugggccagcgcgggggaagaucucaagugagcuacuaucccgccgaaaacuccuacagccgguggucuggccugcuuuccccuugcgaugcggacuggcugggcaugcucgucgugaaaaaggcuaaagggagcgauaugauuguucccggaccuucuuauaagggcaagguguucuuugagcgccccacauucgacggguacgucggauggggcuguggguccggaaaaagcagaacggaaucuggcgagcugugcuccagcgauuccggcaccucuagcgggcugcucccuuccgaccgggugcuguggaucggagauguugccugucagccgaugacacccauuccugaagagaccuuucuugagcuuaagagcuucucucaguccgaauuucccgacaucugcaaaauugauggcaucguguucaaucagugugagggggaaagccucccucaacccuuugacgucgccuggauggaugugggacacucucauaagaucauuaugcgcgagcacaaaacaaagugggugcaggagagcuccucuaaggacuucgucugcuauaaagaaggcaccgggccguguagcgaguccgaagagaagacaugcaaaaccagcggaucuugcagaggcgacaugcaguuuuguaagguugcuggcugcgaacacggggaggaggccuccgaagcuaaaugucggugcagccuggugcauaagccuggagagguggucgugucuuacggcgggaugcgcguuagacccaaauguuacggauucucccggaugauggccacgcuugaagugagccagccugagcaacgcaucggccagugcaccgggugucaccuggaaugcauuaacggcggagucagacucaucacacugaccuccgagcugaagucugcgacagugugugccagccauuuuugcuccucugcuaccagcggcaagaaauccacggagauucaguuccacagcgggucucucguuggaaagacagccauccacgugaaaggcgcucuggucgaugggaccgaauuuacauuugagggauccuguauguuccccgacggcugcgaugccguggacugcaccuuuugucgggaguuccuuaagaauccccaaugcuauccuaccaaaaaguggcuguuuaucauuaucgucauucuccugggguacgcgggccuuaugcugcucacaaacgugcugaaggccaucggaguuuggggcagcugggugauugcuccggucaaacugguguucgccaucaucaagaaacucaugcgcgcuguuucuugucugauggggaagcugauggauagaggaagacaggugauucaugaagaaaucggcgagaaucgggaggggaaccaggacgauauucgcaucgaaauggcccggcccagacgcguccggcacuggauguauuccccugugauucugacgauccucgccauuggacuggcugagggcugcgacgaaauggugcaugcggauagcaaacuuguuucuuguagacaggggagcggcaauaugaaggagugcgucaccacaggacgcgcccugcuccccgcugugaacccuggccaagaggccugucugcacuuuaccacacccggguccccggacagcaagugccugaaaaucaaggugaaacggaucaaucucaaguguaaaaagucuuccagcuacuucgucccugaugccagaucccgcugcaccucugugcggagaugucgcugggcuggagacugccagagcggcugucccccucauuuuacguccaacucuuucagcgacgauugggccgggaagauggaccgggcgggacugggcuuuuccgggugcucugauggcugcggaggcgcugccugugggugcuucaaugccgcucccagcuguauuuucuggagaaaauggguugaaaacccucacggaaucauuuggaaggugucccccugcgccgcuugggucccgagcgccgugaucgagcuuacaaugccuucuggcgaaguucggaccuuccaccccauguccgggauucccacccagguguucaaaggagucagcgugacauaucugggcucugacauggagguuuccggccucaccgaucugugugaaaucgaggagcuuaagagcaaaaagcuggcgcucgccccuugcaaucaggcugggaugggaguggucggcaaagugggggaaauccaauguucuuccgaggaaagcgcccgcacaauuaagaaggacggaugcaucuggaacgcugaucuggugggcauugagcugagagucgacgaugccguuuguuacuccaaaaucacgagcguggaagcgguggccaacuauucugcuauuccgaccacaaucgggggacuccgguuugagagaagccaugacucccagggcaagaucucuggcagcccccuggauauuaccgccauccgcggguccuucucugucaauuaccggggacuuagacugagccucuccgagauuacagcuaccugcacgggcgaagugaccaacguuucugggugcuacagcuguaugacaggagccaaaguguccaucaagcugcacagcucuaaaaauuccaccgcccauguccgcugcaagggcgacgagacagcuuuuagcgugcuggaagggguucacucuuauuccgugagccuuuccuucgaucacgcggucguggacgagcagugucagcucaacugcggaggccaugaaucucaaguuacccugagaggcaaucugauuuuucucgacgugccuaaguucgucgaugggagcuacaugcagacguaucacuccacagugcccaccggagccaacaucccuagccccacagacuggcugaaugcucuuuuuggcaacgggcugucucgguggauccucggagugauuggcguccugcuugggggacuggcccucuucuuucugaucaugucccuguucaaacucggcaccaagcagauuuuucgcagcagaaccaaacuggccuga

SEQ ID NO: 14868 - RNA, 3222 nt, Artificial Sequence
  derived and/or modified CDS sequence (opt5) from SFTSV(HNXY_207)__KC292315.1__GP
augaugaaggugaucugguuccccagccugauuugcuuugucauccaguguuccggcgacucugggccuauuaucugcgccggaccgauucacagcaacaaauccgcugauaucccccaucuccugggcuacucugagaagaucugucaaauugacagacuuauccacguuagcuccuggcugcggaaucauucucaguuccagggguaugugggacagcgcggcgggagaagccaaguguccuacuauccugccgaaaacagcuacucucggugguccggacuccugagccccugcgaugcggacuggcuuggcaugcuggucgugaaaaaggcuaaaggcucugauaugauuguuccugggcccuccuauaagggaaagguguuuuucgagcgcccuaccuuugacggcuacgucggguggggauguggcagcgggaaaucuagaacagaauccggagagcucugcagcuccgauucuggcacgagcuccggccugcugccgagcgaccgggugcucuggaucggggauguugccugucagcccaugaccccuauucccgaagagacauuccuggagcuuaagucuuuuucccagagcgaauuuccugacaucugcaaaauugauggaaucguguuuaaucagugugagggcgaaucucugccccaaccguucgacgucgccuggauggauguggggcacagccauaagaucauuaugcgcgagcacaaaaccaagugggugcaggaguccucuagcaaggacuuugucugcuauaaagaaggaacaggcccuuguuccgagagcgaagagaagaccugcaaaacaucuggguccugcagaggagacaugcaguucuguaagguugcuggcugcgaacacggcgaggaggccagcgaagcuaaaugucggugcucucucgugcauaagcccggggagguggucguguccuacggaggcaugcgcguuagaccuaaauguuacggguuuagccggaugauggccacccuggaagugaaccagcccgagcaacgcaucggacagugcacgggcugucaccuugaaugcauuaaugggggcgucagacugaucacccucacauccgagcugaagucugcgaccgugugugccagccauuucugcuccucugcuacaagcggaaagaaauccaccgagauucaguuccacagcggcucucugguugggaagacggccauccacgugaaaggagcucucgucgauggcacagaauuuaccuucgagggguccuguauguuucccgacggaugcgaugccguggacugcacauucugucgggaauuucugaagaacccucaaugcuauccggcgaaaaaguggcuuuucaucauuaucgucauucugcucggcuacgccgggcugaugcuucugaccaaugugcucaaggcuaucggcauuuggggaagcuggguuaucgcccccgugaaacugauguuugcuaucauuaagaaacugaugcgcaccgucucuugucucaugggcaagcugauggauagagggagacaggugauccaugaggaaauuggagagaaccgggagggcaaucaggacgauguucgcaucgaaauggcccggccuagacgcgugcggcacuggauguauucccccgucauucuuacaauccuggccauugggcucgcugagagcugcgacgaaauggugcaugcggauucuaaacuggugagcuguagacagggauccggcaacaugaaggagugcguuacgaccgggcgcgcccuucugccugcugucaaucccggccaagaggccugucuccacuucacagccccgggaagcccugacucuaagugccugaaaaucaaggugaaacggaucaaccugaaguguaaaaaguccagcuccuacuuugugcccgaugcuagaucucgcugcaccagcguccggagaugucgcugggccggcgacugccaguccgggugcccuccccauuucacaucuaauagcuuuuccgacgauugggcgggaaagauggaccgggcuggccucggguucucuggauguagcgauggcugcgggggcgccgccuguggaugcuuuaacgcugccccuuccuguauuuucuggagaaaauggguggaaaauccccacggcaucauuuggaagguuagcccgugcgcugccugggugccuucugcggucaucgagcugaccaugcccuccggggaagugcggacguuccaccccaugagcggcauuccuacacagguuuuuaaaggagugucugucaccuaucuuggguccgacauggaggugagcggacugaccgaucucugugaaaucgaggagcugaagucuaaaaagcuggcccuugcuccgugcaaccaggccggcaugggcguuguggggaaagucggagaaauccaauguuccagcgaggaauccgcucgcacaauuaagaaggacggcugcaucuggaacgccgaucucguggggauugagcugagaguggacgaugcggucuguuacagcaaaaucaccucuguugaagccguggcuaauuauagcgccauucccacaacgaucggaggccugcgguucgagagaucccaugacucucaggggaagaucagcggauccccucucgauauuaccgcuauccgcggcucuuuuagcgugaacuaccggggccugagacuuucccugucugagauuacagcuaccugcacaggggaagucaccaaugugagcggaugcuacuccuguaugacgggcgccaaaguuagcaucaagcuccacucuuccaaaaacagcaccgcccaugugcgcugcaagggggacgagacagcguucucuguccuggaaggagugcacuccuauaccguuagccuguccuuugaucacgccguggucgacgagcagugucagcuuaauugcggcgggcaugaaucucaagugacacucaagggaaaccugauuuuccuggacguucccaaauuuguggauggcagcuacaugcagaccuaucacuccacggucccuacaggcgcuaauauccccagcccuaccgacuggcucaacgcccuguucgggaauggacuuucuagauggauccugggcgugauuggggugcuccugggaggccuggcccuuuucuucaugaucaugucccucuuuaagcuggggacaaaacaggucuuccggagccgcaccaagcuggcuuga

SEQ ID NO: 14869 - RNA, 3222 nt, Artificial Sequence
  derived and/or modified CDS sequence (opt5) from SFTSV(HNXY_224)__KC292317.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuccuggagcuuaaguccuuuagccagucugaguuccccgacaucugcaaaauugauggaaucguguuuaaucagugugaaggcgaaagccugccucaacccuucgacgucgccuggauggauguggggcacucccauaagaucauuaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcguuagacccaaauguuacggguuuucccggaugauggccacccuggaagugaaccagccugagcaacgcaucggacagugcacgggcugucaccuugaaugcauuaaugggggcgucagacugaucacccucacaucugagcuuaagagcgcgaccgugugugccucccauuucugcucuagcgcuacauccggaaagaaaagcaccgagauucaguuccacucuggcucccugguugggaagacggccauccacgugaaaggagcucucgucgauggcacagaauuuaccuucgaggggagcuguauguuucccgacggaugcgaugccguggacugcacauucugucgggaauuucugaagaacccccaaugcuauccugcgaaaaaguggcuuuucaucauugucgugauccugcucggcuacgccgggcugaugcuucugaccaauguucucaaggcuauuggcaucuggggaucuugggugauugccccggucaaacugauguuugcuaucaucaagaaacugaugcgcaccguguccugucucaugggcaagcugauggauagagggcggcagguuauucaugaggaaaucggagagaacagagagggcaaucaggacgaugugcgcauugaaauggcccggcccagacgcguccggcacuggauguauagcccugugauccuuacaauucuggccaucgggcucacggagucuugcgacgaaauggugcaugcugauagcaaacugguuuccuguagacagggaagcggcaacaugaaggagugcgucaccacagggcgcgcgcuucugcccgccgugaauccuggccaagaggcuugucuccacuucaccgcccccggaucuccggacuccaagugccugaaaauuaaggugaaacggaucaaccugaaguguaaaaagagcuccucuuacuuugucccugaugccagaagccgcugcacauccgugcggagaugucgcugggcuggcgacugcgaaucugggugucccccucauuucaccagcaauuccuuuucugacgauugggccggaaagauggaccgggcgggccucggguucagcggaugcuccgauggcugcgggggcgcugccuguggaugcuuuaacgccgcucccagcuguaucuucuggagaaaauggguugagaauccucacggcauuaucuggaaggugucucccugcgccgcuugggucccguccgccgugauugaacugacgaugccuagcggggagguucggacauuccagcccaugucuggaauccccacccagguguuuaaaggcgucuccgugaccuaucuugggagcgacauggaaguuucuggacugacagaucucugugagauugaggaacugaaguccaaaaagcuggcgcuugccccuugcaaccaggcuggcaugggcguggucgggaaagugggagagauccaauguagcuccgaagagagcgcccgcaccaucaagaaggacggcugcauuuggaacgcugaucucguggggaucgaacugagagucgacgaugccguuuguuacucuaaaauuacaagcguggaggcgguggccaauuauuccgcuaucccgacgaccauuggaggccugcgguucgagagaucucacgacagccaggggaagaucuccggaucuccccucgauaucacagccauucgcggcagcuuuuccgucaacuaccggggccugagacuuucucugagcgaaaucaccgcuacaugcaccggggaggugacgaauguuuccggaugcuacagcuguaugaccggcgccaaagugucuauuaagcuccauuccagcaaaaacucuacagcccacguccgcugcaagggggacgaaaccgcuuucuccgugcuggagggaguucauagcuauacagugucccugucuuuugaucacgcggucguggacgaacagugucagcuuaauugcggcgggcacgagagccaaguuacccucaagggaaaccugaucuuccuggacgugccuaaauuugucgauggcuccuacaugcagacguaucauagcacagugcccaccggcgccaauauuccuucucccacagacuggcucaacgcucuguucgggaauggacuuuccagauggauccugggcgugaucgggguccuccugggaggccuggcccuguuuuucaugauuaugagccucuuuaagcuggggaccaaacagguuuuccggucucgcaccaagcuggccuga

SEQ ID NO: 14870 - RNA, 3222 nt, Artificial Sequence
  derived and/or modified CDS sequence (opt5) from SFTSV(HNXY_231)__KC292313.1__GP
augaugaaggugaucugguucagcucccugauuugcuuugucauccaguguucuggcgacagcgggcccauuaucugcgccggaccuauucacuccaacaaaucugcuggcaucccgcaucuccugggguacagcgagaagaucugucaaauugauagacuuauccacguuuccucuuggcugcggaaucauagccaguuccagggauaugugggccagcgcgggggaagaucccaagugagcuacuaucccgccgaaaacucuuacucccgguggagcggccuccugucuccuugcgacgcggauuggcuuggcaugcuggucgugaaaaaggcuaaaggguccgacaugauuguucccggaccuagcuauaagggcaagguguuuuucgagcgccccaccuuugauggguacgucggauggggcugugggucuggaaaauccagaacagaaagcggcgagcucugcuccucugacagcggcacguccagcgggcugcugccuucugaucgggugcucuggaucggagacguugccugucagccgaugacccccauuccugaagagacauuccuggagcuuaaguccuuuagccagucugaguuccccgauaucugcaaaauugacggcaucguguuuaaucagugugaaggggaaagccugccucaacccuucgaugucgccuggauggacgugggacacucccauaagaucauuaugcgcgagcacaaaaccaagugggugcaggagucuagcuccaaggauuuugucugcuauaaagaaggcacagggccguguagcgagucugaagagaagaccugcaaaacauccggaagcugcagaggcgacaugcaguucuguaagguugcuggcugcgaacacggggaggaggccucugaagcuaaaugucggugcucccucgugcauaagccuggagagguggucgugagcuacggcgggaugcgcguuagacccaaauguuacggauuuucccggaugauggccacccuggaagugaaccagccugagcaacgcaucggccagugcacggggugucaccuugaaugcauuaauggcggagucagacugaucacccucacaucugagcuuaagagcgcgaccgugugugccucccauuucugcucuagcgcuacauccggcaagaaaagcaccgagauucaguuccacucugggucccugguuggaaagacggccauccacgugaaaggcgcucucgucgacgggacagaauuuaccuucgagggaagcuguauguuucccgauggcugcgacgccguggauugcacauucugucgggaauuucugaagaacccccaaugcuauccugcgaaaaaguggcuuuucaucauuaucgucauucugcucggguacgccggccugaugcuucugaccaaugugcucaaggcuaucggaauuuggggcucuuggguuaucgccccggugaaacugaucuuugcuauuaucaagaaacugaugcgcaccgucuccugucucauggggaagcugauggacagaggaagacaggugauucaugaggaaaucggcgagaaccgggaggggaaucaggaugacguucgcauugaaauggcccggcccagacgcgugcggcacuggauguauagcccugucauccuuacaauucuggccaucggacucgcugagucuugcgaugaaauggugcaugcggacagcaaacugguguccuguagacagggcagcgggaacaugaaggagugcguuacgaccggccgcgcccuucugcccgcugucaauccuggacaagaggccugucuccacuucacagcccccggcucuccggauuccaagugccugaaaaucaaggugaaacggauuaaccugaaguguaaaaagagcuccucuuacuuugugccugacgcuagaagccgcugcaccuccguccggagaugucgcugggccggggauugccagucuggaugucccccucauuucacaagcaauuccuuuucugacgacugggcgggcaagauggaucgggcugggcucggauucagcggcugcuccgacgggugcggcggagccgccuguggcugcuuuaacgcugcccccagcuguaucuucuggagaaaauggguggaaaauccucacgggauuaucuggaagguuucucccugcgcugccugggugccguccgcggucauugagcugaccaugccuagcggagaagugcggacguuccaccccaugucuggcauccccacacagguuuuuaaagggguguccgucaccuaucuuggaagcgauauggaggugucuggccugaccgaccucugugaaaucgaggagcugaaguccaaaaagcuggcccuugcuccuugcaaccaggccggcauggggguugugggaaaagucggcgaaauucaauguagcuccgaggaaagcgcucgcacaaucaagaaggaugggugcauuuggaacgccgaccucgugggaaucgagcugagaguggaugacgcggucuguuacucuaaaauuaccagcguugaagccguggcuaauuauuccgccaucccgacaacgaucggcgggcugcgguucgagagaucucaugauagccagggaaagauuuccggcucuccccucgacaucaccgcuauucgcggcagcuuuuccgugaacuaccgggggcugagacuuucucugagcgagaucacagcuaccugcacaggagaagucaccaauguguccggcugcuacagcuguaugacgggggccaaaguuucuauuaagcuccacuccagcaaaaacucuaccgcccaugugcgcugcaagggagaugagacagcguucuccguccuggaaggcgugcacagcuauaccguuucccugucuuuugaccacgccguggucgaugagcagugucagcuuaauugcgggggacaugaaagccaagugacacucaagggcaaccugaucuuccuggacguuccuaaauuuguggacggcuccuacaugcagaccuaucacagcacgguccccacaggggcuaauaucccuucucccaccgauuggcucaacgcccuguucggaaauggccuuuccagauggauucugggggugaucggagugcuccugggcgggcuggcccuguuuuucaugauuaugagccucuuuaagcugggaacaaaacaggucuuccggucucgcaccaagcuggcuuga

SEQ ID NO: 14871 - RNA, 3222 nt, Artificial Sequence
  derived and/or modified CDS sequence (opt5) from SFTSV(HNXY_245)__KC292320.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucuaaucgggugcucuggaucggggacguugccugucagccgaugacccccauuccugaagagacauuccuggagcuuaaguccuuuagccagucugaauuucccgauaucugcaaaauugacggaaucguguuuaaccagugugagggcgaaagccugccucaacccuucgaugucgccuggauggacguggggcacucccauaagaucauuaugcgcgagcacaaaaccaagugggugcaggagucuagcuccaaggauuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcguuagacccaaauguuacggguuuucccggaugauggccacccuggaagugaaucagccugagcaacgcaucggacagugcacgggcugucaccuugaaugcauuaacgggggcgucagacugaucacccucacaucugagcugaagucugcgaccgugugugccucccauuucugcucuagcgcuacauccggaaagaaaagcaccgagauucaguuccacucuggcucccugguugggaagacggccauccacgugaaaggagcucucgucgacggcacagaauuuaccuucgaggggagcuguauguuucccgauggaugcgacgccguggauugcacauucugucgggaauuucugaagaauccccaaugcuauccugcgaaaaaguggcuuuucaucauuaucgucauucugcucggcuacgccgggcugaugcuucugaccaacgugcucaaggcuaucggcauuuggggaucuuggguuaucgccccggugaaacugaucuuugcuauuaucaagaaacugaugcgcaccgucuccugucucaugggcaagcugauggacagagggagacaggugauucaugaggaaaucggagagaaucgggagggcaaccaggaugacguucgcauugaaauggcccggcccagacgcgugcggcacuggauguauagcccugucauccuuacaauucuggccaucgggcucgcugagucuugcgaugaaauggugcaugcggacagcaaacugguguccuguagacagggaagcggcaauaugaaggagugcguuacgaccgggcgcgcccuucugcccgcugucaacccuggccaagaggccugucuccacuucacagcccccggaucuccggauuccaagugccugcggaucaaagugaagagaauuaaucugaaauguaagaaaagcuccucuuacuuugugccugacgcucgcagccggugcaccuccgucagacgcugucggugggccggcgauugccagucugggugucccccucauuucacaagcaacuccuuuucugacgacugggcgggaaagauggauagagcuggccucggguucagcggaugcuccgacggcugcgggggcgccgccuguggaugcuuuaaugcugcccccagcuguaucuucuggcggaaguggguggaaaacccucacggcauuaucuggaaaguuucucccugcgcugccugggugccguccgcggucauugagcugaccaugccuagcggggaagugcgcacguuccaccccaugucuggaauccccacacagguuuuuaagggcguguccgucaccuaucuugggagcgauauggaggugucuggacugaccgaccucugugaaaucgaggagcugaaauccaagaaacuggcccuugcuccuugcaaccaggccggcaugggcguuguggggaaggucggagaaauucaauguagcuccgaggaaagcgcuagaacaaucaaaaaggauggcugcauuuggaaugccgaccucguggggaucgagcugcggguggaugacgcggucuguuacucuaagauuaccagcguugaagccguggcuaacuauuccgccaucccgacaacgaucggaggccugagauucgagcgcucucaugauagccaggggaaaauuuccggaucuccccucgacaucaccgcuauucggggcagcuuuuccgugaauuacagaggccugcgccuuucucugagcgagaucacagcuaccugcacaggggaagucaccaacguguccggaugcuacagcuguaugacgggcgccaagguuucuauuaaacuccacuccagcaagaauagcaccgcccaugugagaugcaaaggggaugagacagcguucuccguccuggaaggagugcacagcuauaccaucucccugucuuuugaccacgccguuguggaugagcagugucagcuuaacugcggcgggcaugaaagccaagucacacucaagggaaaucugaucuuccuggacgugccuaaguuuguugacggcuccuacaugcagaccuaucacagcacggugcccacaggcgcuaacauuccuucucccaccgauuggcucaaugcccuguucgggaacggacuuucccgguggauccugggcgucaugggggugcuccugggaggccuggcccuuuucuucaugauuaugagccucuuuaaacuggggacaaaacagguguuccgcucuagaaccaagcuggcuuga

SEQ ID NO: 14872 - RNA, 3222 nt, Artificial Sequence
  derived and/or modified CDS sequence (opt5) from SFTSV(HNXY_262)__KC292309.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccgggugagcuacuaucccgccgaaaacucuuacucccgcuggagcggacuccugucuccuugcgaugcggacuggcuuggcaugcuggucgugaaaaaggcuaaaggcuccgauaugauuguucccgggccuagcuauaagggaaagguguuuuucgagagacccaccuuugacggcuacgucggguggggauguggcucugggaaaucccggacagaaagcggagagcucugcuccucugauagcggcacguccagcggccugcugccuucugaccgcgugcucuggaucggggauguugccugucaaccgaugacccccauuccugaagagacauuccuggagcuuaaguccuuuagccagucugaguuccccgacaucugcaaaauugauggaaucguguuuaaucagugugaaggcgaaagccugccucagcccuucgacgucgccuggauggauguggggcacucccauaagaucauuaugagagagcacaaaaccaagugggugcaagagucuagcuccaaggacuuugucugcuauaaagaaggaacaggcccguguagcgagucugaagagaagaccugcaaaacauccgggagcugccggggagacaugcaguucuguaagguugcuggcugcgaacacggcgaggaggccucugaagcuaaaugucgcugcucccucgugcauaagccuggggagguggucgugagcuacggaggcaugagaguucggcccaaauguuacggguuuucccgcaugauggccacccuggaagugaaccagccugagcagagaaucggacaaugcacgggcugucaccuugaaugcauuaaugggggcguccggcugaucacccucacaucugagcuuaagagcgcgaccgugugugccucccauuucugcucuagcgcuacauccggaaagaaaagcaccgagauucaguuccacucuggcucccugguugggaagacggccauccacgugaaaggagcucucgucgauggcacagaauuuaccuucgaggggagcuguauguuucccgacggaugcgaugccguggacugcacauucugucgcgaauuucugaagaacccccagugcuauccugcgaaaaaguggcuuuucaucauuaucgucauucugcucggcuacgccgggcugaugcuucugaccaaugugcucaaggcuaucggcauuuggggaucuuggguuaucgccccggugaaacugaucuuugcuauuaucaagaaacugaugagaaccgucuccugucucaugggcaagcugauggaucgggggagacaagugauucaugaggaaaucggagagaaccgcgagggcaaucaggacgauguucggauugaaauggccagaccccgccgggugagacacuggauguauagcccugucauccuuacaauucuggccaucgggcucgcugagucuugcgacgaaauggugcaugcggauagcaaacugguguccugucgccagggaagcggcaacaugaaggagugcguuacgaccgggcgggcccuucugcccgcugucaauccuggccaggaggccugucuccacuucacagcccccggaucuccggacuccaagugccugaaaaucaaggugaaaagaauuaaccugaaguguaaaaagagcuccucuuacuuugugccugaugcucgcagccggugcaccuccgucagacgcugucggugggccggcgacugccaaucugggugucccccucauuucacaagcaauuccuuuucugacgauugggcgggaaagauggacagagcuggccucggguucagcggaugcuccgauggcugcgggggcgccgccuguggaugcuuuaacgcugcccccagcuguaucuucuggcggaaauggguggaaaauccucacggcauuaucuggaagguuucucccugcgcugccugggugccguccgcggucauugagcugaccaugccuagcggggaagugcgcacguuccaccccaugucuggaauccccacacagguuuuuaaaggcguguccgucaccuaucuugggagcgacauggaggugucuggacugaccgaucucugugaaaucgaggagcugagauccaagaaacuggcccuugcuccuugcaaccaggccggcaugggcguuguggggaaggucggagaaauucaguguagcuccgaggaaagcgcucggacaaucaaaaaggacggcugcauuuggaacgccgaucucguggggaucgagcugagaguggacgaugcggucuguuacucuaagauuaccagcguugaagccguggcuaauuauuccgccaucccgacaacgaucggaggccugcgcuucgagcggucucaugacagccaagggaaaauuuccggaucuccccucgauaucaccgcuauuagaggcagcuuuuccgugaacuaccgcggccugagacuuucucugagcgagaucacagcuaccugcacaggggaagucaccaauguguccggaugcuacagcuguaugacgggcgccaagguuucuauuaaacuccacuccagcaagaacucuaccgcccaugugcggugcaaaggggacgagacagcguucuccguccuggaaggagugcacagcuauaccguuucccugucuuuugaucacgccguggucgacgagcagugucagcuuaauugcggcgggcaugaaagccaggugacacucaagggaaaccugaucuuccuggacguuccuaaguuuguggauggcuccuacaugcaaaccuaucacagcacgguccccacaggcgcuaauaucccuucucccaccgacuggcucaacgcccuguucgggaauggacuuucccgcuggauucugggcgugaugggggugcuccugggaggccuggcccuguuuuucaugaucaugagccucuuuaaacuggggacaaagcaggucuucagaucucggaccaaacuggcuuga

SEQ ID NO: 14873 - RNA, 3222 nt, Artificial Sequence
  derived and/or modified CDS sequence (opt5) from SFTSV(HNXY_278)__KC292322.1__GP
augaugaaggugaucugguucagcucccugauuugccucgucauccaguguggcggggacaccggacccauuaucugcgccggcccuacacacucuaacaaaagcgcugauauuccgcaucugcuuggguacuccgagaagaucugucaaaucgacagacugauucacguuucuagcuggcuccggaaucauucccaguuucagggauaugugggccagcgcgggggaagaucucaagugagcuacuaucccgccgaaaacuccuacagccgguggucuggccugcuuuccccuugcgaugcggacuggcugggcaugcucgucgugaaaaaggcuaaagggagcgauaugaucguucccggaccuucuuauaagggcaagguguucuuugagcgccccacguucgacggguacgucggauggggcuguggguccggaaaaagcagaaccgaaucuggcgagcugugcuccagcgauuccggcacaucuagcgggcugcucccuuccgaccgggugcuguggauuggagauguugccugucagccgaugacccccaucccugaagagacauuucuugagcuuaagagcuucucucaguccgaauuucccgacauuugcaaaaucgauggcauuguguucaaucagugugagggggaaagccucccucaacccuuugacgucgccuggauggaugugggacacucucauaagaucaucaugcgcgagcacaaaaccaagugggugcaggagagcuccucuaaggacuucgucugcuauaaagaaggcacagggccguguagcgaguccgaagagaagaccugcaaaacgggaggcagcugcagaggcgacaugcaguuuuguaagguugcugggugcgaacacggagaggaggccucugaagcuaaaugucggugcucccuggugcauaagccuggcgagguggucgugagcuacgggggaaugcgcguuagacccaaauguuacggcuucucucggaugauggccacccuugaagugucccagccugagcaacgcauugggcagugcacaggcugucaccuggaaugcaucaacggaggcgucagacucauuacccugacaagcgagcugaaguccgcgaccgugugugccucucauuuuugcagcuccgcuacgucugggaagaaaagcacagagauccaguuccacuccggaagccucguuggcaagaccgccauucacgugaaaggggcucuggucgauggaacagaguucaccuuugaaggcucuuguauguuccccgacgggugcgaugccguggacugcaccuuuugucgggaguuccuuaagaauccccaaugcuauccugcgaaaaaguggcuguuuaucaucauugucauccuccugggcuacgccggacuuaugcugcucacaaacgugcugaaggcuauuggcguuuggggguccugggugaucgccccggucaaacugguguucgcuauuaucaagaaacucaugcgcgccguuagcugucugaugggaaagcugauggauagaggcagacaggugauccaugaagaaauuggggagaaucgggagggaaaccaggacgauguccgcaucgaaauggcccggcccagacgcgugcggcacuggauguauucuccugugauucugacgauccucgcuauuggccuggcggaggggugcgacgaaaugauccaugccgauuccaaacuuguuagcuguagacagggcucuggaaauaugaaggagugcgucaccacaggccgcgcucugcuccccgccgugaacccugggcaagaggccugucugcacuuuaccgcucccggaagcccggacuccaagugccugaaaauuaaggugaaacggaucaaucucaaguguaaaaagucuagcuccuacuucgucccugaugccagaagccgcugcacauccgugcggagaugucgcugggcgggcgacugccagucugggugucccccucauuuuacccccaacagcuucuccgacgauugggcuggaaagauggaccgggccggccugggguuuucuggcugcagcgauggaugcggcggggccgcuuguggaugcuucaaugccgcuccuuccuguaucuuuuggagaaaauggguugaaaacccccacggcauuaucuggaaggugucuccgugcgccgcgugggucccuagcgccgugauugagcuuacgaugcccuccggggaaguucggacauuccaccccaugagcggaaucccuacccagguguucaaaggcgucucugugaccuaucugggcuccgacauggagguuagcgggcucacagaucugugugaaauugaggagcugaagucuaaaaagcucgcucuugccccgugcaaucaggcuggaaugggcguggucgggaaagugggagaaauccaauguuccagcgaggaaucugcccgcaccaucaagaaggacggcugcauuuggaacgcggaucugguggggaucgagcugagagucgacgaugccguuuguuacuccaaaauuacaagcguggaagcuguggccaacuauuccgcuauccccacgaccauuggaggccuccgguuugagagaagccaugacucucagggcaagaucagcggguccccucuggauaucacagccauucgcggaucuuucagcgucaauuaccggggccuuagacugucccucucugagaucaccgccacaugcaccggggaagugacgaacguuagcggaugcuacuccuguaugaccggcgcuaaagugucuauuaagcugcacagcuccaaaaauagcacagcgcauguccgcugcaagggggacgagaccgccuuuucugugcuggaaggaguucacuccuauagcgugucucuuuccuucgaucacgcugucguggacgagcagugucagcucaacugcggcggccaugaaagccaaguuacacugagagggaaucugaucuuucucgacgugcccaaguucgucgauggauccuacaugcagaccuaucacucuacggugccuacaggcgccaacauucccagcccuaccgacuggcugaaugcccuuuuugggaacggacugucccgguggauccucggcgugaucgggguccugcugggaggccuugcucucuucuuucugauuaugagccuguucaaacucggcacaaagcagaucuuucgcucuagaaccaaacuggccuga

SEQ ID NO: 14874 - RNA, 3222 nt, Artificial Sequence
  derived and/or modified CDS sequence (opt5) from SFTSV(HNXY_31)__KC292310.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuccuggagcuuaaguccuuuagccagucugaguuccccgacaucugcaaaauugauggaaucguguuuaaucagugugaaggcgaaagccugccucaacccuucgacgucgccuggauggauguggggcacucccauaagaucauuaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcguuagacccaaauguuacggguuuucccggaugauggccacccuggaagugaaccagccugagcaacgcaucggacagugcacgggcugucaccuugaaugcauuaaugggggcgucagacugaucacccucacaucugagcuuaagagcgcgaccgugugugccucccauuucugcucuagcgcuacauccggaaagaaaagcaccgagauucaguuccacucuggcucccugguugggaagacggccauccacgugaaaggagcucucgucgauggcacagaauuuaccuucgaggggagcuguauguuucccgacggaugcgaugccguggacugcacauucugucgggaauuucugaagaacccccaaugcuauccugcgaaaaaguggcuuuucaucauuaucgucauucugcucggcuacgccgggcugaugcuucugaccaaugugcucaaggcuaucggcauuuggggaucuuggguuaucgccccggugaaacugaucuuugcuauuaucaagaaacugaugcgcaccgucuccugucucaugggcaagcugauggauagagggagacaggugauucaugaggaaaucggagagaaccgggagggcaaucaggacgauguucgcauugaaauggcccggcccagacgcgugcggcacuggauguauagcccugucauccuuacaauucuggccaucgggcucgcugagucuugcgacgaaauggugcaugcggauagcaaacugguguccuguagacagggaagcggcaacaugaaggagugcguuacgaccgggcgcgcccuucugcccgcugucaauccuggccaagaggccugucuccacuucacagcccccggaucuccggacuccaagugccugaaaaucaaggugaaacggauuaaccugaaguguaaaaagagcuccucuuacuuugugccugaugcuagaagccgcugcaccuccguccggagaugucgcugggccggcgacugccagucugggugucccccucauuucacaagcaauuccuuuucugacgauugggcgggaaagauggaccgggcuggccucggguucagcggaugcuccgauggcugcgggggcgccgccuguggaugcuuuaacgcugcccccagcuguaucuucuggagaaaauggguggaaaauccucacggcauuaucuggaagguuucucccugcgcugccugggugccguccgcggucauugagcugaccaugccuagcggggaagugcggacguuccaccccaugucuggaauccccacacagguuuuuaaaggcguguccgucaccuaucuugggagcgacauggaggugucuggacugaccgaucucugugaaaucgaggagcugaaguccaaaaagcuggcccuugcuccuugcaaccaggccggcaugggcguuguggggaaagucggagaaauucaauguagcuccgaggaaagcgcucgcacaaucaagaaggacggcugcauuuggaacgccgaucucguggggaucgagcugagaguggacgaugcggucuguuacucuaaaauuaccagcguugaagccguggcuaauuauuccgccaucccgacaacgaucggaggccugcgguucgagagaucucaugacagccaggggaagauuuccggaucuccccucgauaucaccgcuauucgcggcagcuuuuccgugaacuaccggggccugagacuuucucugagcgagaucacagcuaccugcacaggggaagucaccaauguguccggaugcuacagcuguaugacgggcgccaaaguuucuauuaagcuccacuccagcaaaaacucuaccgcccaugugcgcugcaagggggacgagacagcguucuccguccuggaaggagugcacagcuauuccguuucucugagcuuugaucacgccguggucgacgagcagugucagcuuaauugcggcgggcaugaaucccaagugacccucagaggaaaccugaucuuccuggacguuccuaaguuuguggauggcagcuacaugcagacauaucacucuaccguccccacgggcgcuaauaucccuucccccacagacuggcucaacgcccuguucgggaauggacuuagccgguggauucugggcgugaucggggugcuccugggaggccuggcccuguuuuucaugauuaugucucucuuuaaacuggggaccaagcaggucuuccgcagcagaacaaaacuggcuuga

SEQ ID NO: 14875 - RNA, 3222 nt, Artificial Sequence
  derived and/or modified CDS sequence (opt5) from SFTSV/FTLSV(2011YGS5)__KF711925.1__GP
augaugaaggugaucugguucagcucccuggucugccucguuauucaguguucuggcgacagcgggcccaucauuugcgccggaccuauccacuccaacaaaucugcugccauuccgcaucugcuuggcuacagcgagaagaucugucaaaucgauagacugauucacguguccucuuggcuccggaaucauagccaguuucagggguaugugggacagcgcggcgggagaucccaagucagcuacuaucccgcggaaaacucuuacucccgguggagcggacugcuuucuccuugcgacgcugauuggcugggcaugcucgugguuaaaaaggccaaaggcuccgacaugaucgugcccgggccuagcuauaagggaaaggucuucuuugagcgccccaccuucgauggcuacgugggguggggauguggcucugggaaauccagaacagaaagcggagagcugugcuccucugacagcggcacguccagcggccugcucccuucugaucggguucuguggauuggggacguggccugucagccgaugacccccaucccugaagagacauuucuugagcugaaguccuucagccagucugaauuucccgauauuugcaaaaucgacggaauugucuucaaucagugugagggcgaaagccucccucaacccuuugauguggcuuggauggacguggggcacucccauaagaucaucaugcgcgagcacaaaaccaaguggguccaggagucuagcuccaaggauuucguuugcuauaaagaaggaacaggcccguguagcgagucugaagagaaggccugcaaaaccuccgggagcugcagaggagacaugcaguuuuguaagguggcuggcugcgaacacggcgaggaggccucugaagcgaaaugucggugcucccuggugcauaagccuggggaggucgugguuagcuacggaggcaugcgcgugagacccaaauguuacggguucucccggaugauggccacaauggaagucaacccucccgagcagcgcauuggacaaugcaccggcugucaccuugaaugcaucaaugggggcgugagacugauuacgcucaccucugagcugaaguccgcuacaguuugugccucccauuuuugcucuagcgcuaccuccggaaagaaaagcacagagauccacuuccacucuggcucccugguggggaagaccgccauucaugucaaaggagcgcucguggacggcacggaauuuacauuugaggggagcuguauguuccccgauggaugcaacgccgucgacugcaccuuuugucgggaguuccugaagaauccucagugcuauccggcuaaaaaguggcuuuuuaucaucauugugauccugcucggcuacgccgggcugaugcuucugacaaacguucucaaggcuauuggcguguggggaucuugggucaucgcccccgugaaacugauguucgccauuaugaagaaacugaugcgcaccguuuccugucucgugggcaagcugauggauagagggcggcaggucauccacgaagaaaucggagagaauggcgaggggaaccaugacgaugugagaauugaaauggcucgcccucggagagugcgccacuggauguauagccccguuauccuuaccauucuggcgaucggacucgccgagggcugcgacgaaaugguccaugcugauucuaaacuggugagcugucggcaaggguccggcaauaugaaggagugcgugacaacggggagagcccuucugccugccgucaaccccggccaggaggcuugucuccacuuuaccgccccggggagcccugacucuaagugccugaaaauuaaggugaaacgcaucaaucugaaguguaaaaaguccagcuccuacuucguucccgaugcgcggaacagaugcacaucugugcgccgguguagaugggcuggagacugccagagcggcugcccuccccacuuuaccuccaauucuuucagcgaugacugggccgggaagauggaccgcgccggacucggcuuuuccggguguucugauggcugcggaggcgcugccugugggugcuucaacgcugccccuagcuguauuuucuggcggaaaugggucgaaaacucccauggaaucaucuggaaggugagccccugcgcggccuggguuccgucugcugugauugagcugacaaugccuuccggcgaagucagaaccuuccaccccaugagcgggauccccacacagguguucaaaggaguuucugugacguaucuuggcuccgacauggaggucagcggccugaccgaucucugugaaauugaggagcugaagucuaaaaagcuggcccuugcuccuugcaaucaagccgggaugggaguggugggcaaagucggggaaauccaguguuccagcgaggaauccgcgcggaccauuaagaaggacggaugcaucuggaacgccgaucucguuggcaucgagcugcgcguggacgaugcuguguguuacagcaaaauuacaucugucgaagccguggcuaauuauagcgccaucccgaccacaauugggggacugagauuugagcggucccaugacucucagggcaagaucagcggcagcccccucgauauuacggccaucagagggucuuucagcguuaacuaccgcggacugcggcuuucccugucugagaucaccgcuacaugcaccggcgaagugacaaaugucagcgggugcuacuccuguaugaccggagcgaaagugagcauuaagcuccacucuuccaaaaacagcacggcccacguuagaugcaagggcgacgagaccgcuuuuucugugcuggaagggguccauuccuauacagugagccuguccuucgaucacgccguuguggacgagcagugucaacuuaauugcggaggccaugaaucucaggucacccucaagggcaaccugaucuuucuggaugugccuaaauucguggacgggagcuacaugcagacauaucacuccaccguccccacgggagccaauauuccuagccccacagacuggcucaacgcucuguuuggcaaugggcuuucucgcuggauccugggaguuauuggcgugcuccugggaggacuggcccuuuucuuucucaucauguuccuguuuaagcugggcaccaaacagguguucagaucccggacaaagcucgcguga

SEQ ID NO: 14876 - RNA, 3222 nt, Artificial Sequence
  derived and/or modified CDS sequence (opt5) from SFTSV/FTLSV(2011YGS7)__KF711922.1__GP
augaugaaggugaucugguucagcucccuggucugccucguuauucaguguucuggcgacagcgggcccaucauuugcgccggaccuauccacuccaacaaaucugcugccauuccgcaucugcuuggcuacagcgagaagaucugucaaaucgauagacugauucacguguccucuuggcuccggaaucauagccaguuucagggguaugugggacagcgcggcgggagaucccaagucagcuacuaucccgcggaaaacucuuacucccgguggagcggacugcuuucuccuugcgacgcugauuggcugggcaugcucgugguuaaaaaggccaaaggcuccgacaugaucgugcccgggccuagcuauaagggaaaggucuucuuugagcgccccaccuucgauggcuacgugggguggggauguggcucugggaaauccagaacagaaagcggagagcugugcuccucugacagcggcacguccagcggccugcucccuucugaucggguucuguggauuggggacguggccugucagccgaugacccccaucccugaagagacauuucuugagcugaaguccuucagccagucugaauuucccgauauuugcaaaaucgacggaauugucuucuaucagugugagggcgaaagccucccucaacccuuugauguggcuuggauggacguggggcacucccauaagaucaucaugcgcgagcacaaaaccaaguggguccaggagucuagcuccaaggauuucguuugcuacaaagaaggaacaggcccguguagcgagucugaagagaaggccugcaaaaccuccgggagcugcagaggagacaugcaguuuuguaagguggcuggcugcgaacacggcgaggaggccucugaagcgaaaugucggugcucccuggugcauaagccuggggaggucgugguuagcuacggaggcaugcgcgugagacccaaauguuauggguucucccggaugauggccacaauggaagucaauccucccgagcagcgcauuggacaaugcaccggcugucaccuugaaugcaucaacgggggcgugagacugauuacgcucaccucugagcucaagagcgcuacaguuugugccucccauuuuugcucuagcgcuaccuccggaaagaaaagcacagagauccacuuccacucuggcucccugguggggaagaccgccauucaugucaaaggagcgcugguggacggcacggaauuuacauuugaggggagcuguauguuccccgauggaugcaaugccgucgacugcaccuuuugucgggaguuccugaagaacccucagugcuacccggcuaaaaaguggcuuuuuaucaucauugugauccugcucggcuaugccgggcugaugcuucugacaaauguucucaaggcuauuggcguguggggaucuugggucaucgcccccgugaaacugauguucgccauuaugaagaaacugaugcgcaccguuuccugucucgugggcaagcugauggauagagggcggcaggucauccacgaagaaaucggagagaacggcgaggggaaucaugacgaugugagaauugaaauggcucgcccucggagagugcgccacuggauguacagccccguuauccuuaccauucuggcgaucggacucgccgagggcugcgacgaaaugguccaugcugauucuaaacuggugagcugucggcaaggguccggcaacaugaaggagugcgugacaacggggagagcccuucugccuagcgucaaucccggccaggaggccugucuccacuuuaccgcuccggggucuccugacuccaagugccugaaaauuaaggugaaacgcaucaaccugaaguguaaaaagagcuccucuuauuucguucccgaugcccggaauagaugcacaagcgugcgccgguguagaugggcgggagacugccaguccggcugcccuccccacuuuaccucuaacagcuucuccgaugacugggcugggaagauggaccgcgccggacucggcuuuucuggguguagcgauggcugcggaggcgccgcuugugggugcuucaaugccgcuccuuccuguauuuucuggcggaaaugggucgaaaacagccauggaaucaucuggaaggugucucccugcgccgcguggguuccguccgccgugauugagcugacaaugccuagcggcgaagucagaaccuuccaccccaugucugggauccccacacagguguucaaaggaguuuccgugacguaccuuggcagcgacauggaggucucuggccugaccgaucucugugaaauugaggagcugaaguccaaaaagcuggcucuugccccuugcaaccaagcugggaugggaguggugggcaaagucggggaaauccaguguagcuccgaggaaagcgcccggaccauuaagaaggacggaugcaucuggaaugcggaucucguuggcaucgagcugcgcguggacgaugccguguguuauucuaaaauuacaagcgucgaagcuguggccaacuacuccgcuaucccgaccacaauugggggacugagauuugagcggucucaugacagccagggcaagaucuccggcucuccccucgauauuacggccaucagagggagcuucuccguuaauuaccgcggacugcggcuuucucugagcgagaucaccgccacaugcaccggcgaagugacaaacgucuccgggugcuauagcuguaugaccggagcuaaagugucuauuaagcuccacuccagcaaaaauucuacggcgcacguuagaugcaagggcgacgagaccgccuuuuccgugcuggaagggguccauagcuacacagugucccugucuuucgaucacgcuguuguggacgagcagugucaacuuaacugcggaggccaugaaagccaggucacccucaagggcaaucugaucuuucuggaugugccuaaauucguggacggguccuauaugcagacauaccacagcaccguccccacgggagccaacauuccuucucccacagacuggcucaaugcccuguuuggcaacgggcuuucccgcuggauccugggaguuauuggcgugcuccugggaggacuggcucuuuucuuucucaucauguuccuguuuaagcugggcaccaaacagguguucagaagccggacaaagcucgccuga

SEQ ID NO: 14877 - RNA, 3222 nt, Artificial Sequence
  derived and/or modified CDS sequence (opt5) from SFTSV/FTLSV(2011YPQ11)__KF711926.1__GP
augaugaaggugaucugguucagcucccuggucugccucguuauucaguguucuggcgacagcgggcccaucauuugcgccggaccuauccacuccaacaaaucugcugccauuccgcaucugcuuggcuacagcgagaagaucugucaaaucgauagacugauucacguguccucuuggcuccggaaucauagccaguuucagggguaugugggacagcgcggcgggagaucccaagucagcuacuaucccgcggaaaacucuuacucccgguggagcggacugcuuucuccuugcgacgcugauuggcugggcaugcucgugguuaaaaaggccaaaggcuccgacaugaucgugcccgggccuagcuauaagggaaaggucuucuuugagcgccccaccuucgauggcuacgugggguggggauguggcucugggaaauccagaacagaaagcggagagcugugcuccucugacagcggcacguccagcggccugcucccuucugaucggguucuguggauuggggacguggccugucagccgaugacccccaucccugaagagacauuucuugagcugaaguccuucagccagucugaauuucccgauauuugcaaaaucgacggaauugucuucaaucagugugagggcgaaagccucccucaacccuuugauguggcuuggauggacguggggcacucccauaagaucaucaugcgcgagcacaaaaccaaguggguccaggagucuagcuccaaggauuucguuugcuauaaagaaggaacaggcccguguagcgagucugaagagaaggccugcaaaaccuccgggagcugcagaggagacaugcaguuuuguaagguggcuggcugcgaacacggcgaggaggccucugaagcgaaaugucggugcucccuggugcauaagccuggggaggucgugguuagcuacggaggcaugcgcgugagacccaaauguuacggguucucccggaugauggccacaauggaagucaacccucccgagcagcgcauuggacaaugcaccggcugucaccuugaaugcaucaaugggggcgugagacugauuacgcucaccucugagcucaagagcgcuacaguuugugccucccauuuuugcucuagcgcuaccuccggaaagaaaagcacagagauccacuuccacucuggcucccugguggggaagaccgccauucaugucaaaggagcgcugguggacggcacggaauuuacauuugaggggagcuguauguuccccgauggaugcaacgccgucgacugcaccuuuugucgggaguuccugaagaauccucagugcuauccggcuaaaaaguggcuuuuuaucaucauugugauccugcucggcuacgccgggcugaugcuucugacaaacguucucaaggcuauuggcguguggggaucuugggucaucgcccccgugaaacugauguucgccauuaugaagaaacugaugcgcaccguuuccugucucgugggcaagcugauggauagagggcggcaggucauccacgaagaaaucggagagaauggcgaggggaaccaugacgaugugagaauugaaauggcucgcccucggagagugcgccacuggauguauagccccguuauccuuaccauucuggcgaucggacucgccgagggcugcgacgaaaugguccaugcugauucuaaacuggugagcugucggcaaggguccggcaauaugaaggagugcgugacaacgggcagagcccuucugccuagcgucaaccccggacaggaggccugucuccacuuuaccgcuccggggucuccugacuccaagugccugaaaauuaaggugaaacgcaucaaucugaaguguaaaaagagcuccucuuacuucguucccgaugcccgguauagaugcacaagcgugcgccgguguccuugggcgggagacugccaguccggcugucccccucacuuuaccucuaacagcuucuccgaugacugggcugggaagauggacagagccggacucggcuuuucugggugcagcgauggcugcggaggcgccgcuugugggugcuucaaugccgcucccuccuguauuuucuggcgcaaaugggucgaaaacagccauggaaucaucuggaaggugucuccgugcgccgcguggguuccuuccgccgugauugagcugacaaugcccagcggcgaaguccggaccuuccaccccaugucugggaucccuacacagguguucaaaggaguuuccgugacguaccuuggcagcgacauggaggucucuggccugaccgaucucugugaaauugaggagcugaaguccaaaaagcuggcucuugccccgugcaaccaagcugggaugggaguggugggcaaagucggggaaauccaguguagcuccgaggaaagcgccagaaccauuaagaaggacggaugcaucuggaaugcggaucucguuggcaucgagcugcggguggacgaugccguguguuauucuaaaauuacaagcgucgaagcuguggccaacuacuccgcuauccccaccacaauugggggacugcgcuuugagagaucucaugacagccagggcaagaucuccggcucuccucucgauauuacggccauccgggggagcuucuccguuaauuacagaggacugcgccuuucucugagcgagaucaccgccacaugcaccggcgaagugacaaacgucuccgggugcuauagcuguaugaccggagcuaaagugucuauuaagcuccacuccagcaaaaauucuacggcgcacguucggugcaagggcgacgagaccgccuuuuccgugcuggaagggguccauagcuacacagugucccugucuuucgaucacgcuguuguggacgagcagugucaacuuaacugcggaggccaugaaagccaggucacccucaagggcaaucugaucuuucuggaugugcccaaauucguggacggguccuauaugcagacauaccacagcaccgucccuacgggagccaacauucccucuccuacagacuggcucaaugcccuguuuggcaacgggauguccagauggauccuuggaguuauuggcgugcugcucgggggacuggcucuguucuuucuuaucauguuccucuuuaagcugggcaccaaacagguguuccgcagcagaacaaagcuggccuga

SEQ ID NO: 14878 - RNA, 3222 nt, Artificial Sequence
  derived and/or modified CDS sequence (opt5) from SFTSV/FTLSV(2011YPQ12)__KF711930.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucuaaucgggugcucuggaucggggacguugccugucagccgaugacccccauuccugaagagacauuccuggagcuuaaguccuuuagccagucugaauuucccgauaucugcaaaauugacggaaucguguuuaaccagugugagggcgaaagccugccucaacccuucgaugucgccuggauggacguggggcacucccauaagaucauuaugcgcgagcacaaaaccaagugggugcaggagucuagcuccaaggauuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcguuagacccaaauguuacggguuuucccggaugauggccacccuggaagugucucagccugagcaacgcaucggacagugcacgggcugucaccuugaaugcauuaaugggggcgucagacugaucacccucacaagcgagcugaaguccgcgaccgugugugccucucauuucugcagcuccgcuacaagcggaaagaaaucuaccgagauucaguuccacuccggcagccugguugggaagacggccauccacgugaaaggagcucucgucgacggcacagaauuuaccuucgaggggucuuguauguuucccgauggaugcgacgccguggauugcacauucugucgggaauuucugaagaacccccaaugcuauccugcgaaaaaguggcuuuucaucauuaucgucauucugcucggcuacgccgggcugaugcuucugaccaaugugcucaaggcuaucggcguuuggggauccugggugauugccccggucaaacugguguuugcuaucaucaagaaacugaugcgcgccguuagcugucucaugggcaagcugauggacagagggagacaggugauucaugaggaaaucggagagaaccgggagggcaaucaggaugacguccgcauugaaauggcccggcccagacgcgugcggcacuggauguauucuccugugauccuuaccauucuggcuaucgggcucgcggagggaugcgaugaaaugguucaugccgacagcaaacuggucuccuguagacagggcagcgggaacaugaaggagugcgugacaacgggccgcgcccuucugcccgcugugaauccuggacaagaggccugucuccacuucaccgcucccggcucuccggauuccaagugccugaaaauuaaggucaaacggaucaaccugaaguguaaaaagagcuccucuuacuuugugccuguugccagauaucgcugcacaagcgugcggagaugucgcugggcgggggacugccaguccggaugucccccucauuucaccucuaauagcuuuuccgaugacugggcuggcaagauggaccgggccgggcucggauucucuggcugcagcgaugggugcggcggagccgcuuguggcugcuuuaacgccgcucccuccuguaucuucuggagaaaaugggucgaaaauccucacgggauuaucuggaaggugagccccugcgccgcguggguuccgucugccgugauugagcugacaaugccuuccggagaaguccggaccuuccaccccaugagcggcauccccacacagguguuuaaagggguuucugugacguaccuuggauccgacauggaggucagcggccugaccgaucucugugaaauugaggagcugaagucuaaaaagcuggcucuugccccuugcaaccaggcuggcauggggguggugggaaaagucggcgaaauccaauguuccagcgaggaauccgcccgcaccaucaagaaggacgggugcauuuggaacgcggaucucguuggaaucgagcugagaguggacgaugccguguguuauagcaaaauuacaucugucgaagcuguggccaauuacagcgcuaucccgaccacaauuggcgggcugcgguucgagagaucccaugacucucagggaaagaucagcggcucuccccucgauaucacggccauucgcggcuccuuuagcguuaacuaccgggggcugagacuuucccugucugagaucaccgccacaugcaccggagaagugacaaaugucagcggcugcuauuccuguaugaccggggcuaaagugagcauuaagcuccacucuuccaaaaacagcacggcgcauguucgcugcaagggagacgagaccgccuucucugugcuggaaggcguccacuccuacagcgugucccugucuuuugaucacgcuguuguggacgagcagugucagcuuaauugcgggggacaugaaagccaagucacacucagaggcaaccugaucuuccuggaugugccuaaguuuguggacggcuccuauaugcagaccuaccacagcacaguccccaccggggccaauauuccuucucccacggacuggcucaacgcccuguucggaaauggccuuucccgguggauccuggggguuaucggagugcuccugggcgggcuggcucuuuucuuccucauuaugagccuguuuaaacugggaacaaagcagaucuuccgcucuagaaccaaacucgccuga

SEQ ID NO: 14879 - RNA, 3222 nt, Artificial Sequence
  derived and/or modified CDS sequence (opt5) from SFTSV/FTLSV(2011YPQ17)__KF711923.1__GP
augaugaaggugaucugguucagcucccuggucugccucguuauucaguguucuggcgacagcgggcccaucauuugcgccggaccuauccacuccaacaaaucugcugccauuccgcaucugcuuggcuacagcgagaagaucugucaaaucgauagacugauucacguguccucuuggcuccggaaucauagccaguuucagggguaugugggacagcgcggcgggagaucccaagucagcuacuaucccgcggaaaacucuuacucccgguggagcggacugcuuucuccuugcgacgcugauuggcugggcaugcucgugguuaaaaaggccaaaggcuccgacaugaucgugcccgggccuagcuauaagggaaaggucuucuuugagcgccccaccuucgauggcuacgugggguggggauguggcucugggaaauccagaacagaaagcggagagcugugcuccucugacagcggcacguccagcggccugcucccuucugaucggguucuguggauuggggacguggccugucagccgaugacccccaucccugaagagacauuucuugagcugaaguccuucagccagucugaauuucccgauauuugcaaaaucgacggaauugucuucaaucagugugagggcgaaagccucccucaacccuuugauguggcuuggauggacguggggcacucccauaagaucaucaugcgcgagcacaaaaccaaguggguccaggagucuagcuccaaggauuucguuugcuauaaagaaggaacaggcccguguagcgagucugaagagaaggccugcaaaaccuccgggagcugcagaggagacaugcaguuuuguaagguggcuggcugcgaacacggcgaggaggccucugaagcgaaaugucggugcucccuggugcauaagccuggggaggucgugguuagcuacggaggcaugcgcgugagacccaaauguuacggguucucccggaugauggccacaauggaagucaacccucccgagcagcgcauuggacaaugcaccggcugucaccuugaaugcaucaaugggggcgugagacugauuacgcucaccucugagcuuaagagcgcuacaguuugugccucccauuuuugcucuagcgcuaccuccggaaagaaaagcacagagauccacuuccacucuggcucccugguggggaagaccgccauucaugucaaaggagcgcucguggacggcacggaauuuacauuugaggggagcuguauguuccccgauggaugcaacgcccuggacugcaccuuuugucgggaguuccuuaagaauccucacugcuauccggcuaaaaaguggcuguuuaucaucauugucauccuccugggcuacgccgggcuuaugcugcucacaaacgugcugaaggcuauuggcguuuggggaucuugggugaucgcccccgucaaacugauguucgccauuaugaagaaacucaugcgcaccguguccugucugguuggcaagcugauggauagagggagacaggugauccaugaagaaaucggagagaauggcgaggggaaccacgacgaugucagaauugaaauggcucgcccucggagagugcgccauuggauguauagccccgugauccugaccauucucgcgaucggacuggccgagggcugcgacgaaaugguucacgcugauucuaaacuugucagcugucggcagggguccggcaauaugaaggagugcgugacaacgggacgggcccugcucccuagcgugaaccccggccaagaggccugucugcacuuuaccgcuccggggucuccugacuccaagugccugaaaauuaaggucaaacgcaucaaucucaaguguaaaaagagcuccucuuacuucgugcccgaugcccggaacagaugcacaagcguucgccgguguagaugggcgggagacugccaguccggcugcccuccccauuuuaccucuaauagcuucuccgaugacugggcugggaagauggaccgcgccggacugggcuuuucuggguguagcgauggcugcggaggcgccgcuugugggugcuucaacgccgcuccuuccuguauuuucuggcggaaauggguggaaaacagccacggaaucaucuggaaggucucucccugcgccgcgugggugccguccgccguuauugagcuuacaaugccuagcggcgaagugagaaccuuccaucccaugucugggauccccacgcaggucuucaaaggaguguccguuacauaucugggcagcgacauggaggugucuggccucaccgaucugugugaaauugaggagcugaaguccaaaaagcuggcucucgccccuugcaaucaggcugggaugggagucgugggcaaagugggggaaauccaauguagcuccgaggaaagcgcccggaccauuaagaaggacggaugcaucuggaacgcggaucuggucggcaucgagcugcgcguugacgaugccguguguuacucuaaaauuacaagcguggaagcugucgccaauuauuccgcuaucccgaccacaauugggggacucagauuugagcggucucacgacagccagggcaagaucuccggcucuccccuggauauuacggccaucagagggagcuucuccgugaacuaccgcggacuucggcugucucucagcgagaucaccgccacaugcaccggcgaaguuacaaauguguccgggugcuacagcuguaugaccggagcuaaagucucuauuaagcugcacuccagcaaaaacucuacggcgcaugugagaugcaagggcgacgagaccgccuuuuccguucuggaaggggugcacagcuauacagucucccuuucuuucgaucaugcugugguugacgagcagugucagcucaauugcggaggccacgaaagccaagugacccugaagggcaaccugaucuuucucgaugucccuaaauucguggacggguccuacaugcagacauaucauagcaccgugcccacgggagccaauauuccuucucccacagacuggcugaacgcccuuuuuggcaaugggcugucccgcuggauccucggagucauuggcguucugcuugggggacuugcucucuucuuucugaucauguuccuguuuaagcucggcaccaaacagguguucagaagccggacaaagcuggccuga

SEQ ID NO: 14880 - RNA, 3222 nt, Artificial Sequence
  derived and/or modified CDS sequence (opt5) from SFTSV/FTLSV(2011YSC22)__KF711927.1__GP
augaugaaggugaucugguucagcucccuggucugccucguuauucaguguucuggcgacagcgggcccaucauuugcgccggaccuauccacuccaacaaaucugcugccauuccgcaucugcuuggcuacagcgagaagaucugucaaaucgauagacugauucacguguccucuuggcuccggaaucauagccaguuucagggguaugugggacagcgcggcgggagaucccaagucagcuacuaucccgcggaaaacucuuacucccgguggagcggacugcuuucuccuugcgacgcugauuggcugggcaugcucgugguuaaaaaggccaaaggcuccgacaugaucgugcccgggccuagcuauaagggaaaggucuucuuugagcgccccaccuucgauggcuacgugggguggggauguggcucugggaaauccagaacagaaagcggagagcugugcuccucugacagcggcacguccagcggccugcucccuucugaucggguucuguggauuggggacguggccugucagccgaugacccccaucccugaagagacauuucuugagcugaaguccuucagccagucugaauuucccgauauuugcaaaaucgacggaauugucuucaaucagugugagggcgaaagccucccucaacccuuugauguggcuuggauggacguggggcacucccauaagaucaucaugcgcgagcacaaaaccaaguggguccaggagucuagcuccaaggauuucguuugcuauaaagaaggaacaggcccguguagcgagucugaagagaaggccugcaaaaccuccgggagcugcagaggagacaugcaguuuuguaagguggcuggcugcgaacacggcgaggaggccucugaagcgaaaugucggugcucccuggugcauaagccuggggaggucgugguuagcuacggaggcaugcgcgugagacccaaauguuacggguucucccggaugauggccacaauggaagucaacccucccgagcagcgcauuggacaaugcaccggcugucaccuugaaugcaucaaugggggcgugagacugauuacgcucaccucugagcucaagagcgcuacaguuugugccucccauuuuugcucuagcgcuaccuccggaaagaaaagcacagagauccacuuccacucuggcucccugguggggaagaccgccauucaugucaaaggagcgcugguggacggcacggaauuuacauuugaggggagcuguauguuccccgauggaugcaacgccgucgacugcaccuuuugucgggaguuccugaagaauccucagugcuauccggcuaaaaaguggcuuuuuaucaucauugugauccugcucggcuacgccgggcugaugcuucugacaaacguucucaaggcuauuggcguguggggaucuugggucaucgcccccgugaaacugauguucgccauuaugaagaaacugaugcgcaccguuuccugucucgugggcaagcugauggauagagggcggcaggucauccacgaagaaaucggagagaauggcgaggggaaccaugacgaugugagaauugaaauggcucgcccucggagagugcgccacuggauguauagccccguuauccuuaccauucuggcgaucggacucgccgagggcugcgacgaaaugguccaugcugauucuaaacuggugagcugucggcaaggguccggcaauaugaaggagugcgugacaacgggcagagcccuucugccuagcgucaaccccggacaggaggccugucuccacuuuaccgcuccggggucuccugacuccaagugccugaaaauuaaggugaaacgcaucaauguuaaguguaaaaagagcuccucuuacuucgugcccgaugcccggaacagaugcacaagcguccgccgguguagaugggcgggagacugccaguccggcugcccuccccacuuuaccucuaauagcuucuccgaugacugggcugggaagauggaccgcgccggacugggcuuuucuggguguagcgauggcugcggaggcgccgcuugugggugcuucaacgccgcuccuuccuguauuuucuggcggaaauggguggaaaacagccauggaaucaucuggaagguuucucccugcgccgcgugggugccguccgccgucauugagcucacaaugccuagcggcgaagugagaaccuuccaccccaugucugggauccccacgcagguuuucaaaggaguguccgucacauaucugggcagcgacauggaggugucuggccuuaccgaucugugugaaauugaggagcucaaguccaaaaagcuggcucuggccccuugcaaucaagcugggaugggaguggucggcaaaguuggggaaauccaguguagcuccgaggaaagcgcccggaccauuaagaaggacggaugcaucuggaacgcggaucuugugggcaucgagcuccgcguggacgaugccgucuguuacucuaaaauuacaagcguggaagcuguugccaauuauuccgcuaucccgaccacaauugggggacugagauuugagcggucucaugacagccagggcaagaucuccggcucuccccuggauauuacggccaucagagggagcuucuccgugaacuaccgcggacuccggcugucucuuagcgagaucaccgccacaugcaccggcgaagucacaaauguguccgggugcuacagcuguaugaccggagcuaaaguuucuauuaagcugcacuccagcaaaaacucuacggcgcacgugagaugcaagggcgacgagaccgccuuuuccguccucgaaggggugcauagcuauacaguuucccugucuuucgaucacgcuguggucgacgagcagugucaacugaauugcggaggccaugaaagccaggugacccuuaagggcaaccucaucuuucuggaugugccuaaauucgucgacggguccuacaugcagacauaucacagcaccguucccacgggagccaauauuccuucucccacagacuggcugaacgcccuccugggcaaugggaugucccgcuggauccuuggagugauuggcgugcugcucgggggacuggcucuguuuuuccuuaucauguuucucuucaagcugggcaccaaacaggucuuuagaagccggacaaagcuggccuga

SEQ ID NO: 14881 - RNA, 3222 nt, Artificial Sequence
  derived and/or modified CDS sequence (opt5) from SFTSV/FTLSV(2011YSC60)__KF711945.1__GP
augaugaaggugaucugguucagcucccugauuugccucgucauccaguguggcggggacaccggacccauuaucugcgccggcccuauucacucuaacaaaagcgcugauaucccgcaucugcuuggguacuccgagaagaucugucaaauugacagacugauccacguuucuagcuggcuccggaaucauucccaguuucagggauaugugggccagcgcgggggaagaucucaagugagcuacuaucccgccgaaaacuccuacagccgguggucuggccugcuuuccccuugcgaugcggacuggcugggcaugcucgucgugaaaaaggcuaaagggagcgauaugauuguucccggaccuucuuauaagggcaagguguucuuugagcgccccacauucgacggguacgucggauggggcuguggguccggaaaaagcagaacggaaucuggcgagcugugcuccagcgauuccggcaccucuagcgggcugcucccuuccgaccgggugcuguggaucggagauguugccugucagccgaugacacccauuccugaagagaccuuucuugagcuuaagagcuucucucaguccgaauuucccgacaucugcaaaauugauggcaucguguucaaucagugugagggggaaagccucccucaacccuuugacgucgccuggauggaugugggacacucucauaagaucauuaugcgcgaguauaaaacaaagugggugcaggagagcuccucuaaggacuucgucugcuacaaagaaggcaccgggccguguagcgaguccgaagagaagacaugcaaaaccagcggaucuugcagaggcgacaugcaguuuuguaagguugcuggcugcgaacacggggaggaggccuccgaagcuaaaugucggugcagccuggugcacaagccuggagagguggucgugucuuacggcgggaugcgcguuagacccaaauguuauggauucucccggaugauggccacgcuugaagugaaccagccugagcaacgcaucggccagugcaccgggugucaucuggaaugcauuaauggcggagucagacucaucacacugaccagcgagcugaaguccgcgacagugugugccucucacuuuugcagcuccgcuaccucuggcaagaaaagcacggagauucaguuccauuccgggagccucguuggaaagacagccauccacgugaaaggcgcucuggucgaugggaccgaguucacauuugaaggaucuuguauguuccccgacggcugcgaugccguggacugcaccuuuugucgggaguuccuuaagaacccccaaugcuacccugcgaaaaaguggcuguuuaucauuaucgucauucuccugggguaugccggccuuaugcugcucaccaaugugcugaaggcuaucggaauuuggggcuccuggguuaucgccccggugaaacugaucuucgcuauuaucaagaaacucaugcgcacagucagcugucugauggggaagcugauggauagaggaagacaggugauucacgaagaaaucggcgagaaccgggaggggaaucaggacgauguucgcauugaaauggcccggcccagacgcgugcggcauuggauguacucuccugucauccugacgauucucgccaucggacuggcugaguccugcgacgaaauggugcacgcggauagcaaacuugugucuuguagacagggcagcgggaacaugaaggagugcguuaccacaggccgcgcccugcuccccgcugucaauccuggacaagaggccugucugcauuuuaccgcccccggcuccccggacagcaagugccugcggaucaaagugaagagaauuaaccucaaauguaagaaaucuuccagcuauuucgugccugaugcucgcaaucggugcacauccgucagacgcugucggugggccggggacugccagucuggaugucccccucacuuuaccagcaacuccuucucugacgauugggcgggcaagauggacagagcugggcugggauuuagcggcugcuccgaugggugcggcggagccgccuguggcugcuucaaugcugcccccucuuguaucuuuuggcggaaguggguggaaaacccucaugggauuaucuggaaaguuagccccugcgcugccugggugccguccgcggucauugagcuuacgaugccuagcggagaagugcgcacauuccaccccaugucuggcauccccacccagguuuucaaggggguguccgucaccuaccugggaagcgacauggaggugucuggccucacagaucugugugaaaucgaggagcugaaauccaagaaacuugcccucgcuccuugcaaccaggccggcauggggguugugggaaaggucggcgaaauucaauguagcucugaggaauccgcuagaaccaucaaaaaggacgggugcauuuggaaugccgaucuggugggaaucgagcugcggguggacgaugcggucuguuauagcaagauuacauccguugaagccguggcuaacuacagcgccaucccgacgaccaucggcgggcucagauuugagcgcucucacgacagccagggaaaaauuuccggcucuccccuggauaucacagcuauucggggcagcuucuccgugaauuacagagggcuucgccugucucucagcgagaucaccgccacaugcaccggagaagucacgaacguguccggcugcuauucuuguaugaccggggccaagguuagcauuaaacugcauuccagcaaaaauucuacagcucacgugagaugcaagggagacgagaccgcguuuuccguccuggaaggcgugcauagcuacacaguuucucuuuccuucgaucacgccguggucgacgagcagugucagcucaacugcgggggacacgaaagccaagugacccugaagggcaaucugaucuuucucgacguuccuaaguucguggauggcuccuauaugcagacguaccauucuacaguccccaccggggcuaacaucccuagccccacagacuggcugaaugcccuuuuuggaaacggccugucccggugggugcucggggugaugggaguccugcugggcgggcuugcccucuucuuuaugauuaugagccuguucaaacugggaaccaagcagguuuuucgcucuagaaccaaacucgcuuga

SEQ ID NO: 14882 - RNA, 3222 nt, Artificial Sequence
  derived and/or modified CDS sequence (opt5) from SFTSV/FTLSV(2011YSH45)__KF711947.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuccuggagcuuaaguccuuuagccagucugaauuucccgacaucugcaaaauugauggaaucguguuuaaucagugugagggcgaaagccugccucaacccuucgacgucgccuggauggauguggggcacucccauaagaucauuaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcguuagacccaaauguuacggguuuucccggaugauggccacccuggaagugaaccagccugagcaacgcaucggacagugcacgggcugucaccuugaaugcauuaaugggggcgucagacugaucacccucacaucugagcugaaguccgcgaccgugugugccucccauuucugcucuagcgcuacauccggaaagaaaagcaccgagauucaguuccacucuggcucccugguugggaagacggccauccacgugaaaggagcucucgucgauggcacagaauuuaccuucgaggggagcuguauguuucccgacggaugcgaugccguggacugcacauucugucgggaauuucugaagaacccccaaugcuauccugcgaaaaaguggcuuuucaucauuaucgucauucugcucggcuacgccgggcugaugcuucugaccaaugugcucaaggcuaucggcauuuggggaucuuggguuaucgccccggugaaacugaucuuugcuauuaucaagaaacugaugcgcaccgucuccugucucaugggcaagcugauggauagagggagacaggugauucaugaggaaaucggagagaaccgggagggcaaucaggacgauguucgcauugaaauggcccggcccagacgcgugcggcacuggauguauagcccugucauccuuacaauucuggccaucgggcucgcugagucuugcgacgaaauggugcaugcggauagcaaacugguguccuguagacagggaagcggcaacaugaaggagugcguuacgaccgggcgcgcccuucugcccgcugucaauccuggccaagaggccugucuccacuucacagcccccggaucuccggacuccaagugccugaaaaucaaggugaaacggauuaaccuggaauguaagaaaagcuccucuuacuuugugccugaugcuagaaaucgcugcaccagcguccggagaugucgcugggccggcgacugccaguccgggugucccccucauuucacaucuaacagcuuuuccgacgauugggcgggaaagauggaccgggcuggccucggguucucuggaugcagcgauggcugcgggggcgccgccuguggaugcuuuaaugcugcccccuccuguaucuucuggagaaaguggguggagaacccucacggcauuaucuggaaaguuagccccugcgcugccugggugccgucugcggucauugaacugaccaugccuuccggggaggugcggacguuccaccccaugagcggaauccccacacagguuuuuaagggcgugucugucaccuaucuuggguccgacauggaagugagcggacugaccgaucucugugagaucgaggaacugaaaucuaagaaacuggcccuugcuccuugcaaccaggccggcaugggcguuguggggaaggucggagagauucaauguuccagcgaagaguccgcucgcacaaucaaaaaggacggcugcauuuggaaugccgaucucguggggaucgaacugagaguggacgaugcggucuguuacagcaagauuaccucuguugaggccguggcuaacuauagcgccaucccgacaacgaucggaggccugcgguucgagagaucccaugacucucaggggaaaauuagcggaagcccccucgauaucaccgcuauucgcggcucuuuuagcgugaauuaccggggccugagacuuucccugucugaaaucacagcuaccugcacaggggaggucaccaacgugagcggaugcuacuccuguaugacgggcgccaagguuagcauuaaacuccacucuucccgcaauagcaccgcccaugugagaugcaagggggacgaaacagcguucucuguccuggagggagugcacuccuauaccguuagccuguccuuugaucacgccguggucgacgaacagugucagcuuaacugcggcgggcaugagucucaagugacacucaaaggaaaucugaucuuccuggacguuccuaaguuuguggauggcagcuacaugcagaccuaucacuccacgguccccacaggcgcuaacaucccuagccccaccgacuggcucaaugcccuguucgggaacggacuuucucggugggugcugggcgugauggggguccuccugggaggccuggcccuuuucuucaugauuaugucccucuuuaagcuggggacaaaacagguuuuccgcagcagaaccaagcuggcuuga

SEQ ID NO: 14883 - RNA, 3222 nt, Artificial Sequence
  derived and/or modified CDS sequence (opt5) from SFTSV/FTLSV(2011YSH52)__KF711928.1__GP
augaugaaggugaucugguucagcucccugauuugccucgucauccaguguggcggggacaccggacccauuaucugcgccggcccuauucacucuaacaaaagcgcugauaucccgcaucugcuuggguacuccgagaagaucugucaaauugacagacugauccacguuucuagcuggcuccggaaucauucccaguuucagggauaugugggccagcgcgggggaagaucucaagugagcuacuaucccgccgaaaacuccuacagccgguggucuggccugcuuuccccuugcgaugcggacuggcugggcaugcucgucgugaaaaaggcuaaagggagcgauaugauuguucccggaccuucuuauaagggcaagguguucuuugagcgccccacauucgacggguacgucggauggggcuguggguccggaaaaagcagaacggaaucuggcgagcugugcuccagcgauuccggcaccucuagcgggcugcucccuuccgaccgggugcuguggaucggagauguugccugucagccgaugacacccauuccugaagagaccuuucuugagcuuaagagcuucucucaguccgaauuucccgacaucugcaaaauugauggcaucguguucaaucagugugagggggaaagccucccucaacccuuugacgucgccuggauggaugugggacacucucauaagaucauuaugcgcgagcacaaaacaaagugggugcaggagagcuccucuaaggacuucgucugcuauaaagaaggcaccgggccguguagcgaguccgaagagaagacaugcaaaaccagcggaucuugcagaggcgacaugcaguuuuguaagguugcuggcugcgaacacggggaggaggccuccgaagcuaaaugucggugcagccuggugcauaagccuggagagguggucgugucuuacggcgggaugcgcguuagacccaaauguuacggauucucccggaugauggccacgcuugaagugagccagccugagcaacgcaucggccagugcaccgggugucaccuggaaugcauuaacggcggagucagacucaucacacugaccuccgagcugaagucugcgacagugugugccagccauuuuugcuccucugcuaccagcggcaagaaauccacggagauucaguuccacagcgggucucucguuggaaagacagccauccacgugaaaggcgcucuggucgaugggaccgaguucacauuugaaggauccuguauguuccccgacggcugcgaugccguggacugcaccuuuugucgggaguuccuuaagaauccccaaugcuauccugcgaaaaaguggcuguuuaucauuaucgucauucuccugggguacgccggcuucaugcuucugaccaacgugcucaaggcuaucggaguuuggggcagcugggugauugccccggucaaacugguguuugcuaucaucaagaaacugaugcgcgccguuucuugucucauggggaagcugauggauagaggaagacaggugauucaugaagaaaucggcgagaaucgggaggggaaccaggacgauguccgcauugaaauggcccggcccagacgcgugcggcacuggauguauuccccugugauccuuacaauucuggcuaucggacucgcggagggcugcgacgaaaugguucaugccgauagcaaacuggucucuuguagacaggggagcggcaauaugaaggagugcgugacgaccggacgcgcucugcugcccgccgugaacccuggccaagaggccugucuccacuucacagcucccggguccccggacagcaagugccugaaaauuaaggucaaacggaucaauaagaaauguaagaagucuuccagcuacuuugugccugaugccagauaucgcugcaccuccguucggagaugucgcugggcgggagacugccagucuggcugucccccucauuucacaagcaacuccuuuucugacgauugggcugggaaaauggaccgggccggacugggcuucagcgggugcuccgauggcugcggaggcgccgcuugugggugcuuuaaugccgcucccucuuguaucuucuggagaaaguggguggaaaacccucacggaauuaucuggaaagucagccccugcgccgcgugggugccguccgccguuauugagcucaccaugccuagcggcgaagugcggacguuccaccccaugucugggauccccacacaggucuuuaagggaguguccguuaccuaccugggcagcgacauggaggugucuggccuuuccgaucugugugaaauugaggagcucaauagcaaaaagcuggcucuggccccuugcaaccaggcugggaugggagucgugggcaaagugggggaaauccaauguucuuccgaggaaagcgcccgcaccaucaagaaggacggaugcauuagaaacgcggaucuugucggcaucgagguucggguggacgaugccguguucuauuuuaaaauuacauccgucgaagcuguggccaauuacagcgcuaucccgaccacaauugggggacucagauucgagcgcucucaugacagccagggcaagaucuccggcucuccccuggauaucacggccauucgggggagcuuuuccguuaacuacagaggacugcgccucucucugagcgagaucaccgccacauguaccggcgaagugacaaaugucuccgggugcuauucuugcaugaccggagcuaaagugagcauuaagcugcacuccagcaaaaacucuacggcgcauguuagauguaagggcgacgagaccgccuucuccgugcuggaagggguccacagcuacucugugucccucagcuuugaucacgcuguuguggacgagcagugccagcugaauuguggaggccaugaaucccaagucacacugcggggcaaccuuaucuuccucgacgugccuaaguuuguggaugggucuuauaugcagaccuaccacagcacaguccccaccggagccaauauuccuucccccacggacuggcugaacgcccuguucggcaaugggcucagccgcuggauccugggaguuaucggcgugcuucuugggggacucgcucuguuuuuccugauucuuucucucuuuaaacugggcacaaagcagaucuucagaucccggaccaaacuggccuga

SEQ ID NO: 14884 - RNA, 3222 nt, Artificial Sequence
  derived and/or modified CDS sequence (opt5) from SFTSV/FTLSV(2011YXX9)__KF711924.1__GP
augaugaaggugaucugguucagcucccuggucugccucguuauucaguguucuggcgacagcgggcccaucauuugcgccggaccuauccacuccaacaaaucugcugccauuccgcaucugcuuggcuacagcgagaagaucugucaaaucgauagacugauucacguguccucuuggcuccggaaucauagccaguuucagggguaugugggacagcgcggcgggagaucccaagucagcuacuaucccgcggaaaacucuuacucccgguggagcggacugcuuucuccuugcgacgcugauuggcugggcaugcucgugguuaaaaaggccaaaggcuccgacaugaucgugcccgggccuagcuauaagggaaaggucuucuuugagcgccccaccuucgauggcuacgugggguggggauguggcucugggaaauccagaacagaaagcggagagcugugcuccucugacagcggcacguccagcggccugcucccuucugaucggguucuguggauuggggacguggccugucagccgaugacccccaucccugaagagacauuucuugagcugaaguccuucagccagucugaauuucccgauauuugcaaaaucgacggaauugucuucaaucagugggagggcgaaagccucccucaacccuuugauguggcuuggauggacguggggcacucccauaagaucaucaugcgcgagcacaaaaccaaguggguccaggagucuagcuccaaggauuucguuuguuauaaagaaggaacaggcccgugcagcgagucugaagagaaggccuguaaaaccuccgggagcugcagaggagacaugcaguuuugcaagguggcuggcugugaacacggcgaggaggccucugaagcgaaaugccgguguucccuggugcauaagccuggggaggucgugguuagcuacggaggcaugcgcgugagacccaaaugcuacggguucucccggaugauggccacaauggaagucaacccucccgagcagcgcauuggacaauguaccggcugccaccuugaauguaucaaugggggcgugagacugauuacgcucaccucugagcucaagagcgcuacaguuugcgccucccauuuuuguucuagcgcuaccuccggaaagaaaagcacagagauccacuuccacucuggcucccugguggggaagaccgccauucaugucaaaggagcgcugguggacggcacggaauuuacauuugaggggagcugcauguuccccgauggauguaacgccgucgacugcaccuuuugccgggaguuccugaagaauccucaguguuauccggcuaaaaaguggcuuuuuaucaucauugugauccugcucggcuacgccgggcugaugcuucugacaaacguucucaaggcuauuggcguguggggaucuugggucaucgcccccgugaaacugauguucgccauuaugaagaaacugaugcgcaccguuuccugccucgugggcaagcugauggauagagggcggcaggucauccacgaagaaaucggagagaauggcgaggggaaccaugacgaugugagaauugaaauggcucgcccucggagagugcgccacuggauguauagccccguuauccuuaccauucuggcgaucggacucgccgagggcugugacgaaaugguccaugcugauucuaaacuggugagcugccggcaaggguccggcaauaugaaggagugugugacaacggggagagcccuucugccuagcgucaaccccggccaggaggccugccuccacuuuaccgcuccggggucuccugacuccaagugucugaaaauuaaggugaaacgcaucaaucugaagugcaaaaagagcuccucuuacuucguucccgaugcccggaacagauguacaagcgugcgccggugcagaugggcgggagacugucaguccggcugcccuccccacuuuaccucuaauagcuucuccgaugacugggcugggaagauggaccgcgccggacucggcuuuucugggugcagcgauggcuguggaggcgccgcuugcggguguuucaacgccgcuccuuccugcauuuucuggcggaaaugggucgaaaacagccauggaaucaucuggaaggugucucccugugccgcguggguuccguccgccgugauugagcugacaaugccuagcggcgaagucagaaccuuccaccccaugucugggauccccacacagguguucaaaggaguuuccgugacguaucuuggcagcgacauggaggucucuggccugaccgaucucugcgaaauugaggagcugaaguccaaaaagcuggcucuugccccuuguaaucaagcugggaugggaguggugggcaaagucggggaaauccagugcagcuccgaggaaagcgcccggaccauuaagaaggacggauguaucuggaacgcggaucucguuggcaucgagcugcgcguggacgaugccgugugcuacucuaaaauuacaagcgucgaagcuguggccaauuauuccgcuaucccgaccacaauugggggacugagauuugagcggucucaugacagccagggcaagaucuccggcucuccccucgauauuacggccaucagagggagcuucuccguuaacuaccgcggacugcggcuuucucugagcgagaucaccgccacauguaccggcgaagugacaaaugucuccgggugcuacagcugcaugaccggagcuaaagugucuauuaagcuccacuccagcaaaaacucuacggcgcacguuagauguaagggcgacgagaccgccuuuuccgugcuggaagggguccauagcuauacagugucccugucuuucgaucacgcuguuguggacgagcagugccaacuuaauuguggaggccaugaaagccaggucacccucaagggcaaccugaucuuucuggaugugccuaaauucguggacggguccuacaugcagacauaucacagcaccguccccacgggagccaauauuccuucucccacagacuggcucaacgcccuguuuggcaaugggcuuucccgcuggauccugggaguuauuggcgugcuccugggaggacuggcucuuuucuuucucaucauguuccuguuuaagcugggcaccaaacagguguucagaagccggacaaagcucgccuga

SEQ ID NO: 14885 - RNA, 3222 nt, Artificial Sequence
  derived and/or modified CDS sequence (opt5) from SFTSV/FTLSV(2012YGS10)__KF711937.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuccuggagcuuaaguccuuuagccagucugaguuccccgacaucugcaaaauugauggaaucguguuuaaucagugugaaggcgaaagccugccucaacccuucgacgucgccuggauggauguggggcacucccauaagaucauuaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcguuagacccaaauguuacggguuuucccggaugauggccacccuggaagugaaccagccugagcaacgcaucggacagugcacgggcugucaccuugaaugcauuaaugggggcgucagacugaucacccucacaucugagcuuaagagcgcgaccgugugugccucccauuucugcucuagcgcuacauccggaaagaaaagcaccgagauucaguuccacucuggcucccugguugggaagacggccauccacgugaaaggagcucucgucgauggcacagaauuuaccuucgaggggagcuguauguuucccgacggaugcgaugccguggacugcacauucugucgggaauuucugaagaacccccaaugcuauccugcgaaaaaguggcuuuucaucauuaucgucauucugcucggcuacgccgggcugaugcuucugaccaaugugcucaaggcuaucggcauuuggggaucuuggguuaucgccccggugaaacugaucuuugcuauuaucaagaaacugaugcgcaccgucuccugucucaugggcaagcugauggauagagggagacaggugauucaugaggaaaucggagagaaccgggagggcaaucaggacgauguucgcauugaaauggcccggcccagacgcgugcggcacuggauguauagcccugucauccuuacagugcuggccauugggcucgcugagucuugcgacgaaauggugcaugcggauagcaaacugguuuccuguagacagggaagcggcaacaugaaggagugcgucacgaccgggcgcgcccuucugcccgcugugaauccuggccaagaggccugucuccacuucacagcccccggaucuccggacuccaagugccugaaaaucaaggugaaacggaucaaccugaaguguaaaaagagcuccucuuacuuugucccugaugcuagaagccgcugcaccuccgugcggagaugucgcugggccggcgacugccagucugggugucccccucauuucacaagcaauuccuuuucugacgauugggcgggaaagauggaccgggcuggccucggguucagcggaugcuccgauggcugcgggggcgccgccuguggaugcuuuaacgcugcccccagcuguauuuucuggagaaaauggguugaaaauccucacggcaucauuuggaaggugucucccugcgcugccugggucccguccgcggugaucgagcugaccaugccuagcggggaaguucggacguuccaccccaugucuggcauucccacacagguguuuaaaggagucuccgugaccuaucuugggagcgacauggagguuucuggacugaccgaucucugugaaaucgaggagcugaaguccaaaaagcuggcccuugcuccuugcaaccaggccggcaugggcguggucgggaaagugggagaaauccaauguagcuccgaggaaagcgcucgcacaauuaagaaggacggcugcaucuggaacgccgaucucguggggauugagcugagagucgacgaugcgguuuguuacucuaaaaucaccagcguggaagccguggcuaauuauuccgccauuccgacaacgaucggaggccugcgguucgagagaucucaugacagccaggggaagaucuccggaucuccccucgauauuaccgcuauccgcggcagcuuuuccgucaacuaccggggccugagacuuucucugagcgagauuacagcuaccugcacaggggaagugaccaauguuuccggaugcuacagcuguaugacgggcgccaaagugucuaucaagcuccacuccagcaaaaacucuaccgcccauguccgcugcaagggggacgagacagcguucuccgugcuggaaggaguucacagcuauaccgugucccugucuuuugaucacgccgucguggacgagcagugucagcuuaauugcggcgggcaugaaagccaaguuacacucaagggaaaccugauuuuccuggacgugccuaaauuugucgauggcuccuacaugcagaccuaucacagcacggugcccacaggcgcuaauaucccuucucccaccgacuggcucaacgcccuguucgggaauggacuuuccagauggauccugggcgugauugggguccuccugggaggccuggcccuguuuuucaugaucaugagccucuuuaagcuggggacaaaacagguuuuccggucucgcaccaagcuggcuuga

SEQ ID NO: 14886 - RNA, 3222 nt, Artificial Sequence
  derived and/or modified CDS sequence (opt5) from SFTSV/FTLSV(2012YGS4)__KF711933.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuccuggagcuuaaguccuuuagccagucugaguuccccgacaucugcaaaauugauggaaucguguuuaaucagugugaaggcgaaagccugccucaacccuucgacgucgccuggauggauguggggcacucccauaagaucauuaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcguuagacccaaauguuacggguuuucccggaugauggccacccuggaagugaaccagccugagcaacgcaucggacagugcacgggcugucaccuugaaugcauuaaugggggcgucagacugaucacccucacaucugagcuuaagagcgcgaccgugugugccucccauuucugcucuagcgcuacauccggaaagaaaagcaccgagauucaguuccacucuggcucccugguugggaagacggccauccacgugaaaggagcucucgucgauggcacagaauuuaccuucgaggggagcuguauguuucccgacggaugcgaugccguggacugcacauucugucgggaauuucugaagaacccccaaugcuauccugcgaaaaaguggcuuuucaucauuaucgucauucugcucggcuacgccgggcugaugcuucugaccaaugugcucaaggcuaucggcauuuggggaucuuggguuaucgccccggugaaacugaucuuugcuauuaucaagaaacugaugcgcaccgucuccugucucaugggcaagcugauggauagagggagacaggugauucaugaggaaaucggagagaaccgggagggcaaucaggacgauguucgcauugaaauggcccggcccagacgcgugcggcacuggauguauagcccugucauccuuacaauucuggccaucgggcucgcugagucuugcgacgaaauggugcaugcggauagcaaacugguguccuguagacagggaagcggcaacaugaaggagugcguuacgaccgggcgcgcccuucugcccgcugucaauccuggccaagaggccugucuccacuucacagcccccggaucuccggacuccaagugccugaaaaucaaggugaaacggauuaaccugaaguguaaaaagagcuccucuuacuuugugccugaugcuagaagccgcugcaccuccguccggagaugucgcugggccggcgacugccagucugggugucccccucauuucacaagcaauuccuuuucugacgauugggcgggaaagauggaccgggcuggccucggguucagcggaugcuccgauggcugcgggggcgccgccuguggaugcuuuaacgcugcccccagcuguaucuucuggagaaaauggguggaaaauccucacggcauuaucuggaagguuucucccugcgcugccugggugccguccgcggucauugagcugaccaugccuagcggggaagugcggacguuccaccccaugucuggaauccccacacagguuuuuaaaggcguguccgucaccuaucuugggagcgacauggaggugucuggacugaccgaucucugugaaaucgaggagcugaaguccaaaaagcuggcccuugcuccuugcaaccaggccggcaugggcguuguggggaaagucggagaaauucaauguagcuccgaggaaagcgcucgcacaaucaagaaggacggcugcauuuggaacgccgaucucguggggaucgagcugagaguggacgaugcggucuguuacucuaaaauuaccagcguugaagccguggcuaauuauuccgccaucccgacaacgaucggaggccugcgguucgagagaucucaugacagccaggggaagauuuccggaaucccccucgauauuaccgcuauccgcggcucuuuuagcgugaacuaccggggccugagacuuucccugucugagauuacagcuaccugcacaggggaagucaccaaugugagcggaugcuacuccuguaugacgggcgccaaaguuagcaucaagcuccacucuuccaaaaacagcaccgcccaugugcgcugcaagggggacgagacagcguucucuguccuggaaggagugcacuccuauaccguuagccuguccuuugaucacgccguggucgacgagcagugucagcuuaauugcggcgggcaugaaucucaagugacacucaagggaaaccugaucuuccuggacguuccuaaauuuguggauggcagcuacaugcagaccuaucacuccacgguccccacaggcgcuaauauuccuagccccaccgacuggcucaacgcccuguucgggaauggacuuucuagauggauccugggcgugauuggggugcuccugggaggccuggcccuguuuuucaugaucaugucccucuuuaagcuggggacaaaacaggucuuccggagccgcaccaagcuggcuuga

SEQ ID NO: 14887 - RNA, 3222 nt, Artificial Sequence
  derived and/or modified CDS sequence (opt5) from SFTSV/FTLSV(2012YSC6)__KF711931.1__GP
augaugaaggugaucugguucagcucccugauuugcuuugucauccaguguucuggcgggagcggacccauuaucugcgccggcccuauucacuccaacaaaucugcugacaucccgcaucuccugggguacagcgagaagaucugucaaauugauagacuuauccacguuuccucuuggcugcggaaucauagccaguuccagggauaugugggccagcgcgggggaagaucccaagugagcuacuaucccgccgaaaacucuuacucccgguggagcggccuccugucuccuugcgacgcggauuggcuuggcaugcuggucgugaaaaaggcuaaaggguccgacaugauuguucccggaccuagcuauaagggcaagguguuuuucgagcgccccaccuuugauggguacgucggauggggcugugggucuggaaaauccagaacagaaagcggcgagcucugcuccucugacagcggcacguccagcgggcugcugccuucugaucgggugcucuggaucggagacguugccugucagccgaugacccccauuccugaagagacauuccuggagcuuaaguccuuuagccagucugaauuucccgauaucugcaaaauugacggcaucguguuuaaucagugugagggggaaagccugccucaacccaucgaugucgccuggauggacgugggacacucccauaagauuaucaugcgcgagcacaaaaccaagugggugcaggagucuagcuccaaggauuucgucugcuauaaagaaggcacagggccguguagcgagucugaagagaagaccugcaaaacauccggaagcugcagaggcgacaugcaguuuuguaagguugcuggcugcgaacacggggaggaggccucugaagcuaaaugucggugcucccucgugcauaagccuggagagguggucgugagcuacggcgggaugcgcguuagacccaaauguuacggauucucccggaugauggccacccuggaagugaaccagccugagcaacgcauuggccagugcacggggugucaccuugaaugcaucaauggcggagucagacugauuacccucacaucugagcucaagagcgcgaccgugugugccucccauuuuugcucuagcgcuacauccggcaagaaaagcaccgagauccaguuccacucugggucccugguuggaaagacggccauccacgugaaaggcgcucuggucgacgggacagaguucaccuuugaaggaagcuguauguuccccgauggcugcgacgccguggauugcacauuuugucgggaguuccugaagaacccccaaugcuauccugcgaaaaaguggcuuuuuauuaucauugucauccugcucggguacgccggccugaugcuucugaccaaugugcucaaggcuauuggaaucuggggcucuuggguuaucgccccggugaaacugauuuucgcuaucauuaagaaacugaugcgcaccgucuccugucucauggggaagcugauggacagaggaagacaggugauccaugaagaaauuggcgagaaccgggaggggaaucaggaugacguucgcaucgaaauggcccggcccagacgcgugcggcacuggauguauagcccugucauucuuacaauccuggccaucggacucgcugagucuugcgaugaaauggugcaugcggacagcaaacugguguccuguagacagggcagcgggaacaugaaggagugcguuacgaccggccgcgcccuucugcccgcugucaauccuggacaagaggccugucuccacuuuacagcccccggcucuccggauuccaagugccugaaaauuaaggugaaacggaucaaccugaaguguaaaaagagcuccucuuacuucgugccugacgcuagaagccgcugcaccuccguccggagaugucgcugggccggggauugccagucuggaugucccccucauuuuacaagcaauuccuucucugacgacugggcgggcaagauggaucgggcugggcucggauuuagcggcugcuccgacgggugcggcggagccgccuguggcugcuucaacgcugcccccagcuguauuuucuggagaaaauggguggaaaauccucacgggaucauuuggaagguuucucccugcgcugccugggugccguccgcggucaucgagcugaccaugccuagcggagaagugcggacguuccaccccaugucuggcauccccacacagguuuucaaagggguguccgucaccuaucuuggaagcgauauggaggugucuggccugaccgaccucugugaaauugaggagcugaaguccaaaaagcuggcccuugcuccuugcaaccaggccggcauggggguugugggaaaagucggcgaaauccaauguagcuccgaggaaagcgcucgcacaauuaagaaggaugggugcaucuggaacgccgaccucgugggaauugagcugagaguggaugacgcggucuguuacucuaaaaucaccagcguugaagccguggcuaauuauuccgccaucccgacaacgauuggcgggcugcgguuugagagaucucaugauagccagggaaagaucuccggcucuccccucgacauuaccgcuauccgcggcagcuucuccgugaacuaccgggggcugagacuuucucugagcgagauuacagcuaccugcacaggagaagucaccaauguguccggcugcuacagcuguaugacgggggccaaaguuucuaucaagcuccacuccagcaaaaacucuaccgcccaugugcgcugcaagggagaugagacagcguuuuccguccuggaaggcgugcacagcuauaccguuucccugucuuucgaccacgccguggucgaugagcagugucagcuuaauugcgggggacaugaaagccaagugacacucaagggcaaccugaucuuucuggacguuccuaaauucguggacggcuccuacaugcagaccuaucacagcacgguccccacaggggcuaauauuccuucucccaccgauuggcucaacgcccuguuuggaaauggccuuuccagauggauccugggggugauuggagugcuccugggcgggcuggcccuuuucuuuaugaucaugagccucuucaagcugggaacaaaacaggucuuucggucucgcaccaagcuggcuuga

SEQ ID NO: 14888 - RNA, 3222 nt, Artificial Sequence
  derived and/or modified CDS sequence (opt5) from SFTSV/FTLSV(2012YSH10)__KF711940.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucuaaucgggugcucuggaucggggacguugccugucagccgaugacccccauuccugaagagacauuccuggagcuuaaguccuuuagccagucugaauuucccgauaucugcaaaauugacggaaucguguuuaaccagugugagggcgaaagccugccucaacccuucgaugucgccuggauggacguggggcacucccauaagaucauuaugcgcgagcacaaaaccaagugggugcaggagucuagcuccaaggauuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcguuagacccaaauguuacggguuuucccggaugauggccacccuggaagugaaucagccugagcaacgcaucggacagugcacgggcugucaccuugaaugcauuaacgggggcgucagacugaucacccucacaucugagcugaagucugcgaccgugugugccucccauuucugcucuagcgcuauguccggaaagaaaagcacagagauucaguuccacucuggcucccugguugggaagaccgccauccacgugaaaggagcucucgucgacggcacggaauuuacauucgaggggagcuguauguuucccgauggaugcgacgccguggauugcaccuucugucgggaauuucugaagaauccccaaugcuauccugcgaaaaaguggcuuuucaucauuaucgucauucugcucggcuacgccgggcugaugcuucugacaaacgugcucaaggcuaucggcauuuggggaucuuggguuaucgccccggugaaacugaucuuugcuauuaucaagaaacugaugcgcaccgucuccugucucaugggcaagcugauggacagagggagacaggugauucaugaggaaaucggagagaaucgggagggcaaccaggaugacguucgcauugaaauggcccggcccagacgcgugcggcacuggauguauagcccugucauccuuaccauucuggccaucgggcucgcugagucuugcgaugaaauggugcaugcggacagcaaacugguguccuguagacagggaagcggcaauaugaaggagugcguuacaacggggcgcgcccuucugcccgcugucaacccuggccaagaggccugucuccacuucaccgcccccggaucuccggauuccaagugccugcggaucaaagugaagagaauuaaucugaaauguaagaaaagcuccucuuacuuugugccugacgcucgcagccggugcacauccgucagacgcugucggugggccggcgauugccagucugggugucccccucauuucaccagcaacuccuuuucugacgacugggcgggaaagauggauagagcuggccucggguucagcggaugcuccgacggcugcgggggcgccgccuguggaugcuuuaaugcugcccccagcuguaucuucuggcggaaguggguggaaaacccucacggcauuaucuggaaaguuucucccugcgcugccugggugccguccgcggucauugagcugacaaugccuagcggggaagugcgcaccuuccaccccaugucuggaauccccacgcagguuuuuaagggcguguccgucacauaucuugggagcgauauggaggugucuggacugaccgaccucugugaaaucgaggagcugaaauccaagaaacuggcccuugcuccuugcaaccaggccggcaugggcguuguggggaaggucggagaaauucaauguagcuccgaggaaagcgcuagaaccaucaaaaaggauggcugcauuuggaaugccgaccucguggggaucgagcugcggguggaugacgcggucuguuacucuaagauuacaagcguugaagccguggcuaacuauuccgccaucccgaccacaaucggaggccugagauucgagcgcucucaugauagccaggggaaaauuuccggaucuccccucgacaucacggcuauucggggcagcuuuuccgugaauuacagaggccugcgccuuucucugagcgagaucaccgccacaugcaccggggaagucacaaacguguccggaugcuacagcuguaugaccggcgccaagguuucuauuaaacuccacuccagcaagaauagcacggcucaugugagaugcaaaggggaugagaccgcguucuccguccuggaaggagugcacagcuauacaguuucccugucuuuugaccacgccguggucgaugagcagugucagcuuaacugcggcgggcaugaaagccaagugacccucaagggaaaucugaucuuccuggacguuccuaaguuuguggacggcuccuacaugcagacauaucacagcaccguccccacgggcgcuaacaucccuucucccacagauuggcucaaugcccuguucgggaacggacuuucccggugggugcugggcgugauggggguccuccugggaggccuggcccuuuucuucaugauuaugagccucuuuaaacuggggaccaagcagguuuuccgcucuagaacaaaacuggcuuga

SEQ ID NO: 14889 - RNA, 3222 nt, Artificial Sequence
  derived and/or modified CDS sequence (opt5) from SFTSV/FTLSV(2012YSH104)__KF711943.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucuaaucgggugcucuggaucggggacguugccugucagccgaugacccccauuccugaagagacauuccuggagcuuaaguccuuuagccagucugaauuucccgauaucugcaaaauugacggaaucguguuuaaccagugugagggcgaaagccugccucaacccuucgaugucgccuggauggacguggggcacucccauaagaucauuaugcgcgagcacaaaaccaagugggugcaggagucuagcuccaaggauuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcguuagacccaaauguuacggguuuucccggaugauggccacccuggaagugaaucagccugagcaacgcaucggacagugcacgggcugucaccuugaaugcauuaacgggggcgucagacugaucacccucacaucugagcugaaguccgcgaccgugugugccucccauuucugcucuagcgcuacauccggaaagaaaagcaccgagauucaguuccacucuggcucccugguugggaagacggccauccacgugaaaggagcucucgucgacggcacagaauuuaccuucgaggggagcuguauguuucccgauggaugcgacgccguggauugcacauucugucggaaguuucugaaaaauccccaaugcuauccugcgaagaaguggcuuuucaucauuaucgucauucugcucggcuacgccgggcugaugcuucugaccaacgugcucaaagcuaucggcauuuggggaucuuggguuaucgccccggugaagcugaucuuugcuauuaucaaaaagcugacccgcacagucuccugucucaugggcaaacugauggacagagggagacaggugauucaugaagagaucggagaaaaucgggagggcaaccaggaugacguucgcauugagauggcccggcccagacgcgugcggcacuggauguauagcccugucauccuuacgauucuggccaucgggcucgcugaaucuugcgaugagauggugcaugcggacagcaagcugguguccuguagacagggaagcggcaauaugaaggaaugcguuaccacagggcgcgcccuucugcccgcugucaacccuggccaagaggccugucuccacuucaccgcccccggaucuccggauuccaaaugccugcggaucaaggugaaaagaauuaaucugaaguguaaaaagagcuccucuuacuuugugccugacgcucgcuaucggugcacaagcgucagacgcugucggugggccggcgauugccaguccgggugucccccucauuucaccucuaacagcuuuuccgacgacugggcgggaaagauggauagagcuggccucggguucucuggaugcagcgacggcugcgggggcgccgccuguggaugcuuuaaugcugcccccuccuguaucuucuggcggaaauggguggagaacccucacggcauuaucuggaagguuagccccugcgcugccugggugccgucugcggucauugaacugacgaugccuuccggggaggugcgcacauuccaccccaugagcggaauccccacccagguuuuuaaaggcgugucugucaccuaccuuggguccgauauggaagugagcggacugacagaccucugugagaucgaggaacugaagucuaaaaagcuggcccuugcuccuugcaaccaggccggcaugggcguuguggggaaagucggagagauucaauguuccagcgaagaguccgcuagaaccaucaagaaggauggcugcauuuggaaugccgaccucguggggaucgaacugcggguggaugacgcggucuguuauagcaaaauuacaucuguugaggccguggcuaacuacagcgccaucccgacgaccaucggaggccugagauucgaacgcucccaugauucucaggggaagauuagcggaagcccccucgacaucacagcuauucggggcucuuuuagcgugaauuacagaggccugcgccuuucccugucugagaucaccgccacaugcaccggggaggucacgaacgugagcggaugcuauuccuguaugaccggcgccaaaguuagcauuaagcuccacucuuccaaaaauagcacagcucaugugagaugcaagggggaugaaaccgcguucucuguccuggagggagugcacuccuacacaguuagccuguccuuugaccacgccguggucgaugaacagugucagcuuaacugcggcgggcaugagucucaagugacccucaagggaaaucugaucuuccuggacguuccuaaauuuguggacggcagcuauaugcagacguaccacuccacaguccccaccggcgcuaacaucccuagccccacagauuggcucaaugcccuguucgggaacggacuuucucggugggugcugggcgugauggggguccuccugggaggccuggcccuuuucuucaugauuaugucccucuuuaagcuggggaccaaacagguuuuccgcagcagaaccaagcuggcuuga

SEQ ID NO: 14890 - RNA, 3222 nt, Artificial Sequence
  derived and/or modified CDS sequence (opt5) from SFTSV/FTLSV(2012YSH105)__KF711944.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucuaaucgggugcucuggaucggggacguugccugucagccgaugacccccauuccugaagagacauuccuggagcuuaaguccuuuagccagucugaauuucccgauaucugcaaaauugacggaaucguguuuaaccagugugagggcgaaagccugccucaacccuucgaugucgccuggauggacguggggcacucccauaagaucauuaugcgcgagcacaaaaccaagugggugcaggagucuagcuccaaggauuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcguuagacccaaauguuacggguuuucccggaugauggccacccuggaagugaaucagccugagcaacgcaucggacagugcacgggcugucaccuugaaugcauuaacgggggcgucagacugaucacccucacaucugagcugaagucugcgaccgugugugccucccauuucugcucuagcgcuacauccggaaagaaaagcaccgagauucaguuccacucuggcucccugguugggaagacggccauccacgugaaaggagcucucgucgacggcacagaauuuaccuucgaggggagcuguauguuucccgauggaugcgacgccguggauugcacauucugucgggaauuucugaagaauccccaaugcuauccugcgaaaaaguggcuuuucaucauuaucgucauucugcucggcuacgccgggcugaugcuucugaccaacgugcucaaggcuaucggcauuuggggaucuuggguuaucgccccggugaaacugaucuuugcuauuaucaagaaacugaugcgcaccgucuccugucucaugggcaagcugauggacagagggagacaggugauucaugaggaaaucggagagaaucgggagggcaaccaggaugacguucgcauugaaauggcccggcccagacgcgugcggcacuggauguauagcccugucauccuuacaauucuggccaucgggcucgcugagucuugcgaugaaauggugcaugcggacagcaaacugguguccuguagacagggaagcggcaauaugaaggagugcguuacgaccgggcgcgcccuucugcccgcugucaacccuggccaagaggccugucuccacuucacagcccccggaucuccggauuccaagugccugcggaucaaagugaagagaauuaaucugaaauguaagaaaagcuccucuuacuuugugccugacgcucgcagccggugcaccuccgucagacgcugucggugggccggcgauugccagucugggugucccccucauuucacaagcaacuccuuuucuggagacugggcgggcaagauggacagagcugggcucggauucagcggcugcuccgaugggugcggcggagccgccuguggcugcuuuaaugcugcccccagcuguaucuucuggcggaaguggguggaaaacccucacgggauuaucuggaaaguuucucccugcgcugccugggugccguccgcggucauugagcugaccaugccuagcggagaagugcgcacguuccaccccaugucuggcauccccacacagguuuuuaaggggguguccgucaccuaucuuggaagcgacauggaggugucuggccugaccgaucucugugaaaucgaggagcugaaauccaagaaacuggcccuugcuccuugcaaccaggccggcauggggguugugggaaaggucggcgaaauucaauguagcuccgaggaaagcgcuagaacaaucaaaaaggacgggugcauuuggaaugccgaucucgugggaaucgagcugcggguggacgaugcggucuguuacucuaagauuaccagcguugaagccguggcuaacuauuccgccaucccgacaacgaucggcgggcugagauucgagcgcucucaugacagccagggaaaaauuuccggcucuccccucgauaucaccgcuauucggggcagcuuuuccgugaauuacagagggcugcgccuuucucugagcgagaucacagcuaccugcacaggagaagucaccaacguguccggcugcuacagcuguaugacgggggccaagguuucuauuaaacuccacuccagcaagaauagcaccgcccaugugagaugcaaaggagacgagacagcguucuccguccuggaaggcgugcacagcuauaccguuucccugucuuuugaucacgccguggucgacgagcagugucagcuuaacugcgggggacaugaaagccaagugacacucaagggcaaucugaucuuccuggauguuccuaaguuuguggacggcuccuacaugcagaccuaucacagcacgguccccacaggggcuaacaucccuucucccaccgacuggcucaaugcccuguucggaaacggccuuucccgguggauucugggggugaugggagugcuccugggcgggcuggcccuuuucuucaugaucaugagccucuuuaaacugggaacaaagcaggucuuccgcucuagaaccaaacuggcuuga

SEQ ID NO: 14891 - RNA, 3222 nt, Artificial Sequence
  derived and/or modified CDS sequence (opt5) from SFTSV/FTLSV(2012YSH107)__KF711942.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucuaaucgggugcucuggaucggggacguugccugucagccgaugacccccauuccugaagagacauuccuggagcuuaaguccuuuagccagucugaauuucccgauaucugcaaaauugacggaaucguguuuaaccagugugagggcgaaagccugccucaacccuucgaugucgccuggauggacguggggcacucccauaagaucauuaugcgcgagcacaaaaccaagugggugcaggagucuagcuccaaggauuuugucugcuauaaagaaggaacaggcccguguagcgagucugaagagaagaccgggaaaacauccggaagcugcagaggcgacaugcaguucugcaagguugcuggcugugaacacggggaggaggccucugaagcuaaaugccgguguucccucgugcauaagccuggagagguggucgugagcuacggcgggaugcgcguuagacccaaaugcuacggauuuucccggaugauggccacccuggaagugaaucagccugagcaacgcaucggccaguguacggggugccaccuugaauguauuaacggcggagucagacugaucacccucacaucugagcugaaguccgcgaccgugugcgccucccauuucuguucuagcgcuacauccggcaagaaaagcaccgagauucaguuccacucugggucccugguuggaaagacggccauccacgugaaaggcgcucucgucgacgggacagaauuuaccuucgagggaagcugcauguuucccgauggcugugacgccguggauugcacauucugccgggaauuucugaagaauccccaauguuauccugcgaaaaaguggcuuuucaucauuaucgucauucugcucggguacgccggccugaugcuucugaccaacgugcucaaggcuaucggaauuuggggcucuuggguuaucgccccggugaaacugaucuuugcuauuaucaagaaacugaugcgcaccgucuccugccucauggggaagcugauggacagaggaagacaggugauucaugaggaaaucggcgagaaucgggaggggaaccaggaugacguucgcauugaaauggcccggcccagacgcgugcggcacuggauguauagcccugucauccuuacaauucuggccaucggacucgcugagucuugugaugaaauggugcaugcggacagcaaacugguguccugcagacagggcagcgggaauaugaaggaguguguuacgaccggccgcgcccuucugcccgcugucaacccuggacaagaggccugccuccacuucacagcccccggcucuccggauuccaagugucugcggaucaaagugaagagaauuaaucugaaaugcaagaaaagcuccucuuacuuugugccugacgcucgcuaucgguguaccagcgucagacgcugccggugggccggggauugucaguccggaugucccccucauuucacaucuaacagcuuuuccgacgacugggcgggcaagauggauagagcugggcucggauucucuggcugcagcgacgggugcggcggagccgccugcggcuguuuuaaugcugcccccuccugcaucuucuggcggaaguggguggaaaacccucacgggauuaucuggaaaguuagccccugugcugccugggugccgucugcggucauugagcugaccaugccuuccggagaagugcgcacguuccaccccaugagcggcauccccacacagguuuuuaagggggugucugucaccuaccuuggauccgauauggaggugagcggccugaccgaccucugcgaaaucgaggagcugaaaucuaagaaacuggcccuugcuccuuguaaccaggccggcauggggguugugggaaaggucggcgaaauucaaugcuccagcgaggaauccgcuagaacaaucaaaaaggauggguguauuuggaaugccgaccucgugggaaucgagcugcggguggaugacgcggucugcuauagcaagauuaccucuguugaagccguggcuaacuacagcgccaucccgacaacgaucggcgggcugagauucgagcgcucccaugauucucagggaaaaauuagcggcagcccccucgacaucaccgcuauucggggcucuuuuagcgugaauuacagagggcugcgccuuucccugucugagaucacagccaccuguacaggagaagucaccaacgugagcggcugcuauuccugcaugacgggggccaagguuagcauuaaacuccacucuuccaagaauagcaccgcucaugugagauguaaaggagaugagacagcguucucuguccuggaaggcgugcacuccuacaccguuagccuguccuuugaccacgccguggucgaugagcagugccagcuuaacugugggggacaugaaucucaagugacacucaagggcaaucugaucuuccuggacguuccuaaguuuguggacggcagcuauaugcagaccuaccacuccacgguccccacaggggcuaacaucccuagccccaccgauuggcucaaugcccuguucggaaacggccuuucucggugggugcugggggugaugggaguccuccugggcgggcuggcccuuuucuucaugauuaugucccucuuuaaacugggaacaaagcagguuuuccgcagcagaaccaaacuggcuuga

SEQ ID NO: 14892 - RNA, 3222 nt, Artificial Sequence
  derived and/or modified CDS sequence (opt5) from SFTSV/FTLSV(2012YSH14)__KF711938.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuccuggagcuuaaguccuuuagccagucugaguuccccgacaucugcaaaauugauggaaucguguuuaaucagugugaaggcgaaagccugccucaacccuucgacgucgccuggauggauguggggcacucccauaagaucauuaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcguuagacccaaauguuacggguuuucccggaugauggccacccuggaagugaaccagccugagcaacgcaucggacagugcacgggcugucaccuugaaugcauuaucgggggcgucagacugauuacccucacaucugagcuuaagagcgcgaccgugugugccucccauuucugcucuagcgcuacauccggaaagaaaagcaccgagauccaguuccacucuggcucccugguugggaagacggccauccacgugaaaggagcucucgucgauggcacagaauuuaccuucgaggggagcuguauguuucccgacggaugcgaugccguggacugcacauucugucgggaauuucugaagaauccccaaugcuauccugcgaaaaaguggcuuuucauuaucauugucauccugcucggcuacgccgggcugaugcuucugaccaacgugcucaaggcuauuggcaucuggggaucuuggguuaucgccccggugaaacugauuuuugcuaucauuaagaaacugaugcgcaccgucuccugucucaugggcaagcugauggauagagggagacaggugauccaugaggaaauuggagagaaucgggagggcaaccaggacgauguucgcaucgaaauggcccggcccagacgcgugcggcacuggauguauagcccugucauucuuacaauccuggccaucgggcucgcugagucuugcgacgaaauggugcaugcggauagcaaacugguguccuguagacagggaagcggcaauaugaaggagugcguuacgaccgggcgcgcccuucugcccgcugucaacccuggccaagaggccugucuccacuucacagcccccggaucuccggacuccaagugccugaaaauuaaggugaaacggaucaaucugaaguguaaaaagagcuccucuuacuuugugccugaugcuagaagccgcugcaccuccguccggagaugucgcugggccggcgacugccagucugggugucccccucauuucacaagcaacuccuuuucugacgauugggcgggaaagauggaccgggcuggccucggguucagcggaugcuccgauggcugcgggggcgccgccuguggaugcuuuaaugcugcccccagcuguauuuucuggagaaaauggguggaaaacccucacggcaucauuuggaagguuucucccugcgcugccugggugccguccgcggucaucgagcugaccaugccuagcggggaagugcggacguuccaccccaugucuggaauccccacacagguuuuuaaaggcguguccgucaccuaucuugggagcgacauggaggugucuggacugaccgaucucugugaaauugaggagcugaaguccaaaaagcuggcccuugcuccuugcaaucaggccggcaugggcguuguggggaaagucggagaaauccaauguagcuccgaggaaagcgcucgcacaauuaagaaggacggcugcaucuggaacgccgaucucguggggauugagcugagaguggacgaugcggucuguuacucuaaaaucaccagcguugaagccguggcuaacuauuccgccaucccgacaacgauuggaggccugcgguucgagagaucucaugacagccaggggaagaucuccggaucuccccucgauauuaccgcuauccgcggcagcuuuuccgugaauuaccggggccugagacuuucucugagcgagauuacagcuaccugcacaggggaagucaccaacguguccggaugcuacagcuguaugacgggcgccaaaguuucuaucaagcuccacuccagcaaaaauucuaccgcccaugugcgcugcaagggggacgagacagcguucuccguccuggaaggagugcacagcuauaccguuucccugucuuuugaucacgccguggucgacgagcagugucagcuuaacugcggcgggcaugaaagccaagugacacucaagggaaaucugaucuuccuggacguuccuaaauuuguggauggcuccuacaugcagaccuaucacagcacgguccccacaggcgcuaacauuccuucucccaccgacuggcucaaugcccuguucgggaacggacuuuccagauggauccugggcgugauuggggugcuccugggaggccuggcccuguuuuucaugaucaugagccucuuuaagcuggggacaaaacaggucuuccggucucgcaccaagcuggcuuga

SEQ ID NO: 14893 - RNA, 3222 nt, Artificial Sequence
  derived and/or modified CDS sequence (opt5) from SFTSV/FTLSV(2012YSH16)__KF711934.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuccuggagcuuaaguccuuuagccagucugaauuucccgacaucugcaaaauugauggaaucguguuuaaucagugugagggcgaaagccugccucaacccuucgacgucgccuggauggauguggggcacucccauaagaucauuaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcguuagacccaaauguuacggguuuucccggaugauggccacccuggaagugaaccagccugagcaacgcaucggacagugcacgggcugucaccuugaaugcauuaaugggggcgucagacugaucacccucacaucugagcugaaguccgcgaccgugugugccucccauuucugcucuagcgcuacauccggaaagaaaagcaccgagauucaguuccacucuggcucccugguugggaagacggccauccacgugaaaggagcucucgucgauggcacagaauuuaccuucgaggggagcuguauguuucccgacggaugcgaugccguggacugcacauucugucgggaauuucugaagaacccccaaugcuauccugcgaaaaaguggcuuuucaucauuaucgucauucugcucggcuacgccgggcugaugcuucugaccaaugugcucaaggcuaucggcauuuggggaucuuggguuaucgccccggugaaacugaucuuugcuauuaucaagaaacugaugcgcaccgucuccugucucaugggcaagcugauggauagagggagacaggugauucaugaggaaaucggagagaaccgggagggcaaucaggacgauguucgcauugaaauggcccggcccagacgcgugcggcacuggauguauagcccugucauccuuacaauucuggccaucgggcucgcugagucuugcgacgaaauggugcaugcggauagcaaacugguguccuguagacagggaagcggcaacaugaaggagugcguuacgaccgggcgcgcccuucugcccgcugucaauccuggccaagaggccugucuccacuucacagcccccggaucuccggacuccaagugccugaaaaucaaggugaaacggauuaaccugaaguguaaaaagagcuccucuuacuuugugccugaugcuagauaucgcugcaccagcguccggagaugucgcugggccggcgacugccaguccgggugucccccucauuucacaucuaauagcuuuuccgacgauugggcgggaaagauggaccgggcuggccucggguucucuggaugcagcgauggcugcgggggcgccgccuguggaugcuuuaacgcugcccccuccuguaucuucuggagaaaauggguggaaaauccucacggcauuaucuggaagguuagccccugcgcugccugggugccgucugcggucauugagcugaccaugccuuccggggaagugcggacguuccaccccaugagcggaauccccacacagguuuuuaaaggcgugucugucaccuaccuuggguccgacauggaggugagcggacugaccgaucucugugaaaucgaggagcugaagucuaaaaagcuggcccuugcuccuugcaaccaggccggcaugggcguuguggggaaagucggagaaauucaauguuccagcgaggaauccgcucgcacaaucaagaaggacggcugcauuuggaacgccgaucucguggggaucgagcugagaguggacgaugcggucuguuauagcaaaauuaccucuguugaagccguggcuaauuacagcgccaucccgacaacgaucggaggccugcgguucgagagaucccaugacucucaggggaagauuagcggaagcccccucgauaucaccgcuauucgcggcucuuuuagcgugaacuaccggggccugagacuuucccugucugagaucacagcuaccugcacaggggaagucaccaaugugagcggaugcuauuccuguaugacgggcgccaaaguuagcauuaagcuccacucuuccaaaaacagcaccgcccaugugcgcugcaagggggacgagacagcguucucuguccuggaaggagugcacuccuacaccguuagccuguccuuugaucacgccguggucgacgagcagugucagcuuaauugcggcgggcaugaaucucaagugacacucaagggaaaccugaucuuccuggacguuccuaaauuuguggauggcagcuauaugcagaccuaccacuccacgguccccacaggcgcuaauaucccuagccccaccgacuggcucaacgcccuguucgggaauggacuuucuagauggauucugggcgugaucggggugcuccugggaggccuggcccuuuucuucaugauuaugucccucuuuaagcuggggacaaaacaggucuuccggagccgcaccaagcuggcuuga

SEQ ID NO: 14894 - RNA, 3222 nt, Artificial Sequence
  derived and/or modified CDS sequence (opt5) from SFTSV/FTLSV(2012YSH6)__KF711921.1__GP
augaugaaggugaucugguucagcucccugauuugccucgucauccaguguucuggcgacagcgggcccauuaucugcgccggaccuauucacuccaacaaaucugcuggcaucccgcaucugcuuggguacagcgagaagaucugucaaauugauagacugauccacguuuccucuuggcuccggaaucauagccaguuucagggauaugugggccagcgcgggggaagaucccaagugagcuacuaucccgccgaaaacucuuacucccgguggaauggccugcuuagcccuugcgacgcggauuggcugggcaugcucgucgugaaaaaggcuaaagagucugacaugauuguucccgggccuuccuauaagggaaagguguucuuugaacgccccaccuucgauggcuacgucggguggggauguggcagcgggaaaucuagaacagaguccggagaacugugcagcuccgacucuggcacgagcuccggccugcucccuagcgaucgggugcuguggaucggggacguugccugucagccgaugacccccauuccugaggagacauuucuugaacugaagucuuucucccagagcgaguuucccgauaucugcaaaauugacggaaucguguucaaccagugugaaggcgagucucucccucaacccuuugaugucgccuggauggacguggggcacagccauaagaucauuaugcgcgagcacaaaaccaagugggugcaggaauccucuagcaaggauuucgucugcuauaaagagggaacaggcccguguuccgaaagcgaggaaaaggcuugcaaaaccucuggguccugcagaggagacaugcaguuuuguaagguugccggcugcgagcacggcgaggaagcuagcgaggccaaaugucggugcucucuggugcauaagccuggggaaguggucguguccuacggaggcaugcgcguuagacccaaauguuacggguucagccggaugauggcgacacuugaggugaauccucccgaacagcgcaucggacaaugcaccggcugucaccuggagugcauuaacgggggcgucagacucaucacgcugaccuccgagcugcggucugccacagugugugcuagccauuuuugcuccucugccaccagcggaaagaaguccacagaaauucacuuccacagcggcucucucguugggaaaaccgcuauccaugugaagggagcccuggucgacggcacggaguucacauuugaaggguccuguauguuccccgauggaugcgacgcgguggauugcaccuuuugucgcgaguuccuuaaaaauccucagugcuauccggccaagaaauggcuguuuaucauuaucgucauucuccugggcuacgcugggcuuaugcuggugacaaacguucucaaggccaucggcguguggggaagcugggucauugcucccgugaagcugauguucgccaucaucaaaaagcugaugagaaccguuucuugucucgugggcaaacugauggaccgggggagacaggucauucacgaagagaucggagagaauggcgaagggaaccaagaugacgugcgcauugagauggcccggccuagacgcgugcggcauuggauguauucccccguuauccuuaccauucuggcuaucggacucgcggaaggcugcgaugagaugguccacgccgacagcaagcuggugucuuguagacaggggagcggcaauaugaaagagugcauuacaacgggacgcgcucugcugccugccgugaaccccggccaggaagccugucuccauuuuaccgcuccgggguccccugauagcaagugccugaagaucaaagucaagcggaucaaucugaaauguaagaaaucuuccagcuacuucgugcccgacgccagaucccgcugcacaucuguucggagaugucgcugggcgggagauugccagagcggcugcccuccccacuuuaccuccaacucuuucagcgacgacugggcugggaagauggaucgggccggacucggcuuuuccggguguucugacggcugcggaggcgccgcuugugggugcuucaaugccgcuccuagcuguaucuuuuggagaaaguggguggagaacccccacggaauuauuuggaaagucuccccgugcgccgcgugggugccuagcgccguuaucgaacugacaaugcccucuggcgaggugcggaccuuccaucccauguccgggauuccuacgcaagucuucaagggagugagcguuacauaucuuggcucugauauggaaguguccggccugaccgaccucugugagaucgaggaacugaaaagcaagaaacuggcucuugccccgugcaaccaggcugggaugggagucgugggcaaggugggggagauccaguguucuuccgaagagagcgcccgcaccauuaaaaaggauggaugcaucuggaaugcggaccucgucggcauugaacugagaguugaugacgccguguguuacuccaagaucacaagcguggaggcugucgccaacuauucugcuauucccaccacaaucgggggacugcgguuugagagaagccacgauucccagggcaaaaucucuggcagcccucucgacauuacggccauccgcggguccuucucugugaauuaccggggacugagacuuagccuguccgaaauuaccgccacaugcaccggcgagguuacaaacgugucugggugcuacagcuguaugaccggagcuaaggucuccaucaaacuccauagcucuaaaaauuccacggcgcacgugcgcugcaagggcgaugaaaccgccuuuagcguucuggagggggugcacucuuauauugucucccugagcuucgaccaugcugugguugaugaacaaugucagcuuaacugcggaggccacgagucccaggugacacucaagggcaaucugaucuuucuggacguccccaaguucguggacgggucuuacaugcagaccuaucauagcacagugccuaccggagccaacauccccuccccuacggauuggcucaaugcccuguuuggcaacgggcuuagcagauggauucugggagucaucggcguucuccuugggggacuggcucuuuucuuucucauuauguuccugcugaaacucggcacaaagcaaguguuucggucucgcaccaaacuggccuga

SEQ ID NO: 14895 - RNA, 3222 nt, Artificial Sequence
  derived and/or modified CDS sequence (opt5) from SFTSV/FTLSV(2012YSH86)__KF711939.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuccuggagcuuaaguccuuuagccagucugaguuccccgacaucugcaaaauugauggaaucguguuuaaucagugugaaggcgaaagccugccucaacccuucgacgucgccuggauggauguggggcacucccauaagaucauuaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcguuagacccaaaugucacggguuuucccggaugauggccacccuggaagugaaccagccugagcaacgcaucggacagugcacgggcugucaucuugaaugcauuaaugggggcgucagacugaucacccucacaucugagcuuaagagcgcgaccgugugugccucccacuucugcucuagcgcuacauccggaaagaaaagcaccgagauucaguuccacucuggcucccugguugggaagacggccauccaugugaaaggagcucucgucgauggcacagaauuuaccuucgaggggagcuguauguuucccgacggaugcgaugccguggacugcacauucugucgggaauuucugaagaacccccaaugcuacccugcgaaaaaguggcuuuucaucauuaucgucauucugcucggcuaugccgggcugaugcuucugaccaaugugcucaaggcuaucggcauuuggggaucuuggguuaucgccccggugaaacugauguuugcuaucauuaagaaacugaugcgcaccgucuccugucucaugggcaagcugauggauagagggagacaggugauccacgaggaaauuggagagaaccgggagggcaaucaggacgauguucgcaucgaaauggcccggcccagacgcgugcggcauuggauguacagcccugucauucuuacaauccuggccauugggcucgcugagucuugcgacgaaauggugcacgcggauagcaaacugguguccuguagacagggaagcggcaacaugaaggagugcguuacgaccgggcgcgcccuucugcccgcugucaauccuggccaagaggccugucuccauuucacagcccccggaucuccggacuccaagugccugaaaaucaaggugaaacggaucaaccugaaguguaaaaagagcuccucuuauuuugugccugaugcuagaagccgcugcaccuccguccggagaugucgcugggccggcgacugccagucugggugucccccucacuucacaagcaauuccuuuucugacgauugggcgggaaagauggaccgggcuggccucggguucagcggaugcuccgauggcugcgggggcgccgccuguggaugcuuuaacgcugcccccagcuguauuuucuggagaaaauggguggaaaauccucacggcaucauuuggaagguuucucccugcgcugccugggugccguccgcggucaucgagcugaccaugccuagcggggaagugcggacguuccaucccaugucuggcauucccacacagguuuuuaaaggaguguccgucaccuaccuugggagcgacauggaggugucuggacugaccgaucucugugaaaucgaggagcugaaguccaaaaagcuggcccuugcuccuugcaaccaggccggcaugggcguuguggggaaagucggagaaauccaauguagcuccgaggaaagcgcucgcacaauuaagaaggacggcugcaucuggaacgccgaucucguggggauugagcugagaguggacgaugcggucuguuauucuaaaaucaccagcguugaagccguggcuaauuacuccgccauuccgacaacgaucggaggccugcgguucgagagaucucacgacagccaggggaagaucuccggaucuccccucgauauuaccgcuauccgcggcagcuuuuccgugaacuaucggggccugagacuuucucugagcgagauuacagcuaccugcacaggggaagucaccaauguguccggaugcuacagcuguaugacgggcgccaaaguuucuaucaagcuccauuccagcaaaaacucuaccgcccacgugcgcugcaagggggacgagacagcguucuccguccuggaaggagugcacagcuacaccguuucccugucuuuugaucaugccguggucgacgagcagugucagcuuaauugcggcgggcacgaaagccaagugacacucaagggaaaccugauuuuccuggacguuccuaaauuuguggauggcuccuauaugcagaccuaccauagcacgguccccacaggcgcuaauaucccuucucccaccgacuggcucaacgcccuguucgggaauggacuuuccagauggauccugggcgugauuggggugcuccugggaggccuggcccuguuuuucaugaucaugagccucuuuaagcuggggacaaaacagguccugcggucucgcaccaagcucgcuuga

SEQ ID NO: 14896 - RNA, 3222 nt, Artificial Sequence
  derived and/or modified CDS sequence (opt5) from SFTSV/FTLSV(2012YSH89)__KF711935.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuccuggagcuuaaguccuuuagccagucugaguuccccgacaucugcaaaauugauggaaucguguuuaaucagugugaaggcgaaagccugccucaacccuucgacgucgccuggauggauguggggcacucccauaagaucauuaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcguuagacccaaauguuacggguuuucccggaugauggccacccuggaagugaaccagccugagcaacgcaucggacagugcacgggcugucaccuugaaugcauuaaugggggcgucagacugaucacccucacaucugagcuuaagagcgcgaccgugugugccucccauuucugcucuagcgcuacauccggaaagaaaagcaccgagauucaguuccacucuggcucccugguugggaagacggccauccacgugaaaggagcucucgucgauggcacagaauuuaccuucgaggggagcuguauguuucccgacggaugcgaugccguggacugcacauucugucgggaauuucugaagaacccccaaugcuauccugcgaaaaaguggcuuuucaucauuaucgucauucugcucggcuacgccgggcugaugcuucugaccaaugugcucaaggcuaucggcauuuggggaucuuggguuaucgccccggugaaacugaucuuugcuauuaucaagaaacugaugcgcaccgucuccugucucaugggcaagcugauggauagagggagacaggugauucaugaggaaaucggagagaaccgggagggcaaucaggacgauguucgcauugaaauggcccggcccagacgcgugcggcacuggauguauagcccugucauccuuacaauucuggccaucgggcucgcugagucuugcgacgaaauggugcaugcggauagcaaacugguguccuguagacagggaagcggcaacaugaaggagugcguuacgaccgggcgcgcccuucugcccgcugucaauccuggccaagaggccugucuccacuucacagcccccggaucuccggacuccaagugccugaaaaucaaggugaaacggauuaaccugaaguguaaaaagagcuccucuuacuuugugccugaugcuagaagccgcugcaccuccguccggagaugucgcugggccggcgacugccagucugggugucccccucauuucacaagcaauuccuuuucugacgauugggcgggaaagauggaccgggcuggccucggguucagcggaugcuccgauggcugcgggggcgccgccuguggaugcuuuaacgcugcccccagcuguaucuucuggagaaaauggguggaaaauccucacggcauuaucuggaagguuucucccugcgcugccugggugccguccgcggucauugagcugaccaugccuagcggggaagugcggacguuccaccccaugucuggaauccccacacagguuuuuaaaggcguguccgucaccuaucuugggagcgacauggaggugucuggacugaccgaucucugugaaaucgaggagcugaaguccaaaaagcuggcccuugcuccuugcaaccaggccggcaugggcguuguggggaaagucggagaaauucaauguagcuccgaggaaagcgcucgcacaaucaagaaggacggcugcauuuggaacgccgaucucguggggaucgagcugagaguggacgaugcggucuguuacucuaaaauuaccagcguugaagccguggcuaauuauuccgccaucccgacaacgaucggaggccugcgguucgagagaucucaugacagccaggggaagauuuccggaucuccccucgauaucaccgcuauucgcggcagcuuuuccgugaacuaccggggccugagacuuucucugagcgagaucacagcuaccugcacaggggaagucaccaauguguccggaugcuacagcuguaugacgggcgccaaaguuucuauuaagcuccacuccagcaaaaacucuaccgcccaugugcgcugcaagggggacgaggcggccuucuccguccuggaaggagugcacagcuauacaguuucccugucuuuugaucacgcuguggucgacgagcagugucagcuuaauugcggcgggcaugaaagccaagugacccucaagggaaaccugaucuuccuggacguuccuaaauuuguggauggcuccuacaugcagacauaucacagcaccguccccacgggcgccaauaucccuucucccacagacuggcucaacgcccuguucgggaauggacuuuccagauggauucugggcgugaucggggugcuccugggaggccuggcucuguuuuucaugauuaugagccucuuuaagcuggggaccaaacaggucuuccggucucgcacaaagcuggccuga

SEQ ID NO: 14897 - RNA, 3222 nt, Artificial Sequence
  derived and/or modified CDS sequence (opt5) from SFTSV/FTLSV(2012YSH9)__KF711919.1__GP
augaugaaggugaucugguucagcucccugauuugccucgucauccaguguucuggcgacagcgggcccauuaucugcgccggaccuauucacuccaacaaaucugcuggcaucccgcaucugcuuggguacagcgagaagaucugucaaauugauagacugauccacguuuccucuuggcuccggaaucauagccaguuucagggauaugugggccagcgcgggggaagaucccgggugagcuacuaucccgccgaaaacucuuacucccgcuggagcggccugcuuucuccuugcgacgcggauuggcugggcaugcucgucgugaaaaaggcuaaagaguccgacaugauuguucccgggccuagcuauaagggaaagguguucuuugaaagacccaccuucgauggcuacgucggguggggauguggcucugggaaaucccggacagagagcggagaacugugcuccucugacagcggcacguccagcggccugcucccuucugaucgcgugcuguggaucggggacguugccugucaaccgaugacccccauuccugaggagacauuucuugaacugaaguccuucagccagucugaguuucccgauaucugcaaaauugacggaaucguguucaaucagugugaaggcgagagccucccucagcccuuugaugucgccuggauggacguggggcacucccauaagaucauuaugagagagcacaaaaccaagugggugcaagaaucuagcuccaaggauuucgucugcuauaaagagggaacaggcccguguagcgaaucugaggaaaaggcuugcaaaaccuccgggagcugccggggagacaugcaguuuuguaagguugccggcugcgagcacggcgaggaggcuucugaagccaaaugucgcugcucccuggugcauaagccuggggaaguggucgugagcuacggaggcaugagaguucggcccaaauguuacggguucucccgcaugauggcgacacuugaggugaacagaccugaacagcggaucggacagugcaccggcugucaccuggagugcauuaaugggggcguccgccucaucacgcugaccucugagcugagaagcgccacagugugugcuucccauuuuugcucuagcgccaccuccggaaagaagaacacagaaauucacuuccacagcggcucucucguugggaaaaccgcuauccaugugaagggagcccuggucgacggcacggaguucacauuugaaggguccuguauguuccccgauggaugcgacgcgguggauugcaccuuuugucgggaguuccuuaaaaauccccaaugcuauccugccaagaaauggcuguuuaucauuaucgucauucuccugggcuacgcugggcuuaugcugcucacaaacgugcugaaggccaucggcguuuggggaagcugggugauugcuccggucaagcugauguucgccaucaucaaaaagcucaugagaaccgugucuugucugguuggcaaacuuauggaccgcgggagacaggugauucacgaagagaucggagagaauggcgaagggaaccaggaugacgucagaauugagauggcccgcccccggagagugcgccauuggauguauuccccugugauccugaccauucucgcuaucggacuggcggaaggcugcgaugagaugguucacgccgacagcaagcuggucucuugucggcaagggagcggcaauaugaaagagugcauuacaacgggacgggcucugcuccccgccgugaacccuggccaggaagccugucugcauuuuaccgcucccggguccccggauagcaagugccugaagaucaaagugaagcgcaucaaucucaaauguaagaaaucuuccagcuacuucgucccugacgcccgguccagaugcacaucugugcgccgguguagaugggcgggagauugccagagcggcugucccccucacuuuaccuccaacucuuucagcgacgacugggcugggaagauggaucgggccggacugggcuuuuccgggugcucugacggcugcggaggcgccgcuugugggugcuucaaugccgcucccagcuguaucuuuuggcgcaaguggguugagaacccucacggaauuauuuggaaagugucccccugcgccgcgugggucccgagcgccgugaucgaacuuacaaugccuucuggcgagguuagaaccuuccaucccauguccgggauucccacacagguguucaagggagucagcgugacguaucugggcucugauauggaaguuuccggccucaccgaccugugugagaucgaggaacugaaaagcaagaaacuugcucucgccccuugcaaccaagcugggaugggaguggucggcaaggugggggagauccaguguucuuccgaagagagcgcccggaccauuaaaaaggauggaugcaucuggaaugcggaccuggugggcauugaacugagagucgaugacgccguuuguuacuccaagaucacaagcguggaggcuguggccaacuauucugcuauuccgaccacaaucgggggacuccgcuuugagcggagccacgauucccagggcaaaaucucuggcagcccccuggacauuacggccaucagaggguccuucucugucaauuaccgcggacuuagacugagccucuccgaaauuaccgccacaugcaccggcgaggugacaaacguuucugggugcuacagcuguaugaccggagcuaagguguccaucaaacugcauagcucuaaaaauuccacggcgcacguccggugcaagggcgaugaaaccgccuuuagcgugcuggaggggguucacucuuauauugugucccuuagcuucgaccaugcugucguggaugaacagugucaacucaacugcggaggccacgagucccagguuacacugaagggcaaucugaucuuucucgacgugccuaaguucgucgacgggucuuacaugcagaccuaucauagcacagugcccaccggagccaacaucccuucccccacggauuggcugaaugcccuuuuuggcaacgggcugagccgcuggauucucggagugaucggcguccugcuugggggacuugcucucuucuuucugauuauguuccugcucaaacugggcacaaagcagguuuuuagaucucggaccaaacuugccuga

SEQ ID NO: 14898 - RNA, 3222 nt, Artificial Sequence
  derived and/or modified CDS sequence (opt5) from SFTSV/FTLSV(2012YSH91)__KF711920.1__GP
augaugaaggugaucugguucagcucccugauuugccucgucauccaguguucuggcgacagcgggcccauuaucugcgccggaccuauucacuccaacaaaucugcuggcaucccgcaucugcuuggguacagcgagaagaucugucaaauugauagacugauccacguuuccucuuggcuccggaaucauagccaguuucagggauaugugggccagcgcgggggaagaucccaagugagcuacuaucccgccgaaaacucuuacucccgguggagcggccugcuuucuccuugcgacgcggauuggcugggcaugcucgucgugaaaaaggcuaaagaguccgacaugauuguucccgggccuagcuauaagggaaagguguucuuugaacgccccaccuucgauggcuacgucggguggggauguggcucugggaaauccagaacagagagcggagaacugugcuccucugacagcggcacguccagcggccugcucccuucugaucgggugcuguggaucggggacguugccugucagccgaugacccccauucacgaggagacauuucuugaacugaaguccuucagccagucugaguuuccugauaucugcaaaauugacggaaucguguucaaucagugugaaggcgagagccucccccaaccuuuugaugucgccuggauggacguggggcauucccacaagaucauuaugcgcgagcacaaaaccaagugggugcaggaaucuagcuccaaggauuucgucugcuauaaagagggaacaggccccuguagcgaaucugaggaaaaggcuugcaaaaccuccgggagcugcagaggagacaugcaguuuuguaagguugccggcugcgagcauggcgagaaggcuucugaaacaaagugucggugcucccuggugcacaaaccgggggagguggucgugagcuacggaggcaugcgcguuagaccuaaguguuacgggaucucccggaugauggccacccuugaagugaaucccccugagcagcgcauuggacaaugcacgggcugucaucuggaaugcaucaacgggggcgucagacucauuacccugacaucugagcugcggagcgcgaccgugugugccucccacuucugcucuagcgcuuccagcggaaagaaaucuacagagauccacuuucauuccggcagccucguugggaagaccgccauccacgugaaaggagcucuggucgacggcacggaguucacauucgaagggucuuguauguuucccgauggaugcgacgccguggauugcaccuucugucgcgaauuucuuaagaacccccagugcuauccugcgaaaaaguggcuguucauuaucauugucauccuccugggcuacgccgggcuuaugcugcucacaaaugugcugaaggcuauuggcguuuggggauccugggugaucgccccggucaaacugauguuugcuaucauuaagaaacucaugagaaccgugagcugucugguuggcaaacuuauggaccgggggagacaggugauccaugaggaaauuggagagaacggcgaggggaaucaagaugacguccgcaucgaaauggcccggcccagacgcgugcggcacuggauguauucuccugugauucugaccauccucgccauuggacuggcugagggcugcgaugaaaugguucaugcggacagcaaacuugucuccuguagacaggggagcggcaacaugaaggagugcaucacaacgggacgcgcccugcuccccgcugugaauccuggccaggaggccugucugcacuucaccgcccccgggucuccggauuccaagugccugaaaaucaaggugaaacggauuaacaucaaguguaaaaagagcuccucuuacuuugucagagacgcucgcagccggugcacauccgugagacgcugucggugggccggagauugccagucuggcugcccuccccacuucaccagcaauuccuuuucugacgacugggcggggaagauggauagagcuggacucggcuucagcggguguuccgacggcugcggaggcgccgccugugggugcuuuaacgcugccccuagcuguauuuucuggcggaaauggguugaaaauccccauggaaucauuuggaaggugucuccuugcgcugccuggguccccuccgcggugaucgagcugacaaugccgagcggcgaaguucgcaccuuucacccuaugucugggauccccacgcaaguguucaaaggagucuccgugacauaucuuggcagcgauauggagguuucuggccugaccgaccucugugaaauugaggagcugaaguccaaaaagcuggcccuugcucccugcaaccaggccgggaugggaguggucggcaaagugggggaaaagcaguguagcuccgaggaaagcgcuagaaccaucaagaaagauggaugcauuuggaacgccgaccucgugggcaucgagcugcgggucgaugacgcgguuuguuacucuaagauuacaagcguggaagccguggcuaauuauuccgccaucccuaccacaaucgggggacugagauucgagcgcucucaugauagccagggcaaaauuuccggcucuccgcucgacaucacggcuauucgggggagcuuuuccgucaacuacagaggacugcgccuuucucugagcgagaucaccgccacaugcaccggcgaagugacaaauguuuccgggugcuacagcuguaugaccggagccaaggugucuauuaaacuccacuccagcaagaacucuacggcucacgucagaugcaagggcgaugagaccgcguucuccgugcuggaagggguucauagcuauaucgugucccugucuuuugaccacgccgucguggaugagcaaugucagcuuaauugcggaggccaugaaagccagguuacacucaaaggcaaccugaucuuccuggacgugcccaaguuugucgacggguccuacaugcagaccuaucacagcacagugccuaccggagcuaauauucccucuccuacggauuggcucaacgcccuguucggcaaugggcuuucccgguggauccugggagugauuggcguccuccuugggggacuggcccuguuuuuccucaucauguuucugcugaaacucggcacaaagcaaguuuuccgcagcagaaccaaacuggcuuga

SEQ ID NO: 14899 - RNA, 3222 nt, Artificial Sequence
  derived and/or modified CDS sequence (opt5) from SFTSV/FTLSV(2012YSH92)__KF711941.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucucacucccgguggagcggacuccugucuccuugcgaugcggacuggcuuggcaugcuggucgugaaaaaggcuaaaggcuccgauaugauuguucccgggccuagcuacaagggaaagguguuuuucgagcgccccaccuuugacggcuaugucggguggggauguggcucugggaaauccagaacagaaagcggagagcucugcuccucugauagcggcacguccagcggccugcugccuucuaaucgggugcucuggaucggggacguugccugucagccgaugacccccauuccugaagagacauuccuggagcuuaaguccuuuagccagucugaauuucccgauaucugcaaaauugacggaaucguguuuaaccagugugagggcgaaagccugccucaacccuucgaugucgccuggauggacguggggcauucccacaagaucauuaugcgcgagcacaaaaccaagugggugcaggagucuagcuccaaggauuuugucugcuacaaagaaggaacaggcccguguagcgagucugaagagaagaccugcaaaacauccgggagcugcagaggagacaugcaguucuguaagguugcuggcugcgaacauggcgaggaggccucugaagcuaaaugucggugcucccucgugcacaagccuggggagguggucgugagcuauggaggcaugcgcguuagacccaaauguuacggguuuucccggaugauggccacccuggaagugaaucagccugagcaacgcaucggacagugcacgggcugucaucuugaaugcauuaacgggggcgucagacugaucacccucacaucugagcugaagucugcgaccgugugugccucccacuucugcucuagcgcuacauccggaaagaaaagcaccgagauucaguuccacucuggcucccugguugggaagacggccauccaugugaaaggagcucucgucgacggcacagaauuuaccuucgaggggagcuguauguuucccgauggaugcgacgccguggauugcacauucugucgggaauuucugaagaauccccaaugcuacccugcgaaaaaguggcuuuucaucauuaucgucauucugcucggcuaugccgggcugaugcuucugaccaacgugcucaaggcuaucggcauuuggggaucuuggguuaucgccccggugaaacugaucuuugcuauuaucaagaaacugaugcgcaccgucuccugucucaugggcaagcugauggacagagggagacaggugauucacgaggaaaucggagagaaucgggagggcaaccaggaugacguucgcauugaaauggcccggcccagacgcgugcggcauuggauguacagcccugucauccuuacaauucuggccaucgggcucgcugagucuugcgaugaaauggugcacgcggacagcaaacugguguccuguagacagggaagcggcaauaugaaggagugcguuacgaccgggcgcgcccuucugcccgcugucaacccuggccaagaggccugucuccauuucacagcccccggaucuccggauuccaagugccugcggaucaaagugaagagaauuaaucugaaauguaagaaaagcuccucuuauuuugugccugacgcucgcagccggugcaccuccgucagacgcugucggugggccggcgauugccagucugggugucccccucacuucacaagcaacuccuuuucugacgacugggcgggaaagauggauagagcuggccucggguucagcggaugcuccgacggcugcgggggcgccgccuguggaugcuuuaaugcugcccccagcuguaucuucuggcggaaguggguggaaaacccucacggcauuaucuggaaaguuucucccugcgcugccugggugccguccgcggucauugagcugaccaugccuagcggggaagugcgcacguuccaucccaugucuggaauccccacacagguuuuuaagggcguguccgucaccuaccuugggagcgauauggaggugucuggacugaccgaccucugugaaaucgaggagcugaaauccaagaaacuggcccuugcuccuugcaaccaggccggcaugggcguuguggggaaggucggagaaauucaauguagcuccgaggaaagcgcuagaacaaucaaaaaggauggcugcauuuggaaugccgaccucguggggaucgagcugcggguggaugacgcggucuguuauucuaagauuaccagcguugaagccguggcuaacuacuccgccaucccgacaacgaucggaggccugagauucgagcgcucucacgauagccaggggaaaauuuccggaucuccccucgacaucaccgcuauucggggcagcuuuuccgugaauuauagaggccugcgccuuucucugagcgagaucacagcuaccugcacaggggaagucaccaacguguccggaugcuacagcuguaugacgggcgccaagguuucuauuaaacuccauuccagcaagaauagcaccgcccacgugagaugcaaaggggaugagacagcguucuccguccuggaaggagugcacagcuacaccguuucccugucuuuugaccaugccguggucgaugagcagugucagcuuaacugcggcgggcacgaaagccaagugacacucaagggaaaucugaucuuccuggacguuccuaaguuuguggacggcuccuauaugcagaccuaccauagcacgguccccacaggcgcuaacaucccuucucccaccgauuggcucaaugcccuguucgggaacggacuuucccggugggugcugggcgugauggggguccuccugggaggccuggcccuuuucuucaugauuaugagccucuuuaaacuggggacaaagcagguuuuccgcucuagaaccaaacuggcuuga

SEQ ID NO: 14900 - RNA, 3222 nt, Artificial Sequence
  derived and/or modified CDS sequence (opt5) from SFTSV/FTLSV(2012YSH93)__KF711946.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucuaaucgggugcucuggaucggggacguugccugucagccgaugacccccauuccugaagagacauuccuggagcuuaaguccuuuagccagucugaauuucccgauaucugcaaaauugacggaaucguguuuaaccagugugagggcgaaagccugccucaacccuucgaugucgccuggauggacguggggcacucccauaagaucauuaugcgcgagcacaaaaccaagugggugcaggagucuagcuccaaggauuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcguuagacccaaauguuacggguuuucccggaugauggccacccuggaagugaaucagccugagcaacgcaucggacagugcacgggcugucaccuugaaugcauuaacgggggcgucagacugaucacccucacaucugagcugaaguccgcgaccgugugugccucccauuucugcucuagcgcuacauccggaaagaaaagcaccgagauucaguuccacucuggcucccugguugggaagacggccauccacgugaaaggagcucucgucgacggcacagaauuuaccuucgaggggagcuguauguuucccgauggaugcgacgccguggauugcacauucugucgggaauuucugaagaauccccaaugcuauccugcgaaaaaguggcuuuucaucauuaucgucauucugcucggcuacgccgggcugaugcuucugaccaacgugcucaaggcuaucggcauuuggggaucuuggguuaucgccccggugaaacugaucuuugcuauuaucaagaaacugacccgcacagucuccugucucaugggcaagcugauggacagagggagacaggugauucaugaggaaaucggagagaaucgggagggcaaccaggaugacguucgcauugaaauggcccggcccagacgcgugcggcacuggauguauagcccugucauccuuacgauucuggccaucgggcucgcugagucuugcgaugaaauggugcaugcggacagcaaacugguguccuguagacagggaagcggcaauaugaaggagugcguuaccacagggcgcgcccuucugcccgcugucaacccuggccaagaggccugucuccacuucaccgcccccggaucuccggauuccaagugccugaaaaucaaggugaaacggauuaaucugaaguguaaaaagagcuccucuuacuuugugccugacgcuagauaucgcugcacaagcguccggagaugucgcugggccggcgauugccaguccgggugucccccucauuucaccucuaacagcuuuuccgacgacugggcgggaaagauggaucgggcuggccucggguucucuggaugcagcgacggcugcgggggcgccgccuguggaugcuuuaaugcugcccccuccuguaucuucuggagaaaauggguggaaaacccucacggcauuaucuggaagguuagccccugcgcugccugggugccgucugcggucauugagcugacgaugccuuccggggaagugcggacauuccaccccaugagcggaauccccacccagguuuuuaaaggcgugucugucaccuaccuuggguccgauauggaggugagcggacugacagaccucugugaaaucgaggagcugaagucuaaaaagcuggcccuugcuccuugcaaccaggccggcaugggcguuguggggaaagucggagaaauucaauguuccagcgaggaauccgcucgcaccaucaagaaggauggcugcauuuggaaugccgaccucguggggaucgagcugagaguggaugacgcggucuguuauagcaaaauuacaucuguugaagccguggcuaacuacagcgccaucccgacgaccaucggaggccugcgguucgagagaucccaugauucucaggggaagauuagcggaagcccccucgacaucacagcuauucgcggcucuuuuagcgugaauuaccggggccugagacuuucccugucugagaucaccgccacaugcaccggggaagucacgaacgugagcggaugcuauuccuguaugaccggcgccaaaguuagcauuaagcuccacucuuccaaaaauagcacagcucaugugcgcugcaagggggaugagaccgcguucucuguccuggaaggagugcacuccuacacaguuagccuguccuuugaccacgccguggucgaugagcagugucagcuuaacugcggcgggcaugaaucucaagugacccucaagggaaaucugaucuuccuggacguuccuaaauuuguggacggcagcuauaugcagacguaccacuccacaguccccaccggcgcuaacaucccuagccccacagauuggcucaaugcccuguucgggaacggacuuucuagaugggugcugggcgugauggggguccuccugggaggccuggcccuuuucuucaugauuaugucccucuuuaagcuggggaccaaacagguuuuccggagccgcaccaagcuggcuuga

SEQ ID NO: 14901 - RNA, 3222 nt, Artificial Sequence
  derived and/or modified CDS sequence (opt5) from SFTSV/FTLSV(YGS1)__KF356537.1__GP
augaugaaggugaucugguucagcucccuggucugccucguuauucaguguucuggcgacagcgggcccaucauuugcgccggaccuauccacuccaacaaaucugcugccauuccgcaucugcuuggcuacagcgagaagaucugucaaaucgauagacugauucacguguccucuuggcuccggaaucauagccaguuucagggguaugugggacagcgcggcgggagaucccaagucagcuacuaucccgcggaaaacucuuacucccgguggagcggacugcuuucuccuugcgacgcugauuggcugggcaugcucgugguuaaaaaggccaaaggcuccgacaugaucgugcccgggccuagcuauaagggaaaggucuucuuugagcgccccaccuucgauggcuacgugggguggggauguggcucugggaaauccagaacagaaagcggagagcugugcuccucugacagcggcacguccagcggccugcucccuucugaucggguucuguggauuggggacguggccugucagccgaugacccccaucccugaagagacauuucuugagcugaaguccuucagccagucugaauuucccgauauuugcaaaaucgacggaauugucuucaaucagugugagggcgaaagccucccucaacccuuugauguggcuuggauggacguggggcacucccauaagaucaucaugcgcgagcacaaaaccaaguggguccaggagucuagcuccaaggauuucguuugcuauaaagaaggaacaggcccguguagcgagucugaagagaaggccugcaaaaccuccgggagcugcagaggagacaugcaguuuuguaagguggcuggcugcgaacacggcgaggaggccucugaagcgaaaugucggugcucccuggugcauaagccuggggaggucgugguuagcuacggaggcaugcgcgugagacccaaauguuacggguucucccggaugauggccacaauggaagucaacccucccgagcagcgcauuggacaaugcaccggcugucaccuugaaugcaucaaugggggcgugagacugauuacgcucaccucugagcucaagagcgcuacaguuugugccucccauuuuugcucuagcgcuaccuccggaaagaaaagcacagagauccacuuccacucuggcucccugguggggaagaccgccauucaugucaaaggagcgcugguggacggcacggaauuuacauuugaggggagcuguauguuccccgauggaugcaacgccgucgacugcaccuuuugucgggaguuccugaagaauccucagugcuauccggcuaaaaaguggcuuuuuaucaucauugugauccugcucggcuacgccgggcugaugcuucugacaaacguucucaaggcuauuggcguguggggaucuugggucaucgcccccgugaaacugauguucgccauuaugaagaaacugaugcgcaccguuuccugucucgugggcaagcugauggauagagggcggcaggucauccacgaagaaaucggagagaauggcgaggggaaccaugacgaugugagaauugaaauggcucgcccucggagagugcgccacuggauguauagccccguuauccuuaccauucuggcgaucggacucgccgagggcugcgacgaaaugguccaugcugauucuaaacuggugagcugucggcaaggguccggcaauaugaaggagugcgugacaacggggagagcccuucugccuagcgucaaccccggccaggaggccugucuccacuuuaccgcuccggggucuccugacuccaagugccugaaaauuaaggugaaacgcaucaaucugaaguguaaaaagagcuccucuuacuucguucccgaugcccggagcagaugcacauccgugcgccgguguagaugggcgggagacugccagucuggcugcccuccccacuuuaccagcaacuccuucucugaugacugggcugggaagauggaccgcgccggacucggcuuuagcggguguuccgauggcugcggaggcgccgcuugugggugcuucaaugccgcuccuagcuguauuuucuggcggaaaugggucgaaaacucucauggaaucaucuggaaggugucccccugcgccgcguggguuccgagcgccgugauugagcugacaaugccuucuggcgaagucagaaccuuccaccccauguccgggauccccacacagguguucaaaggaguuagcgugacguaucuuggcucugacauggaggucuccggccugaccgaucucugugaaauugaggagcuuaagagcaaaaagcuggcucuggccccuugcaaccaagcugggaugggaguggugggcaaagucggggaaauccaguguuccagcgaggaaucugcccggaccauuaagaaggacggaugcaucuggaaugcggaucucguuggcaucgagcugcgcguggacgaugccguguguuacagcaaaauuacauccgucgaagcuguggccaacuauucugcuaucccgaccacaauugggggacugagauuugagcggagccaugacucccagggcaagaucucuggcagcccccucgauauuacggccaucagaggguccuucucuguuaauuaccgcggacugcggcuuagccuguccgagaucaccgccacaugcaccggcgaagugacaaacgucagcgggugcuacucuuguaugaccggagcuaaaguguccauuaagcuccacagcucuaaaaauuccacggcgcacguuagaugcaagggcgacgagaccgccuuuagcgugcuggaagggguccauuccuauacagugucucugagcuucgaucacgcuguuguggacgagcagugucaacuuaacugcggaggccaugaaucccaggucacccucaagggcaaucugaucuuucuggaugugccuaaauucguggacgggagcuacaugcagacauaucacucuaccguccccacgggagccaacauuccuucccccacagacuggcucaaugcccuguuuggcaacgggcuuagccgcuggauccugggaguuauuggcgugcuccugggaggacuggcucuuuucuuucucaucauguuccuguuuaagcugggcaccaaacagguguucagaucucggacaaagcucgccuga

SEQ ID NO: 14902 - RNA, 3222 nt, Artificial Sequence
  derived and/or modified CDS sequence (opt5) from SFTSV/FTLSV(YNY1)__KF356538.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuccuggagcuuaaguccuuuagccagucugaguuccccgacaucugcaaaauugauggaaucguguuuaaucagugugaaggcgaaagccugccucaacccuucgacgucgccuggauggauguggggcacucccauaagaucauuaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcguuagacccaaauguuacggguuuucccggaugauggccacccuggaagugaaccagccugagcaacgcaucggacagugcacgggcugucaccuugaaugcauuaaugggggcgucagacugaucacccucacaucugagcucaagagcgcgaccgugugugccucccauuucugcucuagcgcuacauccggaaagaaaagcaccgagauucaguuccacucuggcucccugguugggaagacggccauccacgugaaaggagcucuggucgauggcacagaauuuaccuucgaggggagcuguauguuucccgacggaugcgaugccguggacugcacauucugucgggaauuucugaagaacccccaaugcuauccugcgaaaaaguggcuuuucaucauuaucgucauucuguuuggcuacgccgggcucaugcugcuuaccaaugugcugaaggcuaucggcauuuggggaucuuggguuaucgccccggugaaacucaucuucgcuauuaucaagaaacugaugcgcaccgucuccugucugaugggcaagcucauggauagagggagacaggugauucaugaggaaaucggagagaaccgggagggcaaucaggacgauguucgcauugaaauggcccggcccagacgcgugcggcacuggauguauagcccugucauccugacaauucuugccaucgggcuggcugagucuugcgacgaaauggugcaugcggauagcaaacucguguccuguagacagggaagcggcaacaugaaggagugcguuacgaccgggcgcgcccugcuucccgcugucaauccuggccaagaggccugucugcacuuuacagcccccggaucuccggacuccaagugccucaaaaucaaggugaaacggauuaaccugaaguguaaaaagagcuccucuuacuucgugccugaugcuagaagccgcugcaccuccguccggagaugucgcugggccggcgacugccagucugggugucccccucauuuuacaagcaauuccuucucugacgauugggcgggaaagauggaccgggcuggccugggguuuagcggaugcuccgauggcugcgggggcgccgccuguggaugcuucaacgcugcccccagcuguaucuucuggagaaaauggguggaaaauccucacggcauuaucuggaagguuucucccugcgcugccugggugccguccgcggucauugagcucaccaugccuagcggggaagugcggacguuucaccccaugucuggaauccccacacagguuuucaaaggcguguccgucaccuaucuggggagcgacauggaggugucuggacuuaccgaucugugugaaaucgaggagcucaaguccaaaaagcuggcccuggcuccuugcaaccaggccggcaugggcguuguggggaaagucggagaaauucaauguagcuccgaggaaagcgcucgcacaaucaagaaggacggcugcauuuggaacgccgaucuuguggggaucgagcucagaguggacgaugcggucuguuacucuaaaauuaccagcguugaagccguggcuaauuauuccgccaucccgacaacgaucggaggccugcgguuugagagaucucaugacagccaggggaagauuuccggaucuccccuggauaucaccgcuauucgcggcagcuucuccgugaacuaccggggccucagacugucucuuagcgagaucacagcuaccugcacaggggaagucaccaauguguccggaugcuacagcuguaugacgggcgccaaaguuucuauuaagcugcacuccagcaaaaacucuaccgcccaugugcgcugcaagggggacgagacagcguuuuccguccucgaaggagugcacagcuauaccguuucccugucuuucgaucacgccguggucgacgagcagugucagcugaauugcggcgggcaugaaagccaagugacacuuaagggaaaccucaucuuucuggacguuccuaaauucguggauggcuccuacaugcagaccuaucacagcacgguccccacaggcgcuaauaucccuucucccaccgacuggcugaacgcccucuuugggaauggacuguccagauggauucuuggcgugaugggggugcugcucggaggccuggcccuguucuuuaugaucaugagccuuuucaagcucgggacaaaacaggucuuucggucucgcaccaagcuggcuuga

SEQ ID NO: 14903 - RNA, 3222 nt, Artificial Sequence
  derived and/or modified CDS sequence (opt5) from SFTSV/FTLSV(YPQ133)__KF356530.1__GP
augaugaaggugaucugguucagcucccugauuugcuuugucauccaguguucuggcgacagcucccccauuaucugcgccgggccuauucacucuaacaaaagcgcugauaucccgcaucuccugggauacuccgagaagaucugucaaauugacagacuuauccacguuucuagcuggcugcggaaucauucccaguuccagggcuauguggggcagcgcggaggcagaagccaagugucuuacuaucccgccgaaaacuccuacagccgguggucugggcuccuguccccuugcgaugcggacuggcuuggaaugcuggucgugaaaaaggcuaaaggcagcgauaugauuguucccggcccuucuuauaaggggaagguguuuuucgagcgccccaccuuugacggauacgucggcuggggguguggauccggcaaaagcagaacagaauccggggagcucugcucuagcgauuccggaacgagcucuggccugcugccuuccgaccgggugcucuggaucggcgauguugccugucagccgaugacccccauuccugaagagacauuccuggagcuuaagagcuuuucucagagcgaguuccccgacaucugcaaaauugaugggaucguguuuaaucagugugaaggagaaucccugccucaacccuucgacgucgccuggauggaugugggccacucucagaagaucauuaugcgcgagcauaaaaccaagugggugcaggagagcuccagcaaggacuuugucugcuauaaagaagggacaggaccguguucugaguccgaagagaagaccugcaaaacaagcggcucuugcagaggggacaugcaguucuguaagguugcuggaugcgaacacggcgaggaggccuccgaagcuaaaugucggugcagccucgugcacaagccuggcgagguggucguguccuacgggggaaugcgcguuagacccaaauguuacggcuuuucucggaugauggccacccuggaagugaaccaaccugagcagcgcaucgggcagugcacgggaugucaucuugaaugcauuaauggcggggucagacugaucacccucacaagcgagcugaaguccgcgaccgugugugccucucacuucugcagcuccgcuacaagcggcaagaaaucuaccgagauucaauuccauuccggaagccugguuggcaagacggccauccacgugaaaggggcucucgucgauggaacagaauuuaccuucgagggcucuuguauguuucccgacgggugcgaugccguggacugcacauucugucgggaauuucugaagaacccccagugcuauccugcgaaaaaguggcuuuucaucauuaucgucauucugcucggauacgccggccugaugcuucugaccaaugugcucaaggcuaucgggauuuggggcuccuggguuaucgccccggugaaacugaucuuugcuauuaucaagaaacugaugcgcaccgucagcugucucaugggaaagcugauggauagaggcagacaggugauucacgaggaaaucggggagaaccgggagggaaaucaggacgauguucgcauugaaauggcccggcccagacgcgugcggcauuggauguauucuccugucauccuuacaauucuggccaucggccucgcugagagcugcgacgaaauggugcacgcggauuccaaacuggugagcuguagacaagggucuggaaacaugaaggagugcguuacgaccggccgcgcccuucugcccgcugucaauccugggcaggaggccugucuccauuucacagcccccggcuccccggacagcaagugccugaaaaucaaggugaaacggauuaaccugaaguguaaaaaguccucuagcuacuuugugccugaugcuagaucccgcugcaccucuguccggagaugucgcugggccggagacugccagagcggcugucccccucacuucacauccaauucuuuuagcgacgauugggcggggaagauggaccgggcuggacucggcuucuccgggugcagcgauggaugcggcggggccgccuguggcugcuuuaacgcugcccccucuuguaucuucuggagaaaauggguggaaaauccucauggaguuauuuggaaggugucccccugcgcugccugggucccgagcgcggugaucgagcugaccaugccuucuggcgaaguucggacguuccaccccauguccgggauucccacacagguguuuaaaggagucagcgugaccuaucuuggcucugacauggagguuuccgggcugaccgaucucugugaaaucgaggagcuuaagagcaaaaagcuggcccuugcuccuugcaaccaagccggaaugggcguggucggcaaagugggggaaauccaguguuccagcgaggaaucugcucgcacaauuaagaaggacggaugcaucuggaacgccgaucucgugggcauugagcugagagucgacgaugcgguuuguuacagcaaaaucaccuccguggaagccguggcuaauuauucugccauuccgacaacgaucgggggacugcgguucgagagaagccacgacucccagggcaagaucucugggagcccccucgauauuaccgcuauccgcggauccuuuucugucaacuaccggggccugagacuuagccuguccgagauuacagcuaccugcacaggcgaagugaccaauguuagcgggugcuacucuuguaugacgggagccaaaguguccaucaagcuccauagcucuaaaaacuccaccgcccacguccgcugcaagggcgacgagacagcguucagcgugcuggaagggguucauuccuauaccgugucucugagcuuugaucacgccgucguggacgagcagugucaacuuaauugcggaggccacgaaucccagguuacacucaaggggaaccugauuuuccuggacgugccuaaauuugucgauggaagcuacaugcagaccuaucauucuacggugcccacaggcgcuaauaucccuucccccaccgacuggcucaacgcccuguucggcaaugggcuuagcagauggauccugggagugaugggcguccuccucgggggacuggcccuguuuuucaugauuaugucucuguuuaagcugggcacaaaacagguuuuccggagccgcaccaagcuggcuuga

SEQ ID NO: 14904 - RNA, 3222 nt, Artificial Sequence
  derived and/or modified CDS sequence (opt5) from SFTSV/FTLSV(YPQ2)__KF356531.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuccuggagcuuaaguccuuuagccagucugaguuccccgacaucugcaaaauugauggaaucguguuuaaucagugugaaggcgaaagccugccucaacccuucgacgucgccuggauggauguggggcacucccauaagaucauuaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcguuagacccaaauguuacggguuuucccggaugauggccacccuggaagugaaccagccugagcaacgcaucggacagugcacgggcugucaccuugaaugcauuaaugggggcgucagacugaucacccucacaucugagcugaaguccgcgaccgugugugccucccauuucugcucuagcgcuacauccggaaagaaaagcaccgagauucaguuccacucuggcucccugguugggaagaucgccauccacgugaaaggagcucucgucgauggcacggaauuuacauucgaggggagcuguauguuucccgacggaugcgaugccguggacugcaccuucugucgggaauuucugaagaacccccaaugcuauccugcgaaaaaguggcuuuucauuaucauugucauccugcucggcuacgccgggcugaugcuucugacaaaugugcucaaggcuauuggcaucuggggaucuuggguuaucgccccggugaaacugauuuuugcuaucauuaagaaacugaugcgcaccgucuccugucucaugggcaagcugauggauagagggagacaggugauccaugaggaaauuggagagaaccgggagggcaaucaggacgauguucgcaucgaaauggcccggcccagacgcgugcggcacuggauguauagcccugucauucuuaccauccuggccaucgggcucgcugagucuugcgacgaaauggugcaugcggauagcaaacugguguccuguagacagggaagcggcaacaugaaggagugcguuacaacggggcgcgcccuucugcccgcugucaauccuggccaagaggccugucuccacuucaccgcccccggaucuccggacuccaagugccugaaaauuaaggugaaacggaucaaccugaaguguaaaaagagcuccucuuacuuugugccuauggcuagauuccgcugcacaagcguccggagaugucgcugggccggcgauugccaguccgggugucccccucauuuuaccucuaauagcuucuccgacgacugggcgggaaagauggaucgggcuggccucggguuuucuggaugcagcgacggcugcgggggcgccgccuguggaugcuucaacgcugcccccuccuguauuuucuggagaaaauggguggaaaauccucacggcaucauuuggaagguuagccccugcgcugccugggugccgucugcggucaucgagcugacaaugccuuccggggaagugcggaccuuucaccccaugagcggaauccccacgcagguuuucaaaggcgugucugucacauaucuuggguccgauauggaggugagcggacugaccgaccucugugaaauugaggagcugaagucuaaaaagcuggcccuugcuccuugcaaccaggccggcaugggcguuguggggaaagucggagaaauccaauguuccagcgaggaauccgcucgcaccauuaagaaggauggcugcaucuggaacgccgaccucguggggauugagcugagaguggaugacgcggucuguuacagcaaaaucacaucuguugaagccguggcuaauuauagcgccaucccgaccacaauuggaggccugcgguuugagagaucccaugauucucaggugaagaucagcgggagcccccucgacauuacggcuaugcgcggaucuuucagcgucaacuaccggggccugagacuuucccugucugagaucaccgccacaugcaccggcgaagugacaaauguuagcgggugcuacuccuguaugaccggagccaaagugagcauuaagcuccacucuuccaaaaacagcacggcucauguccgcugcaagggcgaugagaccgcguuuucugugcuggaagggguucacuccuauacagugagccuguccuucgaccacgccgucguggaugagcagugucagcuuaauugcggaggccaugaaucucaaguuacccucaaggggaaccugaucuuucuggacgugccuaaauucgucgacggaagcuacaugcagacauaucacuccaccgugcccacgggcgcuaauaucccuagccccacagauuggcucaacgcccuguuuggcaaugggcuuucuagauggauucugggagugaugggcguccuccuugggggacuggcccuguucuuuaugaucaugucccucuucaagcugggcaccaaacagguuuuucggagccgcacaaagcuggcuuga

SEQ ID NO: 14905 - RNA, 3222 nt, Artificial Sequence
  derived and/or modified CDS sequence (opt5) from SFTSV/FTLSV(YPQ5)__KF356532.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccgggugagcuacuaucccgccgaaaacucuuacucccgcuggagcggacuccugucuccuugcgaugcggacuggcuuggcaugcuggucgugaaaaaggcuaaaggcuccgauaugauuguucccgggccuagcuauaagggaaagguguuuuucgagagacccaccuuugacggcuacgucggguggggauguggcucugggaaaucccggacagaaagcggagagcucugcuccucugauagcggcacguccagcggccugcugccuucugaccgcgugcucuggaucggggauguugccugucaaccgaugacccccauuccugaagagacauuccuggagcuuaaguccuuuagccagucugaauuucccgacaucugcaaaauugauggaaucguguuuaaucagugugagggcgaaagccugccucagcccuucgacgucgccuggauggauguggggcacucccauaagaucauuaugagagagcacaaaaccaagugggugcaagagucuagcuccaaggacuuugucugcuauaaagaaggaacaggcccguguagcgagucugaagagaagaccugcaaaacauccgggagcugccggggagacaugcaguucuguaagguugcuggcugcgaacacggcgaggaggccucugaagcuaaaugucgcugcucccucgugcauaagccuggggagguggucgugagcuacggaggcaugagaguucggcccaaauguuacggguuuucccgcaugauggccacccuggaagugaaccagccugagcagagaaucggacaaugcacgggcugucaccuugaaugcauuaaugggggcguccggcugaucacccucacaucugagcugaaguccgcgaccgugugugccucccauuucugcucuagcgcuacauccggaaagaaaagcaccgagauucaguuccacucuggcucccugguugggaagacggccauccacgugaaaggagcucucgucgauggcacagaauuuaccuucgaggggagcuguauguuucccgacggaugcgaugccguggacugcacauucugucgcgaauuucugaagaacccccagugcuauccugcgaaaaaguggcuuuucaucauuaucgucauucugcucggcuacgccgggcugaugcuucugaccaaugugcucaaggcuaucggcauuuggggaucuuggguuaucgccccggugaaacugaucuuugcuauuaucaagaaacugaugagaaccgucuccugucucaugggcaagcugauggaucgggggagacaagugauucaugaggaaaucggagagaaccgcgagggcaaucaggacgauguucggauugaaauggccagaccccgccgggugagacacuggauguauagcccugucauccuuacaauucuggccaucgggcucgcugagucuugcgacgaaauggugcaugcggauagcaaacugguguccugucgccagggaagcggcaacaugaaggagugcguuacgaccgggcgggcccuucugcccgcugucaauccuggccaggaggccugucuccacuucacagcccccggaucuccggacuccaagugccugaaaaucaaggugaaaagaauuaaccugaaguguaaaaagagcuccucuuacuuugugccugucgcucgcuaucggugcaccagcgugagacgcugucggugggccggcgauugccaauccgggugucccccucauuucacaucuaauagcuuuuccaacgacugggcgggaaagauggacagagcuggccucggguucucuggaugcagcgauggcugcgggggcgccgccuguggaugcuuuaaugcugcccccuccuguaucuucuggcggaaauggguugaaaacccucacggcauuaucuggaaggugagccccugcgcugccugggucccgucugcggugauugagcugaccaugccuuccggggaaguucgcacguuccaccccaugagcggaauccccacacagguguuuaaaggcgucucugugaccuaccuuggguccuauauggagguuagcggacugaccgaccucugugaaaucgaggagcugagaucuaagaaacuggcccuugcuccuugcaaccaggccggcaugggcguggucgggaaggugggagaaauucaguguuccagcgaggaauccgcucggacaaucaaaaaggauggcugcauuuggaaugccgaccucguggggaucgagcugagagucgaugacgcgguuuguuacagcaagauuaccucuguggaagccguggcuaacuacagcgccaucccgacaacgaucggaggccugcgcuucgagcggucccaugauucucaagggaaaauuagcggaagcccccucgacaucaccgcuauuagaggcucuuuuagcgucaauuaucgcggccugagacuuucccugucugagaucacagcuaccugcacaggggaagugaccaacguuagcggaugcuacuccuguaugacgggcgccaaggugagcauuaaacuccacucuuccaagaauagcaccgcccauguccggugcaaaggggaugagacagcguucucugugcuggaaggaguucacuccuauaccgugagccuguccuuugaccacgccgucguggaugagcagugucagcuuaacugcggcgggcaugaaucucagguuacacucaagggaaaucugaucuuccuggacgugccuaaguuugucgauggcagcuacaugcaaaccuaucacuccacggugcccacaggcgcuaacaucccuagccccaccgacuggcucaaugcccuguucgggaacggacuuucucgcuggauucugggcgugauggggguccuccugggaggccuggcccuuuucuucaugaucaugucccucuuuaaacuggggacaaagcagguuuucagaagccggaccaaacuggcuuga

SEQ ID NO: 14906 - RNA, 3222 nt, Artificial Sequence
  derived and/or modified CDS sequence (opt5) from SFTSV/FTLSV(YSC19)__KF356536.1__GP
augaugaaggugaucugguucagcucccuggucugccucguuauucaguguucuggcgacagcgggcccaucauuugcgccggaccuauccacuccaacaaaucugcugccauuccgcaucugcuuggcuacagcgagaagaucugucaaaucgauagacugauucacguguccucuuggcuccggaaucauagccaguuucagggguaugugggacagcgcggcgggagaucccaagucagcuacuaucccgcggaaaacucuuacucccgguggagcggacugcuuucuccuugcgacgcugauuggcugggcaugcucgugguuaaaaaggccaaaggcuccgacaugaucgugcccgggccuagcuauaagggaaaggucuucuuugagcgccccaccuucgauggcuacgugggguggggauguggcucugggaaauccagaacagaaagcggagagcugugcuccucugacagcggcacguccagcggccugcucccuucugaucggguucuguggauuggggacguggccugucagccgaugacccccaucccugaagagacauuucuugagcugaaguccuucagccagucugaauuucccgauauuugcaaaaucgacggaauugucuucaaucagugugagggcgaaagccucccucaacccuuugauguggcuuggauggacguggggcacucccauaagaucaucaugcgcgagcacaaaaccaaguggguccaggagucuagcuccaaggauuucguuugcuauaaagaaggaacaggcccguguagcgagucugaagagaaggccugcaaaaccuccgggagcugcagaggagacaugcaguuuuguaagguggcuggcugcgaacacggcgaggaggccucugaagcgaaaugucggugcucccuggugcauaagccuggggaggucgugguuagcuacggaggcaugcgcgugagacccaaauguuacggguucucccggaugauggccacaauggaagucaacccucccgagcagcgcauuggacaaugcaccggcugucaccuugaaugcaucaaugggggcgugagacugauuacgcucaccucugagcucaagagcgcuacaguuugugccucccauuuuugcucuagcgcuaccuccggaaagaaaagcacagagauccacuuccacucuggcucccugguggggaagaccgccauucaugucaaaggagcgcugguggacggcacggaguucacauuugaagggagcuguauguuccccgauggaugcaacgccgucgacugcaccuuuugucgggaguuccugaagaauccucagugcuauccggcuaaaaaguggcuuuuuaucaucauugugauccugcucggcuacgccgggcugaugcuucugacaaacguucucaaggcuauuggcguguggggaucuugggucaucgcccccgugaaacugauguucgccauuaugaagaaacugaugcgcaccguuuccugucucgugggcaagcugauggauagagggcggcaggucauccacgaagaaaucggagagaauggcgaggggaaccaugacgaugugagaauugaaauggcucgcccucggagagugcgccacuggauguauagccccguuauccuuaccauucuggcgaucggacucgccgagggcugcgacgaaaugguccaugcugauucuaaacuggugagcugucggcaaggguccggcaauaugaaggagugcgugacaacggggagagcccuucugccuagcgucaaccccggccaggaggccugucuccacuuuaccgcuccggggucuccugacuccaagugccugaaaauuaaggugaaacgcaucaaucugaaguguaaaaagagcuccucuuacuucguucccauugcccggaacagaugcacaagcgugcgccgguguagaugggcgggagauugccaguccggcugcccuccccacuuuaccucuaauagcuucuccgacgauugggcugggaagauggaccgcgccggacucggcuuuucuggguguagcgacggcugcggaggcgccgcuugugggugcuucaacgccgcuccuuccuguaucuuuuggcggaaaugggucgaaaacagccauggaaucauuuggaaggugucucccugcgccgcguggguuccguccgccgugaucgagcugacaaugccuagcggcgaagucagaaccuuccaccccaugucugggauucccacacagguguucaaaggaguuuccgugacguaucuuggcagcgauauggaggucucuggccugaccgaccucugugaaaucgaggagcugaaguccaaaaagcuggcucuugccccuugcaaucaagcugggaugggaguggugggcaaagucggggaaauucaguguagcuccgaggaaagcgcccggaccaucaagaaggauggaugcaucuggaacgcggaccucguuggcauugagcugcgcguggaugacgccguguguuacucuaaaaucacaagcgucgaagcuguggccaauuauuccgcuauuccgaccacaaucgggggacugagauuugagcggucucaugauagccagggcaagauuuccggcucuccccucgacaucacggccaucagagggagcuucuccguuaacuaccgcggacugcggcuuucucugagcgagauuaccgccacaugcaccggcgaagugacaaaugucuccgggugcuacagcuguaugaccggagcuaaagugucuaucaagcuccacuccagcaaaaacucuacggcgcacguuagaugcaagggcgaugagaccgccuuuuccgugcuggaagggguccauagcuauacagugucccugucuuucgaccacgcuguuguggaugagcagugucaacuuaauugcggaggccaugaaagccaggucacccucaagggcaaccugauuuuucuggacgugccuaaauucguggauggguccuacaugcagacauaucacagcaccguccccacgggagccaauaucccuucucccacagacuggcucaacgcccuguuuggcaaugggcuuucccgcuggauucugggaguuaucggcgugcuccugggaggacuggcucuuuucuuucucaucauguuccuguuuaagcugggcaccaaacagguguucagaagccggacaaagcucgccuga

SEQ ID NO: 14907 - RNA, 3222 nt, Artificial Sequence
  derived and/or modified CDS sequence (opt5) from SFTSV/FTLSV(YSC3)__KF356535.1__GP
augaugaaggugaucugguucagcucccuggucugccucguuauucaguguucuggcgacagcgggcccaucauuugcgccggaccuauccacuccaacaaaucugcugccauuccgcaucugcuuggcuacagcgagaagaucugucaaaucgauagacugauucacguguccucuuggcuccggaaucauagccaguuucagggguaugugggacagcgcggcgggagaucccaagucagcuacuaucccgcggaaaacucuuacucccgguggagcggacugcuuucuccuugcgacgcugauuggcugggcaugcucgugguuaaaaaggccaaaggcuccgacaugaucgugcccgggccuagcuauaagggaaaggucuucuuugagcgccccaccuucgauggcuacgugggguggggauguggcucugggaaauccagaacagaaagcggagagcugugcuccucugacagcggcacguccagcggccugcucccuucugaucggguucuguggauuggggacguggccugucagccgaugacccccaucccugaagagacauuucuugagcugaaguccuucagccagucugaauuucccgauauuugcaaaaucgacggaauugucuucaaucagugugagggcgaaagccucccucaacccuuugauguggcuuggauggacguggggcacucccauaagaucaucaugcgcgagcacaaaaccaaguggguccaggagucuagcuccaaggauuucguuugcuauaaagaaggaacaggcccguguagcgagucugaagagaagaccugcaaaacauccgggagcugcagaggagacaugcaguuuuguaagguggccggcugcgaacacggcgaggaggcuucugaagccaaaugucggugcucccuggugcauaagccuggggaggucgugguuagcuacggaggcaugcgcgugagacccaaauguuacggguucucccggaugauggcgacccuugaagucaaccagccugagcaacgcauuggacagugcacgggcugucaccuggaaugcaucaaugggggcgugagacucauuacccugacaucugagcuuaagagcgccaccguuugugcuucccauuuuugcucuagcgccacauccggaaagaaaagcaccgagauccaguuccacucuggcucccucguggggaagacggcuauucacgucaaaggagcccugguggacggcacagaguucaccuuugaagggagcuguauguuccccgauggaugcgacgcggucgauugcacauuuugucgggaguuccuuaagaacccccaaugcuauccugccaaaaaguggcuguuuaucaucauugugauccuccugggcuacgcugggcuuaugcugcucaccaauguucugaaggccauuggcaucuggggaucuugggugauugcuccggucaaacugaucuucgccaucauuaagaaacucaugcgcaccguguccugucugaugggcaagcugauggacagagggcggcagguuauccaugaagaaauuggagagaacagagagggcaaucaggaugacgugcgcaucgaaauggcccggcccagacgcauucggcacuggauguauagcccugucauccugacaauucucgcuaucgggcuggcggagucuugcgaugaaauggugcaugccgacagcaaacuuguguccuguagacagggaagcggcaacaugaaggagugcguuacgaccgggcgcgcucugcuccccgccgucaauccuggccaagaggccugucugcacuuuacagcucccggaucuccggauuccaagugccugaaaaucaaggugaaacggauuaaccucaaguguaaaaagagcuccucuuacuucgugccugacgccagaagccgcugcaccuccguccggagaugucgcugggcgggcgauugccagucugggugucccccucauuuuacaagcaauuccuucucugacgacugggcuggaaagauggaucgggccggccugggguuuagcggaugcuccgacggcugcgggggcgccgcuuguggaugcuucaacgccgcucccagcuguaucuuuuggagaaaauggguggaaaauccucacggcauuaucuggaagguuucucccugcgccgcgugggugccguccgccgucauugagcuuaccaugccuagcggggaagugcggacguuccaccccaugucuggaauccccacacagguuuucaaaggcguguccgucaccuaucuggggagcgauauggaggugucuggacucaccgaccugugugaaaucgaggagcugaaguccaaaaagcucgcucuugccccuugcaaccaggcuggcaugggcguuguggggaaagucggagaaauucaauguagcuccgaggaaagcgcccgcacaaucaagaaggauggcugcauuuggaacgcggaccugguggggaucgagcugagaguggaugacgccgucuguuacucuaaaauuaccagcguugaagcuguggccaauuauuccgcuaucccgacaacgaucggaggccuccgguuugagagaucuuacgauagccaggggaagauuuccggaucuccccuggacaucaccgccauucgcggcagcuucuccgugaacuaccggggccuuagacugucucucagcgagaucacagcuaccugcacaggggaagucaccaauguguccggaugcuauagcuguaugacgggcgccaaaguuucuauuaagcugcauuccagcaaaaacucuaccgcgcacgugcgcugcaagggggaugagacagccuuuuccguccuggaaggagugcauagcuacaccguuucccuuucuuucgaccacgcuguggucgaugagcagugucagcucaauugcggcgggcacgaaagccaagugacacugaagggaaaccugaucuuucucgacguuccuaaauucguggacggcuccuauaugcagaccuaccauagcacgguccccacaggcgccaauaucccuucucccaccgauuggcugaacgcccuuuuugggaauggacuguccagauggauucucggcgugaucggggugcugcugggaggccuugcucucuucuuuaugauuaugagccuguucaagcuggggacaaaacaggucuuucggucucgcaccaagcucgccuga

SEQ ID NO: 14908 - RNA, 3222 nt, Artificial Sequence
  derived and/or modified CDS sequence (opt5) from SFTSV/FTLSV(YSH39)__KF356529.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauucauggagcugaaguccuuuagccagucugaguuccccgacaucugcaaaauugauggaaucguguuuaaucagugugaaggcgaaagccuuccucaacccuucgacgucgccuggauggauguggggcacucccauaagaucauuaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccuggugcauaagccuggggagguggucgugagcuacggaggcaugcgcaucagacccaaauguuacggguuuucccggaugauggccacccucgaaguuaaccagccugagcaacgcauuggacagugcacgggcugucaccuggaaugcaucaaugggggcgugagacuuauuacccugacaucugagcucaagagcgcgaccgucugugccucccauuucugcucuagcgcuacauccggaaagaaaagcaccgagauccaguuccacucuggcucccugguggggaagacggccauccacguuaaaggagcucugguggauggcacagaauuuaccuucgaggggagcuguauguuucccgacggaugcgaugccgucgacugcacauucugucgggaauuucucaagaacccccaaugcuauccugcgaaaaaguggcuguucauuaucauugugauccuucugggccaugccgggcucaugcugcuuaccaauguccugaaggcuauuggcaucuggggaucuugggugaucgccccgguuaaacucauuuuugcuaucauuaagaaacugaugcgcaccguguccugucugaugggcaagcucauggauagagggcggcaggucauccacgaggaaauuggagagaacagagagggcaaucaggacgaugugcgcaucgaaauggcccggcccagacgcguucggcauuggauguacagcccugugauucugacaauccuugccaucgggcuggcugagucuugcgacgaaaugguccacgcggauagcaaacucguguccuguagacagggaagcggcaacaugaaggagugcgugacgaccgggcgcgcccugcuucccgcuguuaauccuggccaagaggccugucugcauuucacagcccccggaucuccggacuccaagugccucaaaauuaaggucaaacggaucaaccugaaguguaaaaagagcuccucuuauuuugugccugaugcuagaagccgcugcaccuccgugcggagaugucgcugggccggcgacugccagucugggugucccccucacuucacaagcaauuccuuuucugacgauugggcgggaaagauggaccgggcuggccugggguucagcggaugcuccgauggcugcgggggcgccgccuguggaugcuuuaacgcugcccccagcuguauuuucuggagaaaaugggucgaaaauccucacggcaucauuuggaaggugucucccugcgcugccuggguuccguccgcggugaucgagcucaccaugccuagcggggaaguccggacguuccaucccaugucuggaauccccacacagguguuuaaaggcguuuccgugaccuaccuggggagcgacauggaggucucuggacuuaccgaucugugugaaauugaggagcucaaguccaaaaagcuggcccuggcuccuugcaaccaggccggcaugggcgugguugggaaagugggagaaauccaauguagcuccgaggaaagcgcucgcacaauuaagaaggacggcugcaucuggaacgccgaucuugucgggauugagcucagaguggacgaugcgguguguuauucuaaaaucaccagcgucgaagccguugcuaauuacuccgccaucccgacaacgauuggaggccugcgguucgagagaucucacgacagccaggggaagaucuccggaucuccccuggauauuaccgcuauccgcggcagcuuuuccgugaacuaucggggccucagacugucucuuagcgagauuacagcuaccugcacaggggaagugaccaaugucuccggaugcuacagcuguaugacgggcgccaaagugucuaucaagcugcauuccagcaaaaacucuaccgcccacguucgcugcaagggggacgagacagcguucuccgugcucgaaggaguccacagcuacaccgugucccugucuuuugaucaugccguuguggacgagcagugucagcugaauugcggcgggcacgaaagccaagucacacuuaagggaaaccucaucuuccuggacgugccuaaauuuguugauggcuccuauaugcagaccuaccauagcacggugcccacaggcgcuaauauuccuucucccaccgacuggcugaacgcccucuucgggaauggacuguccagauggauccuuggcgucauuggggugcugcucggaggccuggcccuguuuuucaugaucaugagccuuuuuaagcucgggacaaaacagguguuccggucucgcaccaagcuggcuuga

SEQ ID NO: 14909 - RNA, 3222 nt, Artificial Sequence
  derived and/or modified CDS sequence (opt5) from SFTSV/FTLSV(YSHX002)__KF356540.1__GP
augaugaaggugaucugguucagcucccugauuugccucgucauccaguguucuggcgacagcgggcccauuaucugcgccggaccuauucacuccaacaaaucugcuggcaucccgcaucugcuuggguacagcgagaagaucugucaaauugauagacugauccacguuuccucuuggcuccggaaucauagccaguuucagggauaugugggccagcgcgggggaagaucccaagugagcuacuaucccgccgaaaacucuuacucccgguggaauggccugcuuagcccuugcgacgcggauuggcugggcaugcucgucgugaaaaaggcuaaagagucugacaugauuguucccgggccuuccuauaagggaaagguguucuuugaacgccccaccuucgauggcuacgucggguggggauguggcagcgggaaaucuagaacagaguccggagaacugugcagcuccgacucuggcacgagcuccggccugcucccuagcgaucgggugcuguggaucggggacguugccugucagccgaugacccccauuccugaggagacauuucuugaacugaagucuuucucccagagcgaguuucccgauaucugcaaaauugacggaaucguguucaaccagugugaaggcgagucucucccucaacccuuugaugucgccuggauggacguggggcacagccauaagaucauuaugcgcgagcacaaaaccaagugggugcaggaauccucuagcaaggauuucgucugcuauaaagagggaacaggcccguguuccgaaagcgaggaaaaggcuugcaaaaccucuggguccugcagaggagacaugcaguuuuguaagguugccggcugcgagcacggcgaggaagcuagcgaggccaaaugucggugcucucuggugcauaagccuggggaaguggucguguccuacggaggcaugcgcguuagacccaaauguuacggguucagccggaugauggcgacacuugaggugaauccucccgaacagcgcaucggacaaugcaccggcugucaccuggagugcauuaacgggggcgucagacucaucacgcugaccuccgagcugcggucugccacagugugugcuagccauuuuugcuccucugccaccagcggaaagaaguccacagaaauucacuuccacagcggcucucucguugggaaaaccgcuauccaugugaagggagcccuggucgacggcacggaguucacauuugaaggguccuguauguuccccgauggaugcgacgcgguggauugcaccuuuugucgcgaguuccuuaaaaauccucagugcuauccggccaagaaauggcuguuuaucauuaucgucauucuccugggcuacgcugggcuuaugcuggugacaaacguucucaaggccaucggcguguggggaagcugggucauugcucccgugaagcugauguucgccaucaucaaaaagcugaugagaaccguuucuugucucgugggcaaacugauggaccgggggagacaggucauucacgaagagaucggagagaauggcgaagggaaccaagaugacgugcgcauugagauggcccggccuagacgcgugcggcauuggauguauucccccguuauccuuaccauucuggcuaucggacucgcggaaggcugcgaugagaugguccacgccgacagcaagcuggugucuuguagacaggggagcggcaauaugaaagagugcauuacaacgggacgcgcucugcugccugccgugaaccccggccaggaagccugucuccauuuuaccgcuccgggguccccugauagcaagugccugaagaucaaagucaagcggaucaaucugaaauguaagaaaucuuccagcuacuucgugcccgacgccagaucccgcugcacaucuguucggagaugucgcugggcgggagauugccagagcggcugcccuccccacuuuaccuccaacucuuucagcgacgacugggcugggaagauggaucgggccggacucggcuuuuccggguguucugacggcugcggaggcgccgcuugugggugcuucaaugccgcuccuagcuguaucuuuuggagaaaguggguggagaacccccacggaauuauuuggaaagucuccccgugcgccgcgugggugccuagcgccguuaucgaacugacaaugcccucuggcgaggugcggaccuuccaucccauguccgggauuccuacgcaagucuucaagggagugagcguuacauaucuuggcucugauauggaaguguccggccugaccgaccucugugagaucgaggaacugaaaagcaagaaacuggcucuugccccgugcaaccaggcugggaugggagucgugggcaaggugggggagaaacaguguucuuccgaagagagcgcccgcaccaucaagaaggauggaugcauuuggaaugcggaccucgucggcaucgaacugagaguugaugacgccguguguuacuccaaaauuacaagcguggaggcugucgccaacuauucugcuauccccaccacaauugggggacugcgguuugagagaagccacgauucccagggcaagaucucuggcagcccucucgacaucacggccauucgcggguccuucucugugaauuaccggggacugagacuuagccuguccgaaaucaccgccacaugcaccggcgagguuacaaacgugucugggugcuacagcuguaugaccggagcuaaagucuccauuaagcuccauagcucuaaaaauuccacggcgcacgugcgcugcaagggcgaugaaaccgccuuuagcguucuggagggggugcacucuuauaucgucucccugagcuucgaccaugcugugguugaugaacaaugucagcuuaacugcggaggccacgagucccaggugacacucaagggcaaucugauuuuucuggacguccccaaauucguggacgggucuuacaugcagaccuaucauagcacagugccuaccggagccaacauccccuccccuacggauuggcucaaugcccuguuuggcaacgggcuuagcagauggauccugggagucauuggcguucuccuugggggacuggcucuuuucuuucucaucauguuccugcugaagcucggcacaaaacaaguguuucggucucgcaccaagcuggccuga

SEQ ID NO: 14910 - RNA, 3222 nt, Artificial Sequence
  derived and/or modified CDS sequence (opt5) from SFTSV/FTLSV(YXX2)__KF356534.1__GP
augaugaaggugaucugguucagcucccugauuugccucgucauccaguguggcggggacaccggacccauuaucugcgccggcccuauucacucuaacaaaagcgcugauaucccgcaucugcuuggguacuccgagaagaucugucaaauugacagacugauccacguuucuagcuggcuccggaaucauucccaguuucagggauaugugggccagcgcgggggaagaucucaagugagcuacuaucccgccgaaaacuccuacagccgguggucuggccugcuuuccccuugcgaugcggacuggcugggcaugcucgucgugaaaaaggcuaaagggagcgauaugauuguucccggaccuucuuauaagggcaagguguucuuugagcgccccacauucgacggguacgucggauggggcuguggguccggaaaaagcagaacggaaucuggcgagcugugcuccagcgauuccggcaccucuagcgggcugcucccuuccgaccgggugcuguggaucggagauguugccugucagccgaugacacccauuccugaagagaccuuucuugagcuuaagagcuucucucaguccgaauuucccgacaucugcaaaauugauggcaucguguucaaucagugugagggggaaagccucccucaacccuuugacgucgccuggauggaugugggacacucucauaagaucauuaugcgcgagcacaaaacaaagugggugcaggagagcuccucuaaggacuucgucugcuauaaagaaggcaccgggccguguagcgaguccgaagagaagacaugcaaaaccagcggaucuugcagaggcgacaugcaguuuuguaagguugcuggcugcgaacacggggaggaggccuccgaagcuaaaugucggugcagccuggugcauaagccuggagagguggucgugucuuacggcgggaugcgcguuagacccaaauguuacggauucucccggaugauggccacgcuugaagugagccagccugagcaacgcaucggccagugcaccgggugucaccuggaaugcauuaacggcggagucagacucaucacacugaccuccgagcugaagucugcgacagugugugccagccauuuuugcuccucugcuaccagcggcaagaaauccacggagauucaguuccacagcgggucucucguuggaaagacagccauccacgugaaaggcgcucuggucgaugggaccgaguucacauuugaaggauccuguauguuccccgacggcugcgaugccguggacugcaccuuuugucgggaguuccuuaagaauccccaaugcuauccugcgaaaaaguggcuguuuaucauuaucgucauucuccugggguacgccggccuuaugcugcucaccaacgugcugaaggcuaucggaguuuggggcagcugggugauugccccggucaaacugguguucgcuaucaucaagaaacucaugcgcgccguuucuugucugauggggaagcugauggauagaggaagacaggugauucaugaagaaaucggcgagaaucgggaggggaaccaggacgauguccgcauugaaauggcccggcccagacgcgugcggcacuggauguauuccccugugauccugacaauucucgcuaucggacuggcggagggcugcgacgaaaugguucaugccgauagcaaacuugucucuuguagacaggggagcggcaauaugaaggagugcgugacgaccggacgcgcucugcuccccgccgugaacccuggccaagaggccugucugcacuuuacagcucccggguccccggacagcaagugccugaaaauuaaggucaaacggaucaaucucaaguguaaaaagucuuccagcuacuucgugccugaugccagaucccgcugcaccucuguucggagaugucgcugggcgggagacugccagagcggcugucccccucauuuuacauccaacucuuucagcgacgauugggcugggaagauggaccgggccggacugggcuuuuccgggugcucugauggcugcggaggcgccgcuugugggugcuucaaugccgcucccagcuguaucuuuuggagaaaauggguggaaaacccucacggaauuaucuggaaggucucccccugcgccgcgugggugccgagcgccguuauugagcuuaccaugccuucuggcgaagugcggacguuccaccccauguccgggauccccacacaggucuucaaaggagugagcguuaccuaucugggcucugacauggagguguccggccucaccgaucugugugaaauugaggagcuuaagagcaaaaagcuggcucucgccccuugcaaucaggcugggaugggagucgugggcaaagugggggaaauccaauguucuuccgaggaaagcgcccgcacaaucaagaaggacggaugcauuuggaacgcggaucuggucggcaucgagcugagaguugacgaugccguguguuacuccaaaauuaccagcguggaagcugucgccaacuauucugcuaucccgacaacgauugggggacuccgguuugagagaagccaugacucccagggcaagaucucuggcagcccccuggauaucaccgccauucgcggguccuucucugugaauuaccggggacuuagacugagccucuccgagaucacagcuaccugcacaggcgaaguuaccaacgugucugggugcuacagcuguaugacgggagccaaagucuccauuaagcugcacagcucuaaaaauuccaccgcgcaugugcgcugcaagggcgacgagacagccuuuagcguucuggaaggggugcacucuuauuccgucagccuuuccuucgauuacgcugugguugacgagcagugucagcucaacugcggaggccacgaaucucaagugacccugagaggcaaucugaucuuucucgacgucccuaaguucguggaugggagcuauaugcagacauaccauuccaccgugcccacgggagccaacauuccuagccccacagacuggcugaaugcccuuuuuggcaacgggcugucucgguggauccucggagucaucggcguucugcuugggggacuggcucucuucuuucugauuaugucccuguucaaacucggcaccaagcagaucuuucgcagcagaacaaaacuggccuga

SEQ ID NO: 14911 - RNA, 3222 nt, Artificial Sequence
  derived and/or modified CDS sequence (opt5) from SFTSV/Huaiyangshan virus(2010-FQM)__HQ419236.1__GP
augaugaaggugaucugguucagcucccugauuugccucgucauccaguguggcggggacaccggacccauuaucugcgccggcccuauucacucuaacaaaagcgcugauaucccgcaucugcuuggguacuccgagaagaucugucaaauugacagacugauccacguuucuagcuggcuccggaaucauucccaguuucagggauaugugggccagcgcgggggaagaucucaagugagcuacuaucccgccgaaaacuccuacagccgguggucuggccugcuuuccccuugcgaugcggacuggcugggcaugcucgucgugaaaaaggcuaaagggagcgauaugauuguucccggaccuucuuauaagggcaagguguucuuugagcgccccacauucgacggguacgucggauggggcuguggguccggaaaaagcagaacggaaucuggcgagcugugcuccagcgauuccggcaccucuagcgggcugcucccuuccgaccgggugcuguggaucggagauguugccugucagccgaugacacccauuccugaagagaccuuucuugagcucaagagcuucucucaguccgaauuucccgacaucugcaaaauugauggcaucguguucaaucagugugagggggaaagccucccucaacccuuugacgucgccuggauggaugugggacacucucauaagaucauuaugcgcgagcacaaaacaaagugggugcaggagagcuccucuaaggacuucgucugcuauaaagaaggcaccgggccguguagcgaguccgaagagaaggcuugcaaagccagcggaucuugcagaggcgacaugcaguuuuguaagguugcuggcugcgaacacggggaggaggccuccgaagcgaaaugucggugcagccuggugcauaagccuggagagguggucgugucuuacggcgggaugcgcguuagacccaaauguuacggauucucccggaugauggccacacuugaagugagccagccugagcaacgcaucggccagugcaccgggugucaccuggaaugcauuaacggcggagucagacucaucacgcugaccuccgagcugaagucugcuacagugugugccagccauuuuugcuccucugcuaccagcggcaagaaauccacagagauucaguuccacagcgggucucucguuggaaagaccgccauccacgugaaaggcgcgcuggucgaugggacggaguucacauuugaaggauccuguauguuccccgacggcugcgaugccguggacugcaccuuuugucgggaguuccuuaagaauccccaaugcuauccugcuaaaaaguggcuguuuaucauuaucgucauucuccugggguacgccggccuuaugcugcucacaaacgugcugaaggcuaucggaguuuggggcagcugggugauugccccggucaaacugguguucgccaucaucaagaaacucaugcgcgcuguuucuugucugauggggaagcugauggauagaggaagacaggugauucaugaagaaaucggcgagaaucgggaggggaaccaggacgauguccgcauugaaauggcgcggcccagacgcgugcggcacuggauguauuccccugugauccugaccauucucgccaucggacuggcugagggcugcgacgaaaugguucaugccgauagcaaacuugucucuuguagacaggggagcggcaauaugaaggagugcgugaccacaggacgcgcccugcuccccgcugugaacccuggccaagaggccugucugcacuuuacggcgcccggguccccggacagcaagugccugaaaauuaaggucaaacggaucaaucucaaguguaaaaagucuuccagcuacuucgugccugaugcuagaucccgcugcaccucuguucggagaugucgcugggccggagacugccagagcggcugucccccucauuuuacauccaacucuuucagcgacgauugggccgggaagauggaccgggcuggacugggcuuuuccgggugcucugauggcugcggaggcgccgcuugugggugcuucaaugccgcgcccagcuguaucuuuuggagaaaauggguggaaaacccucacggaauuaucuggaaggucucccccugcgccgcuugggugccgagcgccguuauugagcuuaccaugccuucuggcgaagugcggacauuccaccccauguccgggauccccacccaggucuucaaaggagugagcguuacguaucugggcucugacauggagguguccggccucacagaucugugugaaauugaggagcuuaagagcaaaaagcuggcucucgccccuugcaaucaggcggggaugggagucgugggcaaagugggggaaauccaauguucuuccgaggaaagcgcccgcaccaucaagaaggacggaugcauuuggaacgcugaucuggucggcaucgagcugagaguugacgaugccguguguuacuccaaaauuaccagcguggaagcugucgccaacuauucugccaucccgacaaccauugggggacuccgguuugagagaagccaugacucccagggcaagaucucuggcagcccccuggauaucacagcuauucgcggguccuucucugugaauuaccggggacuuagacugagccucuccgagaucacggcgaccugcacaggcgaaguuaccaacgugucugggugcuacagcuguaugacaggagccaaagucuccauuaagcugcacagcucuaaaaauuccaccgcucaugugcgcugcaagggcgacgagacggccuuuagcguucuggaaggggugcacucuuauuccgucagccuuuccuucgaucacgccgugguugacgagcagugucagcucaacugcggaggccaugaaucucaagugacccugagaggcaaucugaucuuucucgacgucccuaaguucguggaugggagcuacaugcagacauaucacuccaccgugcccacaggagcuaacauuccuagccccaccgacuggcugaaugcccuuuuuggcaacgggcugucucgguggauccucggagucaucggcguucugcuugggggacuugcgcuguucuuucugauuauguuccuguuuaaacucggcacgaagcagaucuuccgcuccagaacaaaacuggcuuga

SEQ ID NO: 14912 - RNA, 3222 nt, Artificial Sequence
  derived and/or modified CDS sequence (opt5) from SFTSV/Huaiyangshan virus(2010-LZR)__HQ419237.1__GP
augaugaaggugaucugguucagcucccugauuugccucgucauccaguguggcggggacaccggacccauuaucugcgccggcccuauucacucuaacaaaagcgcugauaucccgcaucugcuuggguacuccgagaagaucugucaaauugacagacugauccacguuucuagcuggcuccggaaucauucccaguuucagggauaugugggccagcgcgggggaagaucucaagugagcuacuaucccgccgaaaacuccuacagccgguggucuggccugcuuuccccuugcgaugcggacuggcugggcaugcucgucgugaaaaaggcuaaagggagcgauaugauuguucccggaccuucuuauaagggcaagguguucuuugagcgccccacauucgacggguacgucggauggggcuguggguccggaaaaagcagaacggaaucuggcgagcugugcuccagcgauuccggcaccucuagcgggcugcucccuuccgaccgggugcuguggaucggagauguugccugucagccgaugacacccauuccugaagagaccuuucuugagcuuaagagcuucucucaguccgaauuucccgacaucugcaaaauugauggcaucguguucaaucagugugagggggaaagccucccucaacccuuugacgucgccuggauggaugugggacacucucauaagaucauuaugcgcgagcacaaaacaaagugggugcaggagagcuccucuaaggacuucgucugcuauaaagaaggcaccgggccguguagcgaguccgaagagaagacaugcaaaaccagcggaucuugcagaggcgacaugcaguuuuguaagguugcuggcugcgaacacggggaggaggccuccgaagcuaaaugucggugcagccuggugcauaagccuggagagguggucgugucuuacggcgggaugcgcguuagacccaaauguuacggauucucccggaugauggccacgcuugaagugagccagccugagcaacgcaucggccagugcaccgggugucaccuggaaugcauuaacggcggagucagacucaucacacugaccuccgagcugaagucugcgacagugugugccagccauuuuugcuccucugcuaccagcggcaagaaauccacggagauucaguuccacagcgggucucucguuggaaagacagccauccacgugaaaggcgcucuggucgaugggaccgaguucacauuugaaggauccuguauguuccccgacggcugcgaugccguggacugcaccuuuugucgggaguuccuuaagaauccccaaugcuauccugcgaaaaaguggcuguuuaucauuaucgucauucuccugggguacgccggccuuaugcugcucaccaacgugcugaaggcuaucggaguuuggggcagcugggugauugccccggucaaacugguguucgcuaucaucaagaaacucaugcgcgccguuucuugucugauggggaagcugauggauagaggaagacaggugauucaugaagaaaucggcgagaaucgggaggggaaccaggacgauguccgcauugaaauggcccggcccagacgcgugcggcacuggauguauuccccugugauccugacaauucucgcuaucggacuggcggagggcugcgacgaaaugguucaugccgauagcaaacuugucucuuguagacaggggagcggcaauaugaaggagugcgugacgaccggacgcgcucugcuccccgccgugaacccuggccaagaggccugucugcacuuuacagcucccggguccccggacagcaagugccugaaaauuaaggucaaacggaucaaucucaaguguaaaaagucuuccagcuacuucgugccugaugccagaucccgcugcaccucuguucggagaugucgcugggcgggagacugccagagcggcugucccccucauuuuacauccaacucuuucagcgacgauugggcugggaagauggaccgggccggacugggcuuuuccgggugcucugauggcugcggaggcgccgcuugugggugcuucaaugccgcucccagcuguaucuuuuggagaaaauggguggaaaacccucacggaauuaucuggaaggucucccccugcgccgcguggauuccgagcgccgugaucgagcuuaccaugccuucuggcgaaguucggacguuccaccccauguccgggauucccacacagguguucaaaggagucagcgugaccuaucugggcucugacauggagguuuccggccucaccgaucugugugaaaucgaggagcuuaagagcaaaaagcuggcucucgccccuugcaaucaggcugggaugggaguggucggcaaagugggggaaauccaauguucuuccgaggaaagcgcccgcacaauuaagaaggacggaugcaucuggaacgcggaucuggugggcauugagcugagagucgacgaugccguuuguuacuccaaaaucaccagcguggaagcuguggccaacuauucugcuauuccgacaacgaucgggggacuccgguuugagagaagccaugacucccagggcaagaucucuggcagcccccuggauauuaccgccauccgcggguccuucucugucaauuaccggggacuuagacugagccucuccgagauuacagcuaccugcacaggcgaagugaccaacguuucugggugcuacagcuguaugacgggagccaaaguguccaucaagcugcacagcucuaaaaauuccaccgcgcauguccgcugcaagggcgacgagacagccuuuagcgugcuggaagggguucacucuuauuccgugagccuuuccuucgaucacgcugucguggacgagcagugucagcucaacugcggaggccaugaaucucaaguuacccugagaggcaaucugauuuuucucgacgugccuaaguucgucgaugggagcuacaugcagacauaucacuccaccgugcccacgggagccaacaucccuagccccacagacuggcugaaugcccuuuuuggcaacgggcugucucgguggauccucggagugauuggcguccugcuugggggacuggcucucuucuuucugaucaugucccuguucaaacucggcaccaagcagauuuuucgcagcagaacaaaacuggccuga

SEQ ID NO: 14913 - RNA, 3222 nt, Artificial Sequence
  derived and/or modified CDS sequence (opt5) from SFTSV/Huaiyangshan virus(2010-T112)__HQ419238.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuccuggagcuuaaguccuuuagccagucugaauuucccgacaucugcaaaauugauggaaucguguuuaaucagugugagggcgaaagccugccucaacccuucgacgucgccuggauggauguggggcacucccauaagaucauuaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcguuagacccaaauguuacggguuuucccggaugauggccacccuggaagugaaccagccuguccaacgcaucggacagugcacgggcugucaccuugagugcauuaaugggggcgugagacugaucacccucacaucugaacugaaguccgcgaccguuugugccucccauuucugcucuagcgcuacauccggaaagaaaagcaccgagauucaguuccacucuggcucccugguggggaagacggccauccacgucaaaggagcucucguggauggcacagaguuuaccuucgaagggagcuguauguuucccgacggaugcgaugccgucgacugcacauucugucgggaguuucugaagaacccccaaugcuauccugcgaaaaaguggcuuuucaucauuaucgugauucugcucggcuacgccgggcugaugcuucugaccaauguucucaaggcuaucggcauuuggggaucuugggugaucgccccggucaaacugaucuuugcuauuaucaagaaacugaugcgcaccguguccugucucaugggcaagcugauggauagagggcggcagguuauucaugaagagaucggagaaaacagagagggcaaucaggacgaugugcgcauugagauggcccggcccagacgcguccggcacuggauguaugccccugugauccuuacaauucuggcuauggggcucgcggaaagcugcgacgagauggugcaugccgauucuaaacugguuagcuguagacagggauccggcaacaugaaggaaugcgucacgaccgggcgcgcccuucugcccgccgugaauccuggccaagaggccugucuccacuucacagcucccggaagcccggacucuaagugccugaaaaucaaggugaaacggaucaaccugaaguguaaaaaguccagcuccuacuuugucccugaugccagaucucgcugcaccagcgugcggagaugucgcugggcgggcgacugccaguccgggugucccccucauuucacaucuaauagcuuuuccgacgauugggcuggaaagauggaccgggccggccucggguucucuggaugcagcgauggcugcgggggcgccgcuuguggaugcuuuaacgccgcucccuccuguauuuucuggagaaaauggguugagaauccucacggcaucauuuggaaggugagccccugcgucgccugggugccgucugcgguuaucgaacugaccaugccuuccggggaggugcggacguuccaccccaugagcggcauucccacacaggucuuuaaaggagugucuguuaccuaucuuggguccgacauggaagugagcggacugaccgaucucugugagaucgaggaacugaagucuaaaaagcuggcccuugcuccuugcaaccaggccggcaugggcgucguggggaaagugggagagauccaauguuccagcgaagaguccgcucgcacaauuaagaaggacggcugcaucuggaacgccgaucucgucgggauugaacugagaguugacgaugcgguguguuacagcaaaaucaccucuguggaggccgucgcuaauuauagcgccauuccgacaacgaucggaggccugcgguucgaaagaucccaugacucucaggggaagaucagcggaagcccccucgauauuaccgcuauccgcggcucuuuuagcgugaacuaccggggccugagacuuucccugucugagauuacagcuaccugcacaggggagguuaccaaugugagcggaugcuacuccuguaugacgggcgccaaagucagcaucaagcuccacucuuccaaaaacagcaccgcucaugugcgcugcaagggggacgaaacagcguucucuguucuggagggagugcacuccuauaccgucagccuguccuuugaucacgccgugguugacgaacagugucagcuuaauugcggcgggcaugagucucaagugacacucaagggaaaccugauuuuccuggacgucccuaaauuuguggauggcagcuacaugcagaccuaucacuccacggugcccacaggcgcuaauaucccuagccccaccgacuggcucaacgcccuguucgggaauggacuuucuagauggauccugggcgucauugggguucuccugggaggccuggcccuuuucuucaugaucaugucccucuuuaagcuggggacaaaacagguguuccggagccgcaccaagcuggcuuga

SEQ ID NO: 14914 - RNA, 3222 nt, Artificial Sequence
  derived and/or modified CDS sequence (opt5) from SFTSV/Huaiyangshan virus(2010-WJ)__HQ419229.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggaaaacgcggcgggagaucccaggugagcuacuaucucgccgaaaacucuuacucccgguggagcggacugcuuucucccugcgaugcggacuggcugggcaugcucgucgugaagaaagcuaagggcuccgauaugauuguuccugggcccagcuauaagggaaaaguguuuuucgagcgcccuaccuuugacggcuacgucggguggggauguggcucugggaaguccagaacagaaagcggagagcugugcuccucugauagcggcacguccagcggccugcuccccucugaccgggugcuguggaucggggauguugccugucaaccuaugaccccgauucccgaagagacauuccuugagcugaaauccuuuagccagucugaguucccugacaucugcaagauugauggaaucguguuuaaucagugugaaggcgaaagccucccccagccuuucgacgucgccuggauggauguggggcacucccauaaaaucauuaugcgcgagcacaagaccaagugggugcaagagucuagcuccaaagacuuugucugcuauaaggaaggaacaggccccuguagcgagucugaagagaaaaccugcaagacauccgggagcugcagaggagacaugcaguucuguaaaguugcuggcugcgaacacggcgaggaggccucugaagcuaagugucggugcucccuggugcauaaaccgggggagguggucgugagcuacggaggcaugcgcguuagaccuaaguguuacggguuuucccggaugauggccacccuugaagugaaccagcccgagcagcgcaucggacaaugcacgggcugucaccuggaaugcauuaaugggggcgucagacucaucacccugacaucugagcuuaagagcgcgaccgugugugccucccauuucugcucuagcgcuacauccggcaaaaagagcaccgagauucaguuccacucuggaucccucguugggaaaacggccauccacgugaagggagcucuggucgauggcacagaauuuaccuucgaggggagcuguauguuuccugacggaugcgaugccguggacugcacauucugucgggaauuucuuaaaaacccccagugcuaucccgcgaagaaguggcuguucaucauuaucgucauucuccugggcuacgccgggcuuaugcugcucaccaaugugcugaaagcuaucggcauuuggggaucuuggguuaucgccccugugaagcugaucuuugcuauuaucaaaaagcucaugcgcaccgucuccugucugaugggcaaacuuauggauagagggcggcaagugauucaugaggaaaucggagagaacagagagggcaaucaggacgauguucgcauugaaauggcccggccgagacgcgugcggcacuggauguauagccccgucauccugacaauucucgccaucgggcuggcugagucuugcgacgaaauggugcaugcggauagcaagcugguguccuguagacagggaagcggcaacaugaaggagugcguuacgaccgggcgcgcccugcucccugcugucaaucccggccaggaggccugucugcacuucacagccccuggaucucccgacuccaaaugccugaagaucaaagugaagcggauuaaccucaaauguaagaaguccuccucuuacuuugugccggaugcuagaagccgcugcaccuccguccggagaugucgcugggccggcgacugccaaucugggugcccuccccauuucacaccuaauagcuuuuccgacgauugggcgggaaaaauggaccgggcuggccugggguucucuggauguagcgauggcugcgggggcgccgccuguggaugcuuuaacgcugcccccuccuguaucuucuggagaaaguggguggaaaauccucacggcauuaucuggaaaguuagccccugcgcugccugggugccgucugcggucauugagcuuaccaugccuuccggggaagugcggacguuccaccccaugagcggaauccccacacagguuuuuaagggcgugucugucaccuaucugggguccgacauggaggugagcggacucaccgaucugugugaaaucgaggagcugaaaucuaagaaacuugcccucgcuccuugcaaccaggccggcaugggcguuguggggaaggucggagaaauucaguguuccagcgaggaauccgcucgcacaaucaagaaagacggcugcauuuggaacgccgaucugguggggaucgagcugagaguggacgaugcggucuguuacagcaagauuaccucuguugaagccguggcuaauuauagcgccaucccgacaacgaucggaggccuccgguucgagagaucccaugacucucaagggaaaauuagcggaagcccccuggauaucaccgcuauucgcggcucuuuuagcgugaacuaccggggccuuagacugucccucucugagaucacagcuaccugcacaggggaagucaccaaugugagcggaugcuacuccuguaugacgggcgccaagguuagcauuaaacugcacucuuccaagaacagcaccgcccaugugcgcugcaagggggacgagacagcguucucuguccuggaaggagugcacuccuauaccguuagccuuuccuuugaucacgccguggucgacgagcagugucagcucaauugcggcgggcaugaaucucaggugacacugaaaggaaaccugaucuuccucgacguuccuaaguuuguggauggcagcuacaugcaaaccuaucacuccacgguccccacaggcgcuaauaucccuagccccaccgacuggcugaacgcccuuuucgggaauggacugucuagauggauucucggcgugaucggggugcugcugggaggccuugcccucuuuuucaugauuaugucccuguuuaaacuggggacaaagcaggucuuccggagccgcaccaaacucgcuuga

SEQ ID NO: 14915 - RNA, 3222 nt, Artificial Sequence
  derived and/or modified CDS sequence (opt5) from SFTSV/Huaiyangshan virus(2010-WJQ)__HQ419230.1__GP
augaugaaggugaucugguucagcucccugauuugccucgucauccaguguggcggggacaccggacccauuaucugcgccggcccuacacacucuaacaaaagcgcugauauuccgcaucugcuuggguacuccgagaagaucugucaaaucgacagacugauucacguuucuagcuggcuccggaaucauucccaguuucagggauaugugggccagcgcgggggaagaucucaagugagcuacuaucccgccgaaaacuccuacagccgguggucuggccugcuuuccccuugcgaugcggacuggcugggcaugcucgucgugaaaaaggcuaaagggagcgauaugaucguucccggaccuucuuauaagggcaagguguucuuugagcgccccacguucgacggguacgucggauggggcuguggguccggaaaaagcagaaccgaaucuggcgagcugugcuccagcgauuccggcacaucuagcgggcugcucccuuccgaccgggugcuguggauuggagauguugccugucagccgaugacccccaucccugaagagacauuucuugagcuuaagagcuucucucaguccgaauuucccgacauuugcaaaaucgauggcauuguguucaaucagugugagggggaaagccucccucaacccuuugacgucgccuggauggaugugggacacucucauaagaucaucaugcgcgagcacaaaaccaagugggugcaggagagcuccucuaaggacuucgucugcuauaaagaaggcacagggccguguagcgaguccgaagagaagaccugcaaaacgagcggaucuugcagaggcgacaugcaguuuuguaagguugcuggcugcgaacacggggaggaggccuccgaagcuaaaugucggugcagccuggugcauaagccuggagagguggucgugucuuacggcgggaugcgcguuagacccaaauguuacggauucucccggaugauggccacccuugaagugagccagccugagcaacgcauuggccagugcacagggugucaccuggaaugcaucaacggcggagucagacucauuacccugacauccgagcugaagucugcgaccgugugugccagccauuuuugcuccucugcuacgagcggcaagaaauccacagagauccaguuccacagcgggucucucguuggaaagaccgccauucacgugaaaggcgcucuggucgaugggacagaguucaccuuugaaggauccuguauguuccccgacggcugcgaugccguggacugcaccuuuugucgggaguuccuuaagaauccccaaugcuauccugcgaaaaaguggcuguuuaucaucauugucauccuccugggguacgccggccuuaugcugcucacaaacgugcugaaggcuauuggaguuuggggcagcugggugaucgccccggucaaacugguguucgcuauuaucaagaaacucaugcgcgccguuucuugucugauggggaagcugauggauagaggaagacaggugauccaugaagaaauuggcgagaaucgggaggggaaccaggacgauguccgcaucgaaauggcccggcccagacgcgugcggcacuggauguauuccccugugauucugacgauccucgcuauuggacuggcggagggcugcgacgaaaugguucaugccgauagcaaacuugucucuuguagacaggggagcggcaauaugaaggagugcgugaccacaggacgcgcucugcuccccgccgugaacccuggccaagaggccugucugcacuuuaccgcucccggguccccggacagcaagugccugaaaaucaaggucaaacggauuaaucucaaguguaaaaagucuuccagcuacuucgugccugaugccagauccggaugcacaucuguucgccgguguagaugggcgggcgacugccagagcgggugucccccucauuuuaccuccaacucuuucagcgacgauugggcuggaaagauggaccgcgccggccugggguuuuccggcugcucugauggaugcggcggggccgcuuguggaugcuucaaugccgcucccagcuguaucuuuuggcggaaauggguggaaaacccucacggcaucauuuggaaggucucccccugcgccgcgugggugccgagcgccguuaucgagcuuacgaugccuucuggggaagugagaacauuccaccccauguccggcauucccacccaggucuucaaaggagugagcguuaccuaucugggcucugacauggagguguccgggcucacagaucugugugaaaucgaggagcuuaagagcaaaaagcuggcucucgccccuugcaaucaggcuggaaugggcgucguggggaaagugggagaaauucaauguucuuccgaggaaagcgcccggaccaucaagaaggacggcugcaucuggaacgcggaucuggucgggauugagcugcgcguugacgaugccguguguuacuccaaaaucacaagcguggaagcugucgccaacuauucugcuauuccgacgaccaucggaggccucagauuugagcggagccaugacucccagggcaagauuucugggagcccccuggauaucacagccaucagaggauccuucucugugaauuaccgcggccuucggcugagccucuccgagauuaccgccacaugcaccggggaaguuacgaacgugucuggaugcuacagcuguaugaccggcgcuaaagucuccaucaagcugcacagcucuaaaaauuccacagcgcaugugagaugcaagggggacgagaccgccuuuagcguucuggaaggagugcacucuuauuccgucagccuuuccuucgaucacgcugugguugacgagcagugucagcucaacugcggcggccaugaaucucaagugacacugcgcgggaaucugauuuuucucgacgucccuaaguucguggauggaagcuacaugcagaccuaucacuccacggugcccacaggcgccaacaucccuagccccaccgacuggcugaaugcccuuuuugggaacggacugucuagauggauucucggcgucaucgggguucugcugggaggccuugcucucuucuuucugaucaugucccuguucaaacucggcacaaagcagauuuuucggagccgcaccaaacuggccuga

SEQ ID NO: 14916 - RNA, 3222 nt, Artificial Sequence
  derived and/or modified CDS sequence (opt5) from SFTSV/Huaiyangshan virus(2010-WSQ)__HQ419235.1__GP
augaugaaggugaucugguucagcucccugauuugccucgucauccaguguucuggcgacagcgggcccauuaucugcgccggaccuauucacuccaacaaaucugcuggcaucccgcaucugcuuggguacagcgagaagaucugucaaauugauagacugauccacguuuccucuuggcuccggaaucauagccaguuucagggauaugugggccagcgcgggggaagaucccaagugagcuacuaucccgccgaaaacucuuacucccgguggagcggccugcuuucuccuugcgacgcggauuggcugggcaugcucgucgugaaaaaggcuaaagaguccgacaugauuguucccgggccuagcuauaagggaaagguguucuuugaacgccccaccuucgauggcuacgucggguggggauguggcucugggaaauccagaacagagagcggagaacugugcuccucugacagcggcacguccagcggccugcucccuucugaucgggugcuguggaucggggacguugccugucagccgaugacccccauuccugaggagacauuucuugaacugaaguccuucagccagucugaguuucccgauaucugcaaaauugacggaaucguguucaaucagugugaaggcgagagccucccucaacccuuugaugucgccuggauggacguggggcacucccauaagaucauuaugcgcgagcacaaaaccaagugggugcaggaaucuagcuccaaggauuucgucugcuauaaagagggaacaggcccguguagcgaaucugaggaaagagcuugcaagaccuccgggagcugccggggagacaugcaguuuuguaaaguugccggcugcgagcacggcgaggaggcuucugaagccaagugucgcugcucccuggugcauaaaccuggggaaguggucgugagcuacggaggcaugagaguucggcccaaguguuacggguucucccgcaugauggcgacacuugaggugaacccucccgaacagagaaucggacaaugcaccggcugucaccuggagugcauuaaugggggcguccggcucaucacgcugaccucugagcugcgcagcgccacagugugugcuucccauuuuugcucuagcgccaccuccggcaaaaagagcacagaaauucacuuccacucuggaucccucaucgggaagaccgcuauccauguuaaaggagcccugguggacggcacggaguucacauuugaagggagcuguauguuccccgauggaugcgacgcggucgauugcaccuuuuguagagaguuccuuaagaacccucagugcuauccggccaaaaaguggcuguuuauuaucauugugauccuccugggcuacgcugggcuuaugcugcucacaaauguccugaaagccauuggcguguggggaucuuggguuaucgcucccgugaagcugauguucgccaucauuaagaaacucaugcggaccgucuccugucuggugggcaagcugauggacagagggcgccagguuauccacgaagagauuggagagaacggcgaagggaaucaagaugacgugcggaucgagauggccagaccucgccgggucagacauuggauguauagccccgugauucuuaccauccucgcuauuggacuggcggaagauugcgacgagauggugcacgccgauucuaaacuuguuagcugucgccagggcuccgggaacaugaaggagugcaucacaacgggccgggcucugcucccugccgucaaucccggacaggaagccugucugcauuuuaccgcuccgggcagcccugacucuaaaugccugaagaucaaggugaaaagaauuaaccucaaguguaaaaaguccagcuccuacuucgugcccgaugcccgcucucggugcacaagcgucagacgcugucggugggcgggggacugccaguccggaugcccuccccacuuuaccucuaauagcuucuccgacgauugggcuggcaaaauggacagagccgggcugggauuuucuggcuguagcgaugggugcggcggagccgcuuguggcugcuucaacgccgcuccuuccuguaucuuuuggcggaaguggguggagaauccccacgggauuaucuggaagguuagcccgugcgccgcgugggugccuucugccgucauugaacuuacaaugcccuccggagaggugcgcaccuuccaucccaugagcggcaucccuacgcaaguuuucaaaggggugucugucacauaucugggauccgacauggaagugagcggccucaccgaucugugugagaucgaggaacugaagucuaaaaagcucgcucuugccccgugcaaccaggcuggcauggggguugugggaaaagucggcgagauucaguguuccagcgaagaguccgccagaaccaucaagaaagacgggugcauuuggaacgcggaucuggugggaaucgaacugcggguggacgaugccgucuguuacagcaagauuacaucuguugaggcuguggccaauuauagcgcuauccccaccacaaucggcgggcucagauuugagaagucccacgacucucagggaaaaauuagcggcuccccucuggauaucacggccauucgcggcucuuucagcgugaacuaccgggggcuuagacugucccucucugaaaucaccgccacaugcaccggagaggucacaaaugugagcggcugcuacuccuguaugaccggggcuaagguuagcauuaaacugcauucuuccaagaacagcacggcgcacgugcgcugcaaaggagacgaaaccgccuuuucuguccuggagggcgugcacuccuauaucguuagccuuuccuucgaucaugcuguggucgacgaacaaugucagcucaauugcgggggacacgagucucaggugacacugaagggcaaccugaucuuucucgacguucccaaguucguggauggcagcuacaugcagaccuaucauuccacagucccuaccggggccaauauucccagcccuacggacuggcugaacgcccuuuuuggaaauggccugucuagauggauccucggggugauuggagugcugcugggcgggcuugcucucuucuuucugaucauguuccugcucaaacugggaacaaagcaagucuuucggucccgcaccaaacuugccuga

SEQ ID NO: 14917 - RNA, 3222 nt, Artificial Sequence
  derived and/or modified CDS sequence (opt5) from SFTSV/Huaiyangshan virus(2010-WWG)__HQ419231.1__GP
augaugaaggugaucugguucagcacccugauuugcuuugucauccaguguuccggcgacucugggcccauuaucugcgccggaccuauucacagcaacaaauccgcugauaucccgcaucuccugggcuacucugagaagaucugucaaauugacagacuuauccacguuagcuccuggcugcggaaucauucucaguuccagggguaugugggacagcgcggcgggagaagccaaguguccuacuaucccgccgaaaacagcuacucucggugguccggacuccugagcccuugcgaugcggacuggcuuggcaugcuggucgugaaaaaggcuaaaggcucugauaugauuguucccgggccuuccuauaagggaaagguguuuuucgagcgccccacauuugacggcuacgucggguggggauguggcagcgggaaaucuagaacggaauccggagagcucugcagcuccgauucuggcaccagcuccggccugcugccuagcgaccgggugcucuggaucggggauguugccugucagccgaugacacccauuccugaagagaccuuccuggagcuuaagucuuuuucccagagcgaguuccccgacaucugcaaaauugauggaaucguguuuaaucagugugagggcgaaucucugccucaacccuucgacgucgccuggauggauguggggcacagccauaagaucauuaugcgcgagcacaaaacaaagugggugcaggaguccucuagcaaggacuuugucugcuauaaagaaggaaccggcccguguuccgagagcgaagagaagacaugcaaaaccucuggguccugcagaggagacaugcaguucuguaagguugcuggcugcgaacacggcgaggaggccagcgaagcuaaaugucggugcucucucgugcauaagccuggggagguggucguguccuacggaggcaugcgcguuagacccaaauguuacggguuuccucggaugauggccacgcuggaagugaaccagcccgagcaacgcaucggacagugcaccggcugucaccuugaaugcauuaaugggggcgucagacugaucacacucaccagcgagcugcgguccgcgacagugugugccucucauuucugcagcuccgcuaccucuggaaagaaaagcacggagauucaguuccacuccggcagccugguugggaagacagccauccacgugaagggagcucucgucgauggcaccgaauuuacauucgaggggucuuguauguuucccgacggaugcgaugccguggacugcaccuucugucgcgaauuucugaaaaacccucaaugcuauccggcgaagaaauggcuucugaucauuaucgucauucuccugggcuacgccgggcuuaugcugcucaccaaugugcugaaggcuaucggcauuuggggauccuggguuaucgcccccgugaagcugaucuucgcuauuaucaaaaagcucaugagagccgucagcugucugaugggcaaacuuauggaucgggggagacaggugauucaugagggaaucggcgaaaaccgcgaggggaaucaggacgauguucggauugagauggccagaccucgccgggugagacacuggauguauucucccgucauccugacaauucucgcuaucggacuggcggaauccugcgacgagauggugcaugccgauagcaaacuugugucuugucgccagggcagcgggaacaugaaggaaugcguuacgaccggccgggcucugcucccugccgucaaucccggacaagaggccugucugcacuuuacagcuccgggcuccccugacagcaagugccugaagaucaaagugaagagaauuaaccucaaauguaagaaaucuuccagcuacuucgugcccgaugcccgcucccggugcaccucugucagacgcugucggugggcgggggacugccagagcggaugcccuccccauuuuacauccaauucuuucagcgacgauugggcuggcaagauggacagagccgggcugggauuuuccggcuguucugaugggugcggcggagccgcuuguggcugcuucaacgccgcuccuagcuguaucuuuuggcggaaguggguggagaauccccacgggauuaucuggaaaguuuccccgugcgccgcgugggugccuagcgccgucauugaacuuaccaugcccucuggagaggugcgcacguuccaccccauguccggcaucccuacacagguuuucaagggggugagcgucaccuaucugggaucugacauggaaguguccggccucaccgaucugugugagaucgaagaacugaaaagcaagaaacuugcucucgccccgugcaaccaggcuggcauggggguugugggaaaggucggcgagauucaauguucuuccgaagagagcgccagaacaaucaaaaaggacgggugcauuuggaacgcggaucuggugggaaucgaacugcggguggacgaugccgucuguuacuccaagauuaccagcguugaggcuguggccaauuauucugcuauccccacaacgaucggcgggcucagauuugaacgcagccaugacucccagggaaaaauuucuggcagcccucuggauaucaccgccauucggggcuccuucucugugaacuacagagggcuucgccugagccucuccgagaucacagcuaccugcacaggagaggucaccaaugugucuggcugcuacagcuguaugacgggggccaagguuuccauuaaacugcacagcucuaagaacuccaccgcgcaugugagaugcaaaggagacgaaacagccuuuagcguccuggagggcgugcacucuuauaccguuucccuuagcuucgaucacgcuguggucgacgaacagugucagcucaauugcgggggacaugagucccaagugacacugaagggcaaccugaucuuucucgacguucccaaguucguggauggcucuuacaugcagaccuaucacagcacggucccuacaggggccaauauccccuccccuaccgacuggcugaacgcccuuuuuggaaauggccugagccgguggauucucggggugaucggagugcugcugggcgggcuugcucucuucuuuaugauuaugucucuguucaaacugggaacaaagcaggucuuucgcuccagaaccaaacucgccuga

SEQ ID NO: 14918 - RNA, 3222 nt, Artificial Sequence
  derived and/or modified CDS sequence (opt5) from SFTSV/Huaiyangshan virus(2010-WWX)__HQ419232.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuccuggagcuuaaguccuuuagccagucugaguuccccgacaucugcaaaauugauggaaucguguuuaaucagugugaaggcgaaagccugccucaacccuucgacgucgccuggauggauguggggcacucccauaagaucauuaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcguuagacccaaauguuacggguuuucccggaugauggccacccuggaagugaaccagccugagcaacgcaucggacagugcacgggcugucuucuggaaugcauuaaugggggcgucagacucaucacccugacaucugagcuuaagagcgcgaccgugugugccucccacuucugcucuagcgcuacauccggaaagaaaagcaccgagauucaguuccauucuggcucccucguugggaagacggccauccacgugaaaggagcucugaucgauggcacagaauuuaccuucgaggggagcuguauguuucccgacggaugcgaugccgucgacugcacauucugucgggaauuucuuaagaacccccaaugcuauccugcgaaaaaguggcuguucauuaucauugugauccuccugggcuacgccgggcuuaugcugcucaccaauguccugaaggcuauuggcaucuggggaucuugggugaucgccccgguuaaacugauuuuugcuaucauuaagaaacucaugcgcaccguguccugucugaugggcaagcugauggauagagggcggcaggucauccacgaggaaauuggagagaacagagagggcaaucaggacgaugugcgcaucgaaauggcccggcccagacgcguucggcauuggauguauagcccugugauucugacaauccucgccaucgggcuggcugagucuugcgacgaaaugguccacgcggauagcaaacuuguguccuguagacagggaagcggcaacaugaaggagugcgugacgaccgggcgcgcccugcuccccgcuguuaauccuggccaagaggccugucugcauuucacagcccccggaucuccggacuccaagugccugaaaauuaaggucaaacggaucaaccucaaguguaaaaagagcuccucuuacuuugugccugaugcuagaagccgcugcaccuccgugcggagaugucgcugggccggcgacugccagucugggugucccccucacuucacaagcaauuccuuuucugacgauugggcgggaaagauggaccgggcuggccugggguucagcggaugcuccgauggcugcgggggcgccgccuguggaugcuuuaacgcugcccccagcuguauuuucuggagaaaaugggucgaaaauccucauggcaucauuuggaaggugucucccugcgcugccuggguuccguccgcggugaucgagcuuaccaugccuagcggggaaguccggacguuccaccccaugucuggaauccccacacagguguuuaaaggcguuuccgugaccuaucuggggagcgacauggaggucucuggacucaccgaucugugugaaauugaggagcugaaguccaaaaagcucgcccuugcuccuugcaaccaggccggcaugggcgugguugggaaagugggagaaauccaauguagcuccgaggaaagcgcucgcacaauuaagaaggacggcugcaucuggaacgccgaucuggucgggauugagcugagaguggacgaugcgguguguuacucuaaaaucaccagcgucgaagccguugcuaauuauuccgccaucccgacaacgauuggaggccuccgguucgagagaucucacgacagccaggggaagaucuccggaucuccccuggauauuaccgcuauccgcggcagcuuuuccgugaacuaccggggccuuagacugucucucagcgagauuacagcuaccugcacaggggaagugaccaaugucuccggaugcuacagcuguaugacgggcgccaaagugucuaucaagcugcauuccagcaaaaacucuaccgcccacguucgcugcaagggggacgagacagcguucuccgugcuggaaggaguccauagcuauaccgugucccuuucuuuugaucacgccguuguggacgagcagugucagcucaauugcggcgggcacgaaagccaagucacacugaagggaaaccugaucuuccucgacgugccuaaauuuguugauggcuccuacaugcagaccuaucauagcacggugcccacaggcgcuaauauuccuucucccaccgacuggcugaacgcccuuuucgggaauggacuguccagauggauccucggcgucauuggggugcugcugggaggccuugcccucuuuuucaugaucaugagccuguuuaagcuggggacaaaacagguguuccggucucgcaccaagcucgcuuga

SEQ ID NO: 14919 - RNA, 3222 nt, Artificial Sequence
  derived and/or modified CDS sequence (opt5) from SFTSV/Huaiyangshan virus(2010-ZGQ)__HQ419233.1__GP
augaugaaggugaucugguucagcucccugauuugccucgucauccaguguggcggggacaccggacccauuaucugcgccggcccuacacacucuaacaaaagcgcugauauuccgcaucugcuuggguacuccgagaagaucugucaaaucgacagacugauucacguuucuagcuggcuccggaaucauucccaguuucagggauaugugggccagcgcgggggaagaucucaagugagcuacuaucccgccgaaaacuccuacagccgguggucuggccugcuuuccccuugcgaugcggacuggcugggcaugcucgucgugaaaaaggcuaaagggagcgauaugaucguucccggaccuucuuauaagggcaagguguucuuugagcgccccacguucgacggguacgucggauggggcuguggguccggaaaaagcagaaccgaaucuggcgagcugugcuccagcgauuccggcacaucuagcgggcugcucccuuccgaccgggugcuguggauuggagauguugccugucagccgaugacccccaucccugaagagacauuucuugagcuuaagagcuucucucaguccgaauuucccgacauuugcaaaaucgauggcauuguguucaaucagugugagggggaaagccucccucaacccuuugacgucgccuggauggaugugggacacucucauaagaucaucaugcgcgagcacaaaaccaagugggugcaggagagcuccucuaaggacuucgucugcuauaaagaaggcacagggccguguagcgaguccgaagagaagaccugcaaaacgagcggaucuugcagaggcgacaugcaguuuuguaagguugcuggcugcgaacacggggaggaggccuccgaagcuaaaugucggugcagccuggugcauaagccuggagagguggucgugucuuacggcgggaugcgcguuagacccaaauguuacggauucucccggaugauggccacccuugaagugagccagccugagcaacgcauuggccagugcacagggugucaccuggaaugcaucaacggcggagucagacucauuacccugacauccgagcugaagucugcgaccgugugugccagccauuuuugcuccucugcuacgagcggcaagaaauccacagagauccaguuccacagcgggucucucguuggaaagaccgccauucacgugaaaggcgcucuggucgaugggacagaauuuaccuuugagggauccuguauguuccccgacggcugcgaugccguggacugcaccuuuugucgggaguuccuuaagaauccccaaugcuauccugcgaaaaaguggcuguuuaucaucgucgugauucuccugggguacgccggccuuaugcugcucacaaacguucugaaggcuaucggaguguggggcagcugggucauugccccggugaaacugguuuucgcuaucauuaagaaacucaugcgcgccgugucuugucugauggggaagcugauggauagaggacggcaggucauccaugaagaaaucggcgagaauagagaggggaaccaggacgaugugcgcauugaaauggcccggcccagacgcgugcggcacuggauguauuccccuguuauccugacgauucucgcuaucggacuggcggagggcugcgacgaaaugguccaugccgauagcaaacuugugucuuguagacaggggagcggcaauaugaaggagugcgugaccacaggacgcgcucugcuccccgccgucaacccuggccaagaggccugucugcacuuuaccgcucccggguccccggacagcaagugccugaaaauuaaggugaaacggaucaaucucaaguguaaaaagucuuccagcuacuucguuccugaugccagaucccgcugcacaucugugcggagaugucgcugggcgggagacugccagagcggcugucccccucauuuuaccuccaacucuuucagcgacgauugggcugggaagauggaccgggccggacugggcuuuuccgggugcucugauggcugcggaggcgccgcuugugggugcuucaaugccgcucccagcuguauuuucuggagaaaaugggucgaaaacccucacggaaucaucuggaaggugucccccugcgccgcguggguuccgagcgccgugauugagcuuacgaugccuucuggcgaaguccggacauuccaccccauguccgggauccccacccagguguucaaaggaguuagcgugaccuaucugggcucugacauggaggucuccggccucacagaucugugugaaauugaggagcuuaagagcaaaaagcuggcucucgccccuugcaaucaggcugggaugggaguggugggcaaagucggggaaauccaauguucuuccgaggaaagcgcccgcaccauuaagaaggacggaugcaucuggaacgcggaucugguuggcaucgagcugagaguggacgaugccguguguuacuccaaaauuacaagcgucgaagcuguggccaacuauucugcuaucccgacgaccauugggggacuccgguuugagagaagccaugacucccagggcaagaucucuggcagcccccuggauauuacagccauccgcggguccuucucuguuaauuaccggggacuuagacugagccucuccgagaucaccgccacaugcaccggcgaagugacgaacgucucugggugcuacagcuguaugaccggagcuaaaguguccauuaagcugcacagcucuaaaaauuccacagcgcauguucgcugcaagggcgacgagaccgccuuuagcgugcuggaagggguccacucuuauuccgugagccuuuccuucgaucacgcuguuguggacgagcagugucagcucaacugcggaggccaugaaucucaagucacacugagaggcaaucugaucuuucucgacgugccuaaguucguggaugggagcuacaugcagaccuaucacuccacgguccccacaggagccaacauuccuagccccaccgacuggcugaaugcccuuuuuggcaacgggcugucucgguggauccucggaguuauuggcgugcugcuugggggacuggcucucuucuuucugaucaugucccuguucaaacucggcacaaagcagaucuuucgcagcagaaccaaacuggccuga

SEQ ID NO: 14920 - RNA, 3222 nt, Artificial Sequence
  derived and/or modified CDS sequence (opt5) from SFTSV/Huaiyangshan virus(M-HZM)__JF951393.1__GP
augaugaaggugaucugguucagcucccugaccugccucgucauucaguguucuggcgacagcgggcccaucauuugcgccggaccuauccacuccaacaaaucugcuggcauuccgcaucugcuuggguacagcgagaagaucugucaaaucgauagacugauucacguuuccucuuggcuccggaaucauagccaguuucagggauaugugggccagcgcgggggaagaucccaagugagcuacuaucccgccgaaaacucuuacucccgguggagcggccugcuuucuccuugcgacgcggauuggcugggcaugcucgucgugaaaaaggcuaaagaguccgacaugaucguucccgggccuagcuauaagggaaagguguucuuugaacgccccacauucgauggcuacgucggguggggauguggcucugggaaauccagaacggagagcggagaacugugcuccucugacagcggcaccuccagcggccugcucccuucugaucgggugcuguggauuggggacguugccugucagccgaugacacccaucccugaggagaccuuucuugaacugaaguccuucagccagucugaguuucccgauauuugcaaaaucgacggaauuguguucaaucagugugaaggcgagagccucccucaacccuuugaugucgccuggauggacguggggcacucccauaagaucaucaugcgcgagcacaaaacaaagugggugcaggaaucuagcuccaaggauuucgucugcuauaaagagggaaccggcccguguagcgaaucugaggaaaaggcuugcaaaacauccgggagcugcagaggagacaugcaguuuuguaagguugccggcugcgagcacggcgaggaagccucugaggccaaaugucggugcucccuggugcauaagccuggggaaguggucgugagcuacggaggcaugcgcguuagacccaaauguuacggguucucccggaugauggcgacccuugaggugaacccucccgaacagcgcauuggacaaugcacgggcugucaccuggagugcaucaaugggggcgucagacucauuacccugacaucugagcugcggagcgccaccgugugugcuucccauuuuugcucuagcgccacauccggaaagaagaacaccgaaauccacuuccacagcggcucucucguugggaaaacggcuauucaugugaagggagcccuggucgacggcacagaguucaccuuugaaggguccuguauguuccccgauggaugcgacgcgguggauugcacauuuugucgcgaguuccuuaaaaauccucagugcuauccggccaagaaauggcuguuuaucaucauugucauccuccugggcuacgcugggcuuaugcugcucaccaacgugcugaaggccauuggcguuuggggaagcugggugaucgcucccgucaagcugauguucgccauuaucaaaaagcucaugagaaccgugucuugucugguuggcaaacuuauggaccgggggagacaggugauccacgaagagauuggagagaauggcgaagggaaccaagaugacguccgcaucgagauggcccggccuagacgcgugcggcauuggauguauucccccgugauucugacaauccucgcuauuggacuggcggaaggcugcgaugagaugguucacgccgacagcaaacuugucucuuguagacaggggagcggcaauaugaaggagugcaucacgaccggacgcgcucugcucccugccgugaaccccggccaggaagccugucugcauuuuacagcuccgggguccccugauagcaagugccugaagauuaaagugaagcggaucaaucucaaauguaagaaaucuuccagcuacuucguccccgacgccagaucccgcugcaccucugugcggagaugucgcugggcgggagauugccagagcggcugcccuccccacuuuacauccaacucuuucagcgacgacugggcugggaagauggaucgggccggacugggcuuuuccggguguucugacggcugcggaggcgccgcuugugggugcuucaaugccgcuccuagcuguaucuuuuggagaaaguggguugagaacccccacggaauuaucuggaaaguguccccgugcgccgcgugggucccuagcgccgugauugaacuuaccaugcccucuggcgagguucggacguuccaucccauguccgggaucccuacacaaguguucaagggagucagcgugaccuaucugggcucugauauggaaguuuccggccucaccgaccugugugagauugaggaacugaaaagcaagaaacuugcucucgccccgugcaaccaggcugggaugggaguggucggcaaggugggggagauccaguguucuuccgaagagagcgcccgcacaaucaaaaaggauggaugcauuuggaaugcggaccuggugggcaucgaacugagagucgaugacgccguuuguuacuccaagauuaccagcguggaggcuguggccaacuauucugcuauccccacaacgauugggggacuccgguuugagagaagccacgauucccagggcaaaaucucuggcagcccucuggacaucaccgccauucgcggguccuucucugucaaucuucggggacugagacucagccuguccgaaaucacagcuaccugcacaggcgaggugaccaacguuucugggugcuacagcuguaugacgggagcuaagguguccauuaaacugcauagcucuaaaaauuccaccgcgcacguccgcugcaagggcgaugaaacagccuuuagcgugcuugaggggguucacucuuacaucgugucccucagcuucgaccaugcugucguggaugaacaaugucagcugaacugcggaggccacgagucccagguuacccugaagggcaaucucauuuuucuggacgugcccaaguucgucgacgggucuuauaugcagacauaccauagcaccgugccuacgggagccaacauccccuccccuacagauuggcuuaaugcccuguuuggcaacgggcucagcagauggauccugggagugauuggcguccugcuugggggacucgcucuguucuuucugaucauguuccuccugaaacuuggcaccaagcaaguuuuucggucucgcacaaaacuggccuga

SEQ ID NO: 14921 - RNA, 3222 nt, Artificial Sequence
  derived and/or modified CDS sequence (opt5) from SFTSV/Phlebovirus(AH15/China/2010 strain AH15)__HQ141593.1__GP
augaugaaggugaucugguucuuuagccugauuugccucgucauccaguguggcggggacaccggacccauuaucugcgccggcccuauucacuccaacaaaucugcugauaucccgcaucugcuuggguacagcgagaagaucugucaaauugacagacugauccacguuuccucuuggcuccggaaucauagccaguuccagggauaugugggccagcgcgggggaagaucccaagugucuuacuaucccgccgaaaacagcuacucccgguggagcggccugcuuucuccuugcgaugcggacuggcugggcaugcucgucgugaaaaaggcuaaaggguccgauaugauuguucccggaccuagcuauaagggcaagguguuuuucgagcgccccacauuugacggguacgucggauggggcugugggucuggaaaauccagaacggaaagcggcgagcugugcuccuccgauagcggcaccuccucugggcugcucccuagcgaccgggugcuguggaucggagauguugccugucagccgaugacacccauuccugaagagaccuuccuugagcugaaguccuuuagccagucugaguuccccgacaucugcaaaauugauggcaucguguuuaaucagugugaaggggaaucccucccucaacccuucgacgucgccuggaugggagugggccacagccauaagaucauuaugcgcgagcacaaaacaaagugggugcaggagucuagcuccaaggauuuugucugcuauaaagaagggaccggaccguguucugagagcgaagagaagacaugcaaaaccuccggcagcugcagaggcgacaugcaguucuguaagguugcugggugcgaacacggagaggaggccucugaagcuaaaugucggugcucccuggugcauaagccuggcgagguggucgugagcuacgggggaaugcgcguuagacccaaauguuacggcuuuucucggaugauggccacgcuugaagugaacgagccugaacagcgcaucgggcaaugcaccggcugucaccuggagugcauuaauggaggcgucagacucaucacacugaccuccgagcuuaagagcgcgacagugugugccucccauuucugcucuagcgcuaccuccgggaagaaaucuacggaaauucaguuccacagcggaucccucguuggcaagacagccauccacgugaaaggggcucuggucgacggaaccgaguuuacauucgaaggcagcuguauguuucccgaugggugcgacgccguggauugcaccuucugucgggaguuucuuaagaacccccagugcuauccugcgaaaaaguggcuguucaucauuaucgucauucuccugggcuacgccggacuuaugcugcucaccaaugugcugaaggcuaucggcguuugggggucuugggugauugccccggucaaacugguguuugcuaucaucaagaaacucaugcgcgccguuuccugucugaugggaaagcugauggacagaggccggcaagugauucaugaagagaucggggagaacagagaaggaaaucaggaugacguccgcauugagauggcccggcccagacgcgugcggcacuggauguauagcccugugauccugacaauucucgcuaugggccuggcggaagggugcgaugagaugguucaugccgacucuaaacuugucuccuguagacagggcagcggaaacaugaaggagugcgugacgaccggccgcgcucugcuccccgccgugaauccugggcaggaagccugucugcacuucacagcucccggaucuccggauagcaagugccugaaaaucaaggucaaacggauuaaccucaaguguaaaaaguccagcucuuacuuugugccugacgccagaucccgcugcaccagcguucggagaugucgcugggcgggcgauugccaauccgggugucccccucauuucacaucuaauagcuuuuccgacgacugggcuggaaagauggaucgggccggccugggguucucuggcugcagcgacggaugcggcggggccgcuuguggaugcuuuaacgccgcucccuccuguaucuucuggagaaaauggguggagaauccucacggcaucauuuggaaggucucucccugcgccgcgugggugccgagcgccguuaucgaacuuaccaugccuuccggggaggugcggacguuccaccccaugagcggcauucccacacaggucuuuaaaggagugucuguuaccuaucugggcuccgauauggaagugagcgggcucaccgaccugugugagaucgaggaacugaagucuaaaaagcucgcucuugccccuugcaaccaggcuggaaugggcgucguggggaaagugggagagauucaguguuccagcgaagagucugcccgcacaaucaagaaggauggcugcaucuggaacgcggaccuggucgggauugaacugagaguugaugacgccguguguuacuccaaaaucaccagcguggaggcugucgccaauuauuccgcuauuccgacaacgaucggaggccuccgguucgagagaagccaugauucucaaggcaagauuagcgggucuccccuggacaucaccgccauccgcggaucuuuuagcauuaacuaccggggccuuagacugucccucacagaaaucaccgccacaugcaccggggaggugacgaauguuucuggaugcuacagcuguaugaccggcgcuaaaguguccauuaagcugcacucuagcaaaaacuccacagcgcauguccgcugcaagggggaugaaaccgccuucagcgugcuggagggaguucacucuuauuccgugagccuuucuuuugaccacgcugucguggaugaacagugucagcucaauugcggcggccaugagucccagguuacacugagagggaaccugaucuuccucgacgugccuaaguuugucgacggaagcuacaugcaaaccuaucacuccacggugcccacaggcgccaauauuccuucucccaccgauuggcugaacgcccuuuucgggaauggacugagccgguggauccucggcgugaucgggguccugcugggaggccuugcucucuuuuuccugauuaugucccuguuuaaacucggcacaaagcagguuuuccgcagcagaaccaaacuggccuga

SEQ ID NO: 14922 - RNA, 3222 nt, Artificial Sequence
  derived and/or modified CDS sequence (opt5) from SFTSV/Phlebovirus(HN6/China/2010 strain HN6)__HQ141596.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuccuggagcuuaaguccuuuagccagucugaguuccccgacaucugcaaaauugauggaaucguguuuaaucagugugaaggcgaaagccugccucaacccuucgacgucgccuggauggauguggggcacucccauaagaucauuaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcguuagacccaaauguuacggguuuucccggaugauggccacccuggaagugaaccagccugagcaacgcaucggacagugcacgggcugucaccuugaaugcauuaaugggggcgucagacugaucacccucacaucugagcuuaagagcgcgaccgugugugccucccauuucugcucuagcgcuacauccggaaagaaaagcaccgagauucaguuccacucuggcucccugguugggaagacggccauccacgugaaaggagcucucgucgauggcacagaauuuaccuucgaggggagcuguauguuucccgacggaugcgaugccguggacugcacauucugucgggaauuucugaagaacccccaaugcuauccugcgaaaaaguggcuuuucaucauuaucgucauucugcucggcuacgccgggcugaugcuucugaccaaugugcucaaggcuaucggcauuuggggaucuuggguuaucgccccggugaaacugaucuuugcuauuaucaagaaacugaugcgcaccgucuccugucucgugggcaagcugauggauagagggcggcagguuauucaugaggaaaucggagagaacagagagggcaaucaggacgaugugcgcauugaaauggcccggcccagacgcguccggcacuggauguauagcccugugauccuuacaauucuggccaucgggcucgcugagucuugcgacgaaauggugcaugcggauagcaaacugguuuccuguagacagggaagcggcaacaugaaggagugcgucacgaccgggcgcgcccuucugcccgcugugaauccuggccaagaggccugucuccacuucacagcccccggaucuccggacuccaagugccugaaaaucaaggugaaacggauuaaccugaaguguaaaaagagcuccucuuacuuugucccugaugcuagaagccgcugcaccuccgugcggagaugucgcugggccggcgacugccagucugggugucccccucauuucacaagcaauuccuuuucugacgauugggcgggaaagauggaccgggcuggccucggguucagcggaugcuccgauggcugcgggggcgccgccuguggaugcuuuaacgcugcccccagcuguaucuucuggagaaaauggguugaaaauccucacggcauuaucuggaaggugucucccugcgcugccugggucccguccgcggugauugagcugaccaugccuagcggggaaaugcggacguuccaccccaugucuggaauccccacacagguuuuuaaaggcguguccgucaccuaucuugggagcgacauggaggugucuggacugaccgaucucugugaaaucgaggagcugaaguccaaaaagcuggcccuugcuccuugcaaccaggccggcaugggcguuguggggaaagucggagaaauucaauguagcuccgaggaaagcgcucgcacaaucaagaaggacggcugcauuuggaacgccgaucucguggggaucgagcugagaguggacgaugcggucuguuacucuaaaauuaccagcguugaagccguggcuaauuauuccgccaucccgacaacgaucggaggccugcgguucgagagaucucaugacagccaggggaagauuuccggaucuccccucgauaucaccgcuauucgcggcagcuuuuccgugaacuaccggggccugagacuuucucugagcgagaucacagcuaccugcacaggggaagucaccaauguguccggaugcuacagcuguaugacgggcgccaccguuucuauuaaacuccacuccagcaagaacucuacagcccaugugcgcugcaaaggggacgagaccgcguucuccguccuggaaggagugcacagcuauacaguuucccugucuuuugaucacgccguggucgacgagcagugucagcuuaauugcggcgggcaugaaagccaagugacccucaagggaaaccugaucuuccuggacguuccuaaguuuguggauggcuccuacaugcagacguaucacagcacaguccccaccggcgcuaauaucccuucucccacagacuggcucaacgcccuguucgggaauggacuuuccagauggauucugggcgugaucggggugcuccugggaggccuggcccuguuuuucaugauuaugagccucuuuaaacuggggaccaagcaggucuuccggucucgcaccaaacuggcuuga

SEQ ID NO: 14923 - RNA, 3222 nt, Artificial Sequence
  derived and/or modified CDS sequence (opt5) from SFTSV/Phlebovirus(JN1/China/2010)__JN258706.1__GP
augaugaaggugaucugguucagcucccugauuugccucgucauccaguguucuggcgacagcgggcccauuaucugcgccggaccuauucacuccaacaaaucugcuggcaucccgcaucugcuuggguacagcgagaagaucugucaaauugauagacugauccacguuuccucuuggcuccggaaucauagccaguuucagggauaugugggccagcgcgggggaagaucccaagugagcuacuaucccgccgaaaacucuuacucccgguggagcggccugcuuucuccuugcgacgcggauuggcugggcaugcucgucgugaaaaaggcuaaagaguccgacaugauuguucccgggccuagcuauaagggaaagguguucuuugaacgccccaccuucgauggcuacgucggguggggauguggcucugggaaauccagaacagagagcggagaacugugcuccucugacagcggcacguccagcggccugcucccuucugaucgggugcuguggaucggggacguugccugucagccgaugacccccauuccugaggagacauuucuugaacugaaguccuucagccagucugaguuucccaauaucugcaaaauugauggaaucguguucaaccagugugaaggcgagagccucccucaacccuuugacgucgccuggauggauguggggcacucccauaagaucauuaugcgcgagcacaaaaccaagugggugcaggaaucuagcuccaaggacuucgucugcuauaaagagggaacaggcccguguagcgaaucugaggaaaaggcuugcaaaaccuccgggagcugcagaggagauaugcaguuuuguaagguugccggcugcgagcacggcgaggaagcuagcgaggccaaaugucggugcucccuggugcauaagccuggggaaguggucgugagcuacggaggcaugcgcguuagacccaaauguuacggguucucccggaugauggcgacacuugaggugaauccucccgaacagcgcaucggacaaugcaccggcugucaccuggagugcauuaacgggggcgucagacucgugacgcugaccucugagcugcggagcgccacaguuugugcuucccauuuuugcucuagcgccaccuccggaaagaagucuacagaaauccacuuccacucuggcucccucguggggaaaaccgcuauucaugucaagggagcccugguggacggcacggaguucacauuugaagggagcuguauguuccccgacggaugcgaugcggucgacugcaccuuuugucgcgaguuccuuaaaaauccucagugcuauccggccaagaaauggcuguuuaucaucauugugauccuccugggcuacgcugggcuuaugcugcucacaaacguucugaaggccauuggcguguggggaucuugggucaucgcucccgugaagcugauguucgccauuaucaaaaagcucaugagaaccguuuccugucuggugggcaaacuuauggaucgggggagacaggucauccacgaagagauuggagagaauggcgaagggaaccaagacgaugugcgcaucgagauggcccggccuagacgcgugcggcauuggauguauagccccguuauucugaccauccucgcuauuggacuggcggaaggcugcgacgagaugguccacgccgauucuaagcuggugagcuguagacagggguccggcaauaugaaagagugcaucacaacgggacgcgcucugcucccugccgugaaccccggccaggaagccugucugcauuuuaccgcuccggggagcccugacucuaagugccugaagauuaaagucaagcggaucaaucucaaauguaagaaauccagcuccuacuucgugcccgaugccagaucucgcugcacaagcguucggagaugucgcugggcgggagacugccaguccggcugcccuccccacuuuaccucuaacagcuucuccgaugacugggcugggaagauggaccgggccggacugggcuuuucuggguguagcgauggcugcggaggcgccgcuugugggugcuucaaugccgcuccuuccuguaucuuuuggagaaaguggguggagaacccccacggaauuaucuggaaagucagcccgugcgccgcgugggugccuucugccguuauugaacuuacaaugcccuccggcgaggugcggaccuuccaucccaugagcgggaucccuacgcaagucuucaagggagugucuguuacauaucugggcuccgacauggaagugagcggccucaccgaucugugugagauugaggaacugaaaucuaagaaacuugcucucgccccgugcaaccaggcugggaugggagucgugggcaaggugggggagauccaguguuccagcgaagaguccgcccgcaccaucaaaaaggacggaugcauuuggaaugcggaucuggucggcaucgaacugagaguugacgaugccguguguuacagcaagauuacaucuguggaggcugucgccaacuauagcgcuauccccaccacaauugggggacuccgguuugagagaucccacgacucucagggcaaaaucagcggcuccccucuggauaucacggccauucgcgggucuuucagcgugaauuaccggggacuuagacugucccucucugaaaucaccgccacaugcaccggcgagguuacaaacgugagcgggugcuacuccuguaugaccggagcuaaggucagcauuaaacugcauucuuccaagaauagcacggcgcacgugcgcugcaaaggcgacgaaaccgccuuuucuguucugaagggggugcacuccuauaucgucagccuuuccuucgaucaugcugugguugacgagcaaugucagcucaacugcggaggccacgaaucucaggugacacugaagggcaaucugauuuuucucgauguccccaucuucguggacgggagcuacaugcagaccuaucauuccacagugccuaccggagccaacauccccagcccuacggacuggcugaaugcccuuuuuggcaacgggcugucuagauggauucucggagucaucggcguucugcuugggggacuugcucucuucuuucugauuauguuccugcucaaacugggcacaaagcaaguguuucggucccgcaccaaacuugccuga

SEQ ID NO: 14924 - RNA, 3222 nt, Artificial Sequence
  derived and/or modified CDS sequence (opt5) from SFTSV/Phlebovirus(JS2010-014)__JQ317170.1__GP
augaugaaggugaucugguucagcuaccugauuugcuuugucauccaguguuccggcgacucugggcccauuaucugggccggaccuauucacagcaacaaauccgcugauaucccgcaucuccugggcuauucugagaagaucugccaaauugacagacuuauccacguuagcuccuggcugcggaaucauucucaguuccagggguacgugggacagcgcggcgggagaagccaaguguccuauuaccccgccgaaaacagcuauucucggugguccggacuccugagcccuugugaugcggacuggcuuggcaugcuggucgugaaaaaggcuaaaggcucugauaugauuguucccgggccuuccuacaagggaaagguguuuuucgagcgccccaccuuugacggcuaugucggguggggaugcggcagcgggaaaucuagaacagaauccggagagcucuguagcuccgauucuggcacgagcuccggccugcugccuagcgaccgggugcucuggaucggggauguugccugccagccgaugacccccauuccugaagagacauuccuggagcuuaagucuuuuucccagagcgaguuccccgacaucuguaaaauugauggaaucguguuuaaucagugcgagggcgaaucucugccucaacccuucgacgucgccuggauggauguggggcacagccauaagaucauuaugcgcgagcacaaaaccaagugggugcaggaguccucuagcaaggacuuugucuguuacaaagaaggaacaggcccgugcuccgagagcgaagagaagaccuguaaaacaucuggguccugcagaggagacaugcaguucugcaagguugcuggcugugaacacggcgaggaggccagcgaagcuaaaugccgguguucucucgugcauaagccuggggagguggucguguccuacggaggcaugcgcaucagacccaaaugcuauggguuuagccggaugauggccacccuggaaguuucccagccugagcaacgccuuggacaguguacgggcugccaccuggaauguauuaacgggggcgugagacucaucacccugacaucugagcuuaagagcgcgaccgucugcgccucccauuucuguucuagcgcuacauccggaaagaaaagcaccgagauucaguuccacucuggcucccucguggggaagacggccauccacguuaaaggagcucugguggauggcacagaauuuaccuucgaggggagcugcauguuucccgacggaugugaugccgucgacugcacauucugccgggaauuucuuaagaauccccaauguuacccugcgaaaaaguggcuguucaucauuaucgugauucuccugggcuaugccgggcuuaugcugcucaccaacguccugaaggcuaucggcauuuggggaucuugggugaucgccccgguuaaacugauguuugcuaucauuaagaaacucaugcgcaccguguccugccugaugagaaagcugauggaucggggcagacaggucauccaugaggaaauuggggagaaucgcgugggaaaccaggacgauguucggaucgagauggccagaccccgccgggugagacacuggauguacagcccugucauucugacaauccucgccauuggccuggcugaaucuugugacgagauggugcaugcggauagcaaacuuguguccugccgccaggggagcggaaauaugaaggaauguguuacgaccggccgggcccugcuccccgcugucaacccugggcaagaggccugccugcacuucacagcccccggcucuccggacuccaagugucugaaaaucaaggugaaaagaaucaaucucaagugcaaaaagagcuccucuuauuuugugccugaugcucgcagccgguguaccuccgucagacgcugccggugggccggagacugucagucuggcugucccccucauuucacaagcaacuccuuuucugacgauugggcggggaagauggacagagcuggacugggcuucagcgggugcuccgauggaugcggcggggccgccugcggcuguuuuaaugcugcccccagcugcauuuucuggcggaaauggguggagaacccucacggaaucauuuggaagguuucucccugugcugccugggugccguccgcggucaucgaacuuaccaugccuagcggcgaggugcgcacguuccaccccaugucugggauucccacacagguuuuuaaaggaguguccgucaccuaccugggcagcgacauggaagugucugggcucaccgaucugugcgagaucgaagaacugaaguccaaaaagcuggcccucgcuccuuguaaucaggccggaaugggcguugugggcaaagucggggagauccaaugcagcuccgaagagagcgcuagaacaauuaagaaggacggauguaucuggaacgccgaucuggugggcauugaacugcggguggacgaugcggucugcuauucuaaaaucaccagcguugaggccguggcuaacuacuccgccauuccgacaacgaucgggggacucagauucgaacgcucucaugacagccagggcaagaucuccgggucuccccuggauauuaccgcuauccggggcagcuuuuccgugaauuacagaggacuucgccugucucucagcgagauuacagccaccuguacaggcgaggucaccaacguguccgggugcuauagcugcaugacgggagccaaaguuucuaucaagcugcacuccagcaaaaauucuaccgcucaugugagauguaagggcgacgaaacagcguucuccguccuggagggggugcacagcuacaccguuucccuuucuuuugaucacgccguggucgacgaacagugccagcucaacuguggaggccaugagagccaagugacacugaaggggaaucugauuuuccucgacguuccuaaauuuguggauggauccuauaugcagaccuaccacagcacgguccccacaggcgcuaacaucccuucucccaccgacuggcugaaugcccuuuucggcaacgggcugucccgguggauccucggagugauuggcgugcugcuugggggacuugcccucuuuuucaugaucaugagccuguuuaagcugggcacaaaacaggucuuccgcucuagaaccaagcucgcuuga

SEQ ID NO: 14925 - RNA, 3222 nt, Artificial Sequence
  derived and/or modified CDS sequence (opt5) from SFTSV/Phlebovirus(JS2010-015)__JQ317173.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuccuggagcuuaaguccuuuagccagucugaguuccccgacaucugcaaaauugauggaaucguguuuaaucagugugaaggcgaaagccugccucaacccuucgacgucgccuggauggauguggggcacucccauaagaucauuaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcguuagacccaaauguuacggguuuucccggaugauggccacccuggaagugaaccagccugagcaacgcaucggacagugcacgggcugucaccuugaaugcauuaaugggggcgucagacugaucacccucacaucugagcucaagagcgcgaccgugugugccucccauuucugcucuagcgcuacauccggaaagaaaagcaccgagauucaguuccacucuggcucccugguugggaagacggccauccacgugaaaggagcucuggucgauggcacagaauuuaccuucgaggggagcuguauguuucccgacggaugcaacgccguggauugcacauucugucgggaauuucugaagaauccccaaugcuauccugcgaaaaaguggcuuuucaucauuaucgucauucugcucggcuacgccgggcugaugcuucugaccaacgugcucaaggcuaucggcauuuggggaucuuggguuaucgccccggugaaacugauguuugcuaucauuaagaaacugaugcgcaccgucuccugucucaugggcaagcugauggacagagggagacaggugauccaugaggaaauuggagagaaucgggagggcaaccaggaugacguucgcaucgaaauggcccggcccagacgcgugcggcacuggauguauagcccugucauucuuacauuccuggccaucgggcucgcugagucuugcgaugaaauggugcaugcggacagcaaacugguguccuguagacagggaagcggcaauaugaaggagugcguuacgaccgggcgcgcccuucugcccgcugucaacccuggccaagaggccugucuccacuuuacagcccccggaucuccggauuccaagugccugaaaauuaaggugaaacggaucaaucugaaguguaaaaagagcuccucuuacuucgugccugacgcuagaagccgcugcaccuccguccggagaugucgcugggccggcgauugccagucugggugucccccucauuuuacaagcaacuccuucucugacgacugggcgggaaagauggaucgggcuggccucggguuuagcggaugcuccgacggcugcgggggcgccgccuguggaugcuucaaugcugcccccagcuguaucuucuggagaaaauggguggaaaacccucacggcauuaucuggaagguuucucccugcgcugccugggugccguccgcggucauugagcugaccaugccuagcggggaagugcggacguuucaccccaugucuggaauccccacacagguuuucaaaggcguguccgucaccuaucuugggagcgauauggaggugucuggacugaccgaccucugugaaauugaggagcugaaguccaaaaagcuggcccuugcuccuugcaaccaggccggcaugggcguuguggggaaagucggagaaauccaauguagcuccgaggaaagcgcucgcacaaucaagaaggauggcugcauuuggaaugccgaccucguggggaucgagcugagaguggaugacgcggucuguuacucuaaaauuaccagcguugaagccguggcuaacuauuccgccaucccgacaacgauuggaggccugcgguuugagagaucucaugauagccaggggaagaucuccggaucuccccucgacaucaccgcuauucgcggcagcuucuccgugaauuaccggggccugagacuuucucugagcgagaucacagcuaccugcacaggggaagucaccaacguguccggaugcuacagcuguaugacgggcgccaaaguuucuauuaagcuccacuccagcaaaaauucuaccgcccaugugcgcugcaagggggaugagacagcguuuuccguccuggaaggagugcacagcuauaccguuucccugucuuucgaccacgccguggucgaugagcagugucagcuuaacugcggcgggcaugaaagccaagugacacucaagggaaaucugaucuuucuggacguuccuaaauucguggacggcuccuacaugcagaccuaucacagcacgguccccacaggcgcuaacauuccuucucccaccgauuggcucaaugcccuguuugggaacggacuuuccagauggauccugggcgugaucggggugcuccugggaggccuggcccuuuucuuuaugauuaugagccucuucaagcuggggacaaaacaggucuuucggucucgcaccaagcuggcuuga

SEQ ID NO: 14926 - RNA, 3222 nt, Artificial Sequence
  derived and/or modified CDS sequence (opt5) from SFTSV/Phlebovirus(JS2010-019)__JQ317179.1__GP
augaugaaggugaucugguucagcucccugaccugcuuugucauucaguguucuggcgacagcgggcccaucauuugcgccggaccuauccacuccaacaaaucugcugauauuccgcaucuccugggcuacagcgagaagaucugucaaaucgacagacuuauucacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugaucguucccgggccuagcuauaagggaaagguguuuuucgagcgccccacauuugacggcuacgucggguggggauguggcucugggaaauccagaacggaaagcggagagcucugcuccucugauagcggcaccuccagcggccugcugccuucugaccgggugcucuggauuggggauguugccugucagccgaugacacccaucccugaagagaccuuccuggagcuuaaguccuuuagccagucugaguuccccgacauuugcaaaaucgauggaauuguguuuaaucagugugaaggcgaaagccugccucaacccuucgacgucgccuggauggauguggggcacucccauaagaucaucaugcgcgagcacaaaacaaagugggugcaggagucuagcuccaaggacuuugucugcuauaaagaaggaaccggcccguguagcgagucugaagagaagacaugcaaaaccuccgggagcugcagaggagacaugcaguucuguaagguugcuggcugcgaacacggcgaggaggccucugaagcuaaaugucggugcucccucgugcauaagccuggggagguggucgugagcuacggaggcaugcgcguuagacccaaauguuacggguuuucccggaugauggccacgcuggaagugaaccagccugagcaacgccuuggacagugcaccggcugucaccuggaaugcauuaaugggggcgucagacucaucacacugaccucugagcuuaagagcgcgacagugugugccucccauuucugcucuagcgcuaccuccggaaagaaaagcacggagauucaguuccacucuggcucccucguugggaagacagccauccacgugaaaggagcucuggucgauggcaccgaauuuacauucgaggggagcuguauguuucccgacggaugcgaugccguggacugcaccuucugucgggaauuucuuaagaacccccaaugcuauccugcgaaaaaguggcuguucauuaucaucgucauucuccugggcuacgccgggcuuaugcugcucaccaaugugcugaaggcuaucggcauuuggggaucuuggguuaucgccccggugaaacugauguuugcuauuaucaagaaacucaugcgcacagucuccugucugaugagaaagcugauggaucggggcagacaggugauccaugaggaaauuggggagaaccgcgagggaaaucaggacgauguucggaucgaaauggccagaccccgccgggugagacacuggauguauagcccugucauucugacgauccucgccauuggccuggcugagucuugcgacgaaauggugcaugcggauagcaaacuuguguccugucgccaggggagcggaaacaugaaggagugcguuaccacaggccgggcccugcucucugcugucaaucccgggcaagaggccugucugcacuucaccgccccuggcucccccgacagcaagugccugaaaaucaaggugaaaagaauuaaccucaaguguaaaaaguccucuagcuacuuugugccggaugcucgcucccggugcacaucugucagacgcugucggugggccggagacugccagagcggcugcccuccccauuucaccuccaauucuuuuagcgacgauugggcggggaagauggacagagcuggacugggcuucuccggguguagcgauggaugcggcggggccgccuguggcugcuuuaacgcugccccuucuuguaucuucuggcggaaauggguggaaaauccccacggaaucauuuggaagguuuccccuugcgcugccugggugcccagcgcggucaucgagcuuacgaugccgucuggcgaagugcgcacauuccacccuauguccgggauucccacccagguuuuuaaaggagugagcgucaccuaucugggcucugacauggagguguccgggcucacagaucugugugaaaucgaggagcuuaagagcaaaaagcuggcccucgcucccugcaaccaggccggaaugggcguugugggcaaagucggggaaauucaauguuccagcgaggaaucugcuagaaccaucaagaaggacggaugcaucuggaacgccgaucuggugggcauugagcugcggguggacgaugcggucuguuacagcaaaaucacauccguugaagccguggcuaauuauucugccauuccuacgaccaucgggggacucagauucgagcgcagccaugacucccagggcaagauuucugggagcccgcuggauaucacagcuauccggggauccuuuucugugaacuacagaggccuucgccugagccucuccgagauuaccgccacaugcaccggcgaagucacgaaugugagcgggugcuacucuuguaugaccggagccaaaguuuccaucaagcugcacagcucuaaaaacuccacagcucaugugagaugcaagggcgacgagaccgcguucagcguccuggaagggggacacuccuauacagugucucuuagcuuugaucacgccguuguggacgagcagugucagcucaauugcggcgggcaugaaucccaagucacccugaagggaaaccugauuuuccucgacgugcccaaauuuguugauggcagcuacaugcagacguaucacucuacagugccuaccggcgcuaauauccccuccccuacagacuggcugaacgcccuuuucgggaauggacugagccgguggauucucggcgucaucggggugcugcugggaggccuugcccucuuuuucaugaucaugucucuguuuaagcuggggaccaaacagguguuccgcagcagaaccaagcucgcuuga

SEQ ID NO: 14927 - RNA, 3222 nt, Artificial Sequence
  derived and/or modified CDS sequence (opt5) from SFTSV/Phlebovirus(JS24)__HQ830164.1__GP
augaugaaggugaucugguucagcucccugauuugccucgucauccaguguggcggggacaccggacccauuaucugcgccggcccuauucacucuaacaaaagcgcugauaucccgcaucugcuuggguacuccgagaagaucugucaaauugacagacugauccacguuucuagcuggcuccggaaucauucccaguuucagggauaugugggccagcgcgggggaagaucucaagugagcuacuaucccgccgaaaacuccuacagccgguggucuggccugcuuuccccuugcgaugcggacuggcugggcaugcucgucgugaaaaaggcuaaagggagcgauaugauuguucccggaccuucuuauaagggcaagguguucuuugagcgccccacauucgacggguacgucggauggggcuguggguccggaaaaagcagaacggaaucuggcgagcugugcuccagcgauuccggcaccucuagcgggcugcucccuuccgaccgggugcuguggaucggagauguugccugucagccgaugacacccauuccugaagagaccuuucuugagcuuaagagcuucucucaguccgaauuucccgacaucugcaaaauugauggcaucguguucaaucagugugggggagagagccucccucaacccuuugacgucgccuggauggaugugggccacucucauaagaucauuaugcgcgaacacaaaacaaagugggugcaggagagcuccucuaaggacuucgucugcuauaaagaggggaccggaccguguagcgaauccgaggaaaagacaugcaaaaccagcggcucuugcagaggcgacaugcaguuuuguaagguugcugggugcgagcacggagaagaggccuccgaggcuaaaugucggugcagccuggugcauaagccuggcgaaguggucgugucuuacgggggaaugcgcguuagacccaaauguuacggcuucucccggaugauggccacgcuugaggugaaccagccugaacaacgcaucgggcagugcaccggcugucaccuggagugcauuaauggaggcgucagacucaucacacugaccagcgaacugaaguccgcgacagugugugccucucauuuuugcagcuccgcuaccucugggaagaaaagcacggagauucaguuccacuccggaagccucguuggcaagacagccauccacgugaaaggggcucuggucgauggaaccgaguucacauuugaaggcucuuguauguuccccgacgggugcgaugccguggacugcaccuuuugucgggaguuccuuaagaacccccaaugcuauccugcgaaaaaguggcuguuuaucauuaucgucauucuccugggcuacgccggacuuaugcugcucaccaaugugcugaaggcuaucggcguuuggggguccugggugauugccccggucaaacugguguucgcuaucaucaagaaacucaugcgcgccguuagcugucugaugggaaagcugauggauagaggcagacaggugauucaugaagagaucggggaaaaccgggagggaaaucaggacgauguccgcauugagauggcccggcccagacgcgugcggcacuggauguauucuccugugauccugacaauucucgcuaucggccuggcggaagggugcgacgagaugguucaugccgauuccaaacuugucagcuguagacagggcucuggaaacaugaaggaaugcgugacgaccggccgcgcucugcuccccgccgugaauccugggcaagaggccugucugcacuuuacagcucccggaagcccggacuccaagugccugaaaauuaaggucaaaaagaucaaccucaaauguaagaagucuagcuccuacuucgugccugaugcccggagcagaugcaccuccguucgccgguguagaugggcgggcgacugccagucugggugucccccucauuuuacaagcaauuccuucucugacgauugggcuggaaaaauggaccgcgccggccugggguuuagcggcugcuccgauggaugcggcggggccgcuuguggaugcuucaacgccgcucccucuuguaucuuuuggcggaaguggguggagaauccucacggcauuaucuggaaagucagccccugcgccgcgugggugccguccgccguuauugaacuuaccaugccuagcggggaggugagaacguuccaccccaugucuggaauccccacacaggucuucaagggcguguccguuaccuaucugggcagcgacauggaagugucugggcucaccgaucugugugagauugaggaacugaaauccaagaaacuugcucucgccccuugcaaccaggcuggaaugggcgucguggggaaggugggagagauccaauguagcucugaagaguccgcccggacaaucaagaaagacggcugcauuuggaacgcggaucuggucgggaucgaacugcgcguugacgaugccguguguuacagcaagauuaccuccguggaggcugucgccaauuauagcgcuaucccgacaacgauuggaggccucagauuugaacggucucaugacagccagggcaaaaucuccgggucuccccuggauaucaccgccauuagaggcagcuucuccgugaacuaccgcggacuucggcugucucucagcgagaucacagcuaccugcacaggggagguuaccaauguguccggaugcuacucuuguaugacgggcgccaaggucagcauuaaacugcacuccagcaagaacucuaccgcgcaugugagaugcaagggggacgaaacagccuuuuccguucuggagggagugcacagcuauucugucucccuuagcuucgaucacgcugugguugacgaacagugucagcucaauugcggcggccaugagucccacgugacccugaaagggaaccugaucuuucucgacgucccuaaguucguggauggaucuuacaugcaaacauaucauagcaccgugcccacgggcgccaauauuccuucccccacagacuggcugaacgcccuuuuugggaauggacugagccgcuggauccucggcgucaucgggguucugcugggaggccuugcucucuucuuucugauuaugucucuguucaaacucggcaccaaacagguguuuagaucccggacaaagcuggccuga

SEQ ID NO: 14928 - RNA, 3222 nt, Artificial Sequence
  derived and/or modified CDS sequence (opt5) from SFTSV/Phlebovirus(JS4/China/2010 strain JS4)__HQ141605.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuccuggagcuuaaguccuuuagccagucugaguuccccgacaucugcaaaauugauggaaucguguuuaaucagugugaaggcgaaagccugccucaacccuucgacgucgccuggauggauguggggcacucccauaagaucauuaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcguuagacccaaauguuacggguuuucccggaugauggccacccuggaagugaacccucccgagcagcgcaucggacaaugcacgggcugucaccuugaaugcauuaaugggggcgucagacugaucacccucacaucugagcuuaagagcgcgaccgugugugccucccauuucugcucuagcgcuacauccggaaagaaaagcaccgagauucaguuccacucuggcucccugguugggaagacggccauccacgugaaaggagcucucgucgauggcacagaauuuaccuucgaggggagcuguauguuucccgacggaugcgaugccguggacugcacauucugucgggaauuucugaagaacccucagugcuauccggcgaaaaaguggcuuuucaucauuaucgucauucugcucggcuacgccgggcugaugcuucugaccaaugugcucaaggcuaucggcguuuggggaucuugggugauugcccccgucaaacugcuguuugcuaucaucaagaaacucaugcgcaccguguccugucugaugggcaagcugauggauagagggcggcaaguuauucaugaggaaaucggagagaacagagagggcaaucaggacgaugugcgcauugaaauggcccggccuagacgcguccggcacuggauguauagccccgugauccugacaauucucgccaucgggcuggcugagggaugcgacgaaauggugcaugcggauucuaaacuuguuagcuguagacagggcuccgagaacaugaaggagugcgucacgaccgggcgcgcccugcucccugcugugaaucccggccaggaagccugucugcacuucacagccccgggaagcccugacucuaagugccugaaaauuaaggugaaacggaucaaccucaaguguaaaaaguccagcuccuacuuuguccccgaugcuagaucucgcugcaccagcgugcggagaugucgcugggccggcgacugccaauccgggugcccuccccauuucacaucuaauagcuuuuccgacgauugggcgggaaagauggaccgggcuggccugggguucucuggauguagcgauggcugcgggggcgccgccuguggaugcuuuaacgcugccccuuccuguaucuucuggagaaaauggguugagaauccccacggcauuaucuggaaggugagcccgugcgcugccugggucccuucugcggugauugaacuuaccaugcccuccggggagguucggacguuccaccccaugagcggaaucccuacacagguguuuaaaggcgucucugugaccuaucugggguccgacauggaaguuagcggacucaccgaucugugugagauugaggaacugaagucuaaaaagcucgcccuugcuccgugcaaccaggccggcaugggcguggucgggaaagugggagagauccaguguuccagcgaagaguccgcucgcacaaucaagaaggacggcugcauuuggaacgccgaucugguggggaucgaacugagagucgacgaugcgguuuguuacagcaaaauuaccucuguggaggccguggcuaauuauagcgccauccccacaacgauuggaggccuccgguucgagagaucccaugacucucaagggaagaucagcggauccccucuggauaucaccgcuauucgcggcucuuuuagcgucaacuaccggggccuuagacugucccucucugaaaucacagcuaccugcacaggggaggugaccaauguuagcggaugcuacuccuguaugacgggcgccaaagugagcauuaagcugcacucuuccaaaaacagcaccgcccauguccgcugcaagggggacgaaacagcguucucugugcuggagggaguucacuccuauaccgugagccuuuccuuugaucacgccgucguggacgaacagugucagcucaauugcggcgggcaugagucucagguuacacugaagggaaaccugaucuuccucgacgugcccaaauuugucgauggcagcuacaugcaaaccuaucacuccacggugccuacaggcgcuaauauucccagcccuaccgacuggcugaacgcccuuuucgggaauggacugucuagauggauccucggcgugaucgggguccugcugggaggccuugcccucuuuuuccugauuaugucccuguuuaagcucgggacaaaacagguuuuccggagccgcaccaagcuggcuuga

SEQ ID NO: 14929 - RNA, 3222 nt, Artificial Sequence
  derived and/or modified CDS sequence (opt5) from SFTSV/Phlebovirus(JS6)__HQ830170.1__GP
augaugaaggugaucugguucagcucccugauuugccucgucauccaguguggcggggacaccggacccauuaucugcgccggcccuauucacucuaacaaaagcgcugauaucccgcaucugcuuggguacuccgagaagaucugucaaauugacagacugauccacguuucuagcuggcuccggaaucauucccaguuucagggauaugugggccagcgcgggggaagaucucaagugagcuacuaucccgccgaaaacuccuacagccgguggucuggccugcuuuccccuugcgaugcggacuggcugggcaugcucgucgugaaaaaggcuaaagggagcgauaugauuguucccggaccuucuuauaagggcaagguguucuuugagcgccccacauucgacggguacgucggauggggcuguggguccggaaaaagcagaacggaaucuggcgagcugugcuccagcgauuccggcaccucuagcgggcugcucccuuccgaccgggugcuguggaucggagauguugccugucagccgaugacacccauuccugaagagaccuuucuugagcuuaagagcuucucucaguccgaauuucccgacaucugcaaaauugauggcaucguguucaaucagugugagggggaaagccucccucaacccuuugacgucgccuggauggaugugggacacucucauaagaucauuaugcgcgagcacaaaacaaagugggugcaggagagcuccucuaaggacuucgucugcuauaaagaaggcaccgggccguguagcgaguccgaagagaagacaugcaaaaccagcggaucuugcagaggcgacaugcaguuuuguaagguugcuggcugcgaacacggggaggaggccuccgaagcuaaaugucggugcagccuggugcauaagccuggagagguggucgugucuuacggcgggaugcgcguuagacccaaauguuacggauucucccggaugauggccacgcuugaagugaacgagccugaacagcgcaucggccaaugcaccgggugucagcuggagugcauuaauggcggagucagacucaucacacugaccagcgagcugaaguccgcgacagugugugccucucacuuuugcagcuccgcuaccucuggcaagaaaagcacggaaauucaguuccauuccgggagccucguuggaaagacagccauccacgugaaaggcgcucuggucgaugggaccgaguucacauuugaaggaucuuguauguuccccgacggcugcgaugccguggacugcaccuuuugucgggaguuccuuaagaacccccaaugcuauccugcgaaaaaguggcuguuuaucauuaucgucauucuccugggguacgccggccuuaugcugcucaccaaugugcugaaggcuaucggaguuuggggcuccugggugauugccccggucaaacugguguucgcuaucaucaagaaacucaugcgcgccguuagcugucugauggggaagcugauggauagaggaagacaggugauucacgaagagaucggcgagaaccgggaagggaaucaggacgauguccgcauugagauggcccggcccagacgcgugcggcauuggauguauucuccugugauccugacaauucucgcuaugggacuggcggaaggcugcgacgagaugguucacgccgauuccaaacuugucagcuguagacaggggucuggcaacaugaaggagugcgugacgaccggacgcgcucugcuccccgccgugaauccuggccaagaagccugucugcauuuuacagcucccgggagcccggacuccaagugccugaaaaucaaggucaaacggauuaaccucaaguguaaaaagucuagcuccuacuucgugccugaugccagaagccgcugcaccuccguucggagaugucgcugggcgggagacugccagucuggcugucccccucacuuuacaagcaauuccuucucugacgauugggcugggaagauggaccgggccggacugggcuuuagcgggugcuccgauggcugcggaggcgccgcuugugggugcuucaacgccgcucccucuuguaucuuuuggagaaaauggguggagaauccucauggaaucauuuggaaggucagccccugcgccgcgugggugccguccgccguuaucgaacuuaccaugccuagcggcgaggugcggacguuccaccccaugucugggauucccacacaggucuucaaaggaguguccguuaccuaucugggcagcgacauggaagugucuggccucaccgaucugugugagaucgaggaacugaaguccaaaaagcuggcucucgccccuugcaaccaggcugggaugggagucgugggcaaagugggggagauucaauguagcucugaagaguccgcccgcacaaucaagaaggacggaugcaucuggaacgcggaucuggucggcauugaacugagaguugacgaugccguguguuacagcaaaaucaccuccguggaggcugucgccaauuauagcgcuauuccgacaacgaucgggggacuccgguuugagagaucucacgacagccagggcaagauuuccggcucuccccuggauaucaccgccauccgcgggagcuucuccauuaacuaccggggacuuagacugucucucagcgaaaucacagcuaccugcacaggcgaggugaccaauguuuccgggugcuacucuuguaugacgggagccaaagugagcauuaagcugcauuccagcaaaaacucuaccgcgcacguccgcugcaagggcgacgaaacagccuuuuccgugcuggaggggguucauagcuauucugugucccuuagcuucgaucacgcugucguggacgaacagugucagcucaauugcggaggccacgagucccaaguuacccugagaggcaaccugaucuuucucgacgugccuaaguucgucgaugggucuuacaugcagacauaucauagcaccgugcccacgggagccaauauuccuucccccacagacuggcugaacgcccuuuuuggcaaugggcugagccgguggauccucggagugaucggcguccugcuugggggacuugcucucuucuuucugauuaugucucuguucaaacucggcaccaagcagguuuuucgcuccagaacaaaacuggccuga

SEQ ID NO: 14930 - RNA, 3222 nt, Artificial Sequence
  derived and/or modified CDS sequence (opt5) from SFTSV/Phlebovirus(JSD1)__JF267784.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucucacucccgguggagcggacuccugucuccuugcgaugcggacuggcuuggcaugcuggucgugaaaaaggcuaaaggcuccgauaugauuguucccgggccuagcuacaagggaaagguguuuuucgagcgccccaccuuugacggcuaugucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuccuggagcuuaaguccuuuagccagucugaguuccccgacaucugcaaaauugauggaaucguguuuaaucagugugaaggcgaaagccugccucaacccuucgacgucgccuggauggauguggggcauucccacaagaucauuaugcgcgagcacaaaaccaagugggugcaggagucuagcuccaaggacuuugucugcuacaaagaaggaacaggcccguguagcgagucugaagagaagaccugcaaaacauccgggagcugcagaggagacaugcaguucuguaagguugcuggcugcgaacauggcgaggaggccucugaagcuaaaugucggugcucccucgugcacaagccuggggagguggucgugagcuauggaggcaugcgcguuagacccaaauguuacggguuuucccggaugauggccacccuggaagugaaccagccugagcaacgcaucggacagugcacgggcugucaucuugaaugcauuaaugggggcgucagacugaucacccucacaucugagcucaagagcgcgaccgugugugccucccacuucugcucuagcgcuacauccggaaagaaaagcaccgagauucaguuccacucuggcucccugguugggaagacggccauccaugugaaaggagcucuggucgauggcacagaauuuaccuucgaggggagcuguauguuucccgacggaugcaacgccguggauugcacauucugucgggaauuucugaagaauccccaaugcuacccugcgaaaaaguggcuuuucaucauuaucgucauucugcucggcuaugccgggcugaugcuucugaccaacgugcucaaggcuaucggcauuuggggaucuuggguuaucgccccggugaaacugauguuugcuaucauuaagaaacugaugcgcaccgucuccugucucaugggcaagcugauggacagagggagacaggugauccacgaggaaauuggagagaaucgggagggcaaccaggaugacguucgcaucgaaauggcccggcccagacgcgugcggcauuggauguacagcccugucauucuuacauuccuggccaucgggcucgcugagucuugcgaugaaauggugcacgcggacagcaaacugguguccuguagacagggaagcggcaauaugaaggagugcguuacgaccgggcgcgcccuucugcccgcugucaacccuggccaagaggccugucuccauuuuacagcccccggaucuccggauuccaagugccugaaaauuaaggugaaacggaucaaucugaaguguaaaaagagcuccucuuauuucgugccugacgcuagaagccgcugcaccuccguccggagaugucgcugggccggcgauugccagucugggugucccccucacuuuacaagcaacuccuucucugacgacugggcgggaaagauggaucgggcuggccucggguuuagcggaugcuccgacggcugcgggggcgccgccuguggaugcuucaaugcugcccccagcuguaucuucuggagaaaauggguggaaaacccucacggcauuaucuggaagguuucucccugcgcugccugggugccguccgcggucauugagcugaccaugccuagcggggaagugcggacguuucaucccaugucuggaauccccacacagguuuucaaaggcguguccgucaccuaccuugggagcgauauggaggugucuggacugaccgaccucugugaaauugaggagcugaaguccaaaaagcuggcccuugcuccuugcaaccaggccggcaugggcguuguggggaaagucggagaaauccaauguagcuccgaggaaagcgcucgcacaaucaagaaggauggcugcauuuggaaugccgaccucguggggaucgagcugagaguggaugacgcggucuguuauucuaaaauuaccagcguugaagccguggcuaacuacuccgccaucccgacaacgauuggaggccugcgguuugagagaucucacgauagccaggggaagaucuccggaucuccccucgacaucaccgcuauucgcggcagcuucuccgugaauuaucggggccugagacuuucucugagcgagaucacagcuaccugcacaggggaagucaccaacguguccggaugcuacagcuguaugacgggcgccaaaguuucuauuaagcuccauuccagcaaaaauucuaccgcccacgugcgcugcaagggggaugagacagcguuuuccguccuggaaggagugcacagcuacaccguuucccugucuuucgaccaugccguggucgaugagcagugucagcuuaacugcggcgggcacgaaagccaagugacacucaagggaaaucugaucuuucuggacguuccuaaauucguggacggcuccuauaugcagaccuaccauagcacgguccccacaggcgcuaacauuccuucucccaccgauuggcucaaugcccuguuugggaacggacuuuccagauggauccugggcgugaucggggugcuccugggaggccuggcccuuuucuuuaugauuaugagccucuucaagcuggggacaaaacaggucuuucggucucgcaccaagcuggcuuga

SEQ ID NO: 14931 - RNA, 3222 nt, Artificial Sequence
  derived and/or modified CDS sequence (opt5) from SFTSV/Phlebovirus(LN2/China/2010 strain LN2)__HQ141608.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuccuggagcuuaaguccuuuagccagucugaauuucccgacaucugccgcauugauggaaucguguuuaaucagugugagggcgaaagccugccucaacccuucgacgucgccuggauggauguggggcacucccauaaaaucauuaugagagagcacaagaccaaaugggugcaggagucuagcuccaaggacuuugucugcuauaaggaaggaacaggcccguguagcgagucugaagagaaaaccugcaagacauccgggagcugccggggagacaugcaguucuguaaaguugcuggcugcgaacacggcgaggaggccucugaagcuaagugucgcugcucccucgugcauaaaccuggggagguggucgugagcuacggaggcaugagaguucggcccaaguguuacggguuuucccgcaugauggccacccuggaagugaaccagccuguccaaagaaucggacagugcacgggcugucaccuugagugcauuaaugggggcgugcggcugaucacccucacaucugaacugaaaagcgcgaccguuugugccucccauuucugcucuagcgcuacauccggaaagaaguccaccgagauucaguuccacucuggcucccugguggggaaaacggccauccacgucaagggagcucucguggauggcacagaguuuaccuucgaagggagcuguauguuucccgacggaugcgaugccgucgacugcacauucugucgcgaguuucugaaaaacccccaaugcuauccugcgaagaaauggcuuuucaucauuaucgugauucugcucggcuacgccgggcugaugcuucugaccaauguucucaaggcuaucggcauuuggggaucuugggugaucgccccggucaagcugaucuuugcuauuaucaaaaagcugaugagaaccguguccugucucaugggcaaacugauggaucgggggagacagguuauucaugaagagaucggagaaaaccgcgagggcaaucaggacgaugugcggauugagauggccagaccccgccgggucagacacuggauguaugccccugugauccuuacaauucuggcuauggggcucgcggaaagcugcgacgagauggugcaugccgauucuaagcugguuagcugucgccagggauccggcaacaugaaagaaugcgucacgaccgggcgggcccuucugcccgccgugaauccuggccaagaggccugucuccacuucacagcucccggaagcccggacucuaagugccugaagaucaaagugaagagaaucaaccugaaauguaagaaauccagcuccuacuuugucccugaugcccgcucucggugcaccagcgugagacgcugucggugggcgggcgacugccaguccgggugucccccucauuucacaucuaauagcuuuuccgacgauugggcuggaaagauggacagagccggccucggguucucuggaugcagcgauggcugcgggggcgccgcuuguggaugcuuuaacgccgcucccuccuguauuuucuggcggaaguggguugagaauccucacggcaucauuuggaaagugagccccugcgccgcgugggucccgucugccgugaucgaacugaccaugccuuccggggagguucgcacguuccaccccaugagcggcauucccacacagguguuuaagggagucucugugaccuaucuuggguccgacauggaaguuagcggacugaccgaucucugugagaucgaggaacugaaaucuaagaaacuggcucuugccccuugcaaccaggcuggcaugggcguggucgggaaggugggagagauccaauguuccagcgaagaguccgccagaacaauuaaaaaggacggcugcaucuggaacgcggaucucguggggauugaacugcgggucgacgaugccguuuguuacagcaagaucaccucuguggaggcuguggccaauuauagcgcuauuccgacaacgaucggaggccugagauucgaacgcucccaugacucucaggggaaaaucagcggaagcccccucgauauuaccgccauccggggcucuuuuagcgucaacuacagaggccugcgccuuucccugucugagauuacagcuaccugcacaggggaggugaccaauguuagcggaugcuacuccuguaugacgggcgcuaaggugagcaucaaacuccacucuuccaagaacagcaccgcgcaugucagaugcaaaggggacgaaacagccuucucugugcuggagggaguucacuccuauaccgugagccuguccuuugaucacgcugucguggacgaacagugucagcuuaauugcggcgggcaugagucucaaguuacacucaagggaaaccugauuuuccuggacgugccuaaguuugucgauggcagcuacaugcagaccuaucacuccacggugcccacaggcgccaauaucccuagccccaccgacuggcucaacgcccuguucgggaauggacuuucucgguggauccugggcgugauugggguccuccugggaggccuggcucuuuucuucaugaucaugucccucuuuaaacuggggacaaagcagguuuuccgcagcagaaccaaacuggccuga

SEQ ID NO: 14932 - RNA, 3222 nt, Artificial Sequence
  derived and/or modified CDS sequence (opt5) from SFTSV/Phlebovirus(LN3/China/2010 strain LN3)__HQ141611.1__GP
augaugaaggugaucugguucagcucccugauuugccucgucauccaguguggcggggacaccggacccauuaucugcgccggcccuauucacucuaacaaaagcgcugauaucccgcaucugcuuggguacuccgagaagaucugucaaauugacagacugauccacguuucuagcuggcuccggaaucauucccaguuucagggauaugugggccagcgcgggggaagaucucaagugagcuacuaucccgccgaaaacuccuacagccgguggucuggccugcuuuccccuugcgaugcggacuggcugggcaugcucgucgugaaaaaggcuaaagggagcgauaugauuguucccggaccuucuuauaagggcaagguguucuuugagcgccccacauucgacggguacgucggauggggcuguggguccggaaaaagcagaacggaaucuggcgagcugugcuccagcgauuccggcaccucuagcgggcugcucccuuccgaccgggugcuguggaucggagauguugccugucagccgaugacacccauuccugaagagaccuuucuugagcugaagucuuucucucaguccgaauuucccgacaucugcaaaauugauggcaucguguucaaucagugugagggggaaagccucccucaacccuuugacgucgccuggauggaugugggacacucucauaagaucauuaugcgcgagcacaaaacaaagugggugcaggagagcuccucuaaggacuucgucugcuauaaagaaggcaccgggccguguagcgaguccgaagagaagacaugcaaaaccagcggaucuugcagaggcgacaugcaguuuuguaagguugcuggcugcgaacacggggaggaggccuccgaagcuaaaugucggugcagccuggugcauaagccuggagagguggucgugucuuacggcgggaugcgcguuagacccaaauguuacggauucucccggaugauggccacgcuugaagugaaccagccugagcaacgcaucggccagugcaccgggugucaccuggaaugcauuaauggcggagucagacucaucacacugaccagcgagcugaaguccgcgacagugugugccucucauuuuugcagcuccgcuaccucuggcaagaaaagcacggagauucaguuccacuccgggagccucguuggaaagacagccauccacgugaaaggcgcucuggucgaugggaccgaguucacauuugaaggaucuuguauguuccccgacggcugcgaugccguggacugcaccuuuugucgggaguuccuuaagaacccccaaugcuauccugcgaaaaaguggcuguuuaucauuaucgucauucuccugggguacgccggccuuaugcugcucaccaaugugcugaaggcuaucggaguuuggggcuccugggugauugccccggucaaacugguguucgcuaucaucaagaaacucaugcgcgccguuagcugucugauggggaagcugauggauagaggaagacaggugauucaugaagaaaucggcgagaaccgggaggggaaucaggacgauguccgcauugaaauggcccggcccagacgcgugcggcacuggauguauucuccugugauccugacaauucucgcuaucggacuggcggagggcugcgacgaaaugguucaugccgauuccagacuugucagcugucgccaggggucuggcaacaugaaagagugcgugacgaccggacgggcucugcuccccgccgugaauccuggccaagaggccugucugcacuuuacagcucccgggagcccggacuccaagugccugaagauuaaagucaagagaaucaaccucaaauguaagaaaagcagcuccuacuucgugccugaugcccgcagccggugcaccuccguuagacgcugucggugggcgggagacugccagucuggcugucccccucauuuuacaagcaauuccuucucugacgauugggcugggaagauggacagagccggacugggcuuuagcgggugcuccgauggcugcggaggcgccgcuugugggugcuucaacgccgcucccucuuguaucuuuuggcggaaguggguggaaaauccucacggaauuaucuggaaagucagccccugcgccgcgugggugccguccgccguuauugagcuuaccaugccuagcggcgaagugcgcacguuccaccccaugucugggauccccacacaggucuucaagggaguguccguuaccuaucugggcagcgacauggaggugucuggccucaccgaucugugugaaauugaggagcugaaauccaagaaacuugcucucgccccuugcaaccaggcugggaugggagucgugggcaaggugggggaaauccaauguagcucugaggaauccgccagaacaaucaaaaaggacggaugcauuuggaacgcggaucuggucggcaucgagcugcggguugacgaugccguguguuacagcaagauuaccuccguggaagcugucgccaauuauagcgcuaucccgacaacgauugggggacucagauuugagcgcucucaugacagccagggcaaaaucuccggcucuccccuggauaucaccgccauucgggggagcuucuccgugaacuacagaggacuucgccugucucucagcgagaucacagcuaccugcacaggcgaaguuaccaauguguccgggugcuacucuuguaugacgggagccaaggucagcauuaaacugcacuccagcaagaacucuaccgcgcaugugagaugcaaaggcgacgagacagccuuuuccguucuggaaggggugcacagcuauucugucucccuuagcuucgaucacgcugugguugacgagcagugucagcucaauugcggaggccaugaaucccacgugacccugcggggcaaccugaucuuucucgacgucccuaaguucguggaugggucuuacaugcaaacauaucauagcaccgugcccacgggagccaauauuccuucccccacagacuggcugaacgcccuuuuuggcaaugggcugagccgcuggauccucggagucaucggcguucugcuugggggacuugcucucuucuuucugauuaugucucuguucaagcucggcaccaaacagguguuuagaucccggacaaagcuggccuga

SEQ ID NO: 14933 - RNA, 3222 nt, Artificial Sequence
  derived and/or modified CDS sequence (opt5) from SFTSV/Phlebovirus(SD24/China/2010 strain SD24)__HM802201.1__GP
augaugaaggugaucugguucagcucccugauuugccucgucauccaguguucuggcgacagcgggcccauuaucugcgccggaccuauucacuccaacaaaucugcuggcaucccgcaucugcuuggguacagcgagaagaucugucaaauugauagacugauccacguuuccucuuggcuccggaaucauagccaguuucagggauaugugggccagcgcgggggaagaucccaagugagcuacuaucccgccgaaaacucuuacucccgguggagcggccugcuuucuccuugcgacgcggauuggcugggcaugcucgucgugaaaaaggcuaaagaguccgacaugauuguucccgggccuagcuauaagggaaagguguucuuugaacgccccaccuucgauggcuacgucggguggggauguggcucugggaaauccagaacagagagcggagaacugugcuccucugacagcggcacguccagcggccugcucccuucugaucgggugcuguggaucggggacguugccugucagccgaugacccccauuccugaggagacauuucuugaacugaaguccuucagccagucugaguuucccgauaucugcaaaauugacggaaucguguucaaucagugugaaggcgagagccucccucaacccuuugauaucgccuggauggacgucgggcacucccauaagauuaucaugcgcgagcacaaaaccaagugggugcaggaaucuagcuccaaggauuucgugugcuauaaagagggaacaggcccguguagcgaaucugaggaaaaggcuugcaaaaccuccgggagcugcagaggagacaugcaguuuuguaaggucgccggcugcgagcacggcgaggaagcuagcgaggccaaaugucggugcucccugguucauaagccuggggaagugguggucagcuacggaggcaugcgcgugagacccaaauguuacggguucucccggaugauggcgacacuugagguuaacccucccgaacagcgcauuggacaaugcaccggcugucaccuggagugcaucaaugggggcgugagacucauuacgcugaccucugagcugcggagcgccacagucugugcuucccauuuuugcucuagcgccaccuccggaaagaagucuacagaaauccacuuccacucuggcucccucguggggaaaaccgcuauccauguuaagggagcccugguggacggcacggaguucacauuugaagggagcuguauguuccccgauggaugcgacgcggucgauugcaccuuuugucgcgaguuccuuaaaaacccucagugcuauccggccaagaaauggcuguuuauuaucauugugauccuccugggcuacgcugggcuuaugcugcucacaaauguccugaaggccauuggcguguggggaucuuggguuaucgcucccgugaagcugauguucgccaucauuaaaaagcucaugagaaccgucuccugucuggugggcaaacuuauggaccgggggagacagguuauccacgaagagauuggagagaacggcgaagggaaucaagaugacgugcgcaucgagauggcccggccuagacgcguccggcauuggauguauagccccgugauucugaccauccucgcuauuggacuggcggaaggcugcgaugagauggugcacgccgacucuaagcugguuagcuguagacagggguccggcaacaugaaagagugcaucacaacgggacgcgcucugcucccugccgucaaucccggccaggaagccugucugcauuuuaccgcuccggggagcccugauucuaagugccugaagaucaaagugaagcggauuaaccucaaauguaagaaauccagcuccuacuucgugcccgacgccagaucucgcugcacaagcguccggagaugucgcugggcgggagauugccaguccggcugcccuccccacuuuaccucuaauagcuucuccgacgacugggcugggaagauggaucgggccggacugggcuuuucuggguguagcgacggcugcggaggcgccgcuugugggugcuucaacgccgcuccuuccuguaucuuuuggagaaaguggguggagaauccccacggaauuaucuggaaaguuagcccgugcgccgcgugggugccuucugccgucauugaacuuacaaugcccuccggcgaggugcggaccuuccaucccaugagcgggaucccuacgcaaguuuucaagggagugucugucacauaucugggcuccgauauggaagugagcggccucaccgaccugugugagaucgaggaacugaaaucuaagaaacuugcucucgccccgugcaaccaggcugggaugggaguugugggcaaggucggggagauucaguguuccagcgaagaguccgcccgcaccaucaaaaaggauggaugcauuuggaacgcggaccuggugggcaucgaacugagaguggaugacgccgucuguuacagcaagauuacaucuguugaggcuguggccaauuauagcgcuauccccaccacaaucgggggacuccgguuugagagaucccacgauucucagggcaaaauuagcggcuccccucuggacaucacggccauucgcgggucuuucagcgugaacuaccggggacuuagacugucccucucugaaaucaccgccacaugcaccggcgaggucacaaaugugagcgggugcuacuccuguaugaccggagcuaagguuagcauuaaacugcauucuuccaagaacagcacggcgcacgugcgcugcaaaggcgaugaaaccgccuuuucuguccuggagggggugcacuccuauaucguuagccuuuccuucgaccaugcuguggucgaugaacaaugucagcucaauugcggaggccacgagucucaggugacacugaagggcaaccugaucuuucucgacguucccaaguucguggacgggagcuacaugcagaccuaucauuccacagucccuaccggagccaauauucccagcccuacggauuggcugaacgcccuuuuuggcaaugggcugucuagauggauccucggagugauuggcgugcugcuugggggacuugcucucuucuuucugaucauguuccugcucaaacugggcacaaagcaagucuuucggucccgcaccaaacuugccuga

SEQ ID NO: 14934 - RNA, 3222 nt, Artificial Sequence
  derived and/or modified CDS sequence (opt5) from SFTSV/Phlebovirus(SD4/China/2010 strain SD4)__HM802203.1__GP
augaugaaggugaucugguucagcucccugauuugcuuugucauccaguguucuggcgacagcgggcccauuaucugcgccggaccuauucacuccaacaaaucugcugauaucccgcaucuccugggcuacagcgagaagaucugucaaauugacagacuuauccacguuuccucuuggcugcggaaucauagccaguuccagggguaugugggacagcgcggcgggagaucccaagugagcuacuaucccgccgaaaacucuuacucccgguggagcggacuccugucuccuugcgaugcggacuggcuuggcaugcuggucgugaaaaaggcuaaaggcuccgauaugauuguucccgggccuagcuauaagggaaagguguuuuucgagcgccccaccuuugacggcuacgucggguggggauguggcucugggaaauccagaacagaaagcggagagcucugcuccucugauagcggcacguccagcggccugcugccuucugaccgggugcucuggaucggggauguugccugucagccgaugacccccauuccugaagagacauuccuggagcuuaaguccuuuagccagucugaguuccccgacaucugcaaaauugauggaaucguguuuaaucagugugaaggcgaaagccugccucaacccuucgacgucgccuggauggauguggggcacucccauaagaucauuaugcgcgagcacaaaaccaagugggugcaggagucuagcuccaaggacuuugucugcuauaaagaaggaacaggcccguguagcgagucugaagagaagaccugcaaaacauccgggagcugcagaggagacaugcaguucuguaagguugcuggcugcgaacacggcgaggaggccucugaagcuaaaugucggugcucccucgugcauaagccuggggagguggucgugagcuacggaggcaugcgcguuagacccaaauguuacggguuuucccggaugauggccacccuggaagugaacccucccgagcagcgcaucggacaaugcacgggcugucaccuugaaugcauuaaugggggcgucagacugaucacccucacaucugagcuuaagagcgcgaccgugugugccucccauuucugcucuagcgcuacauccggaaagaaaagcaccgagauucaguuccacucuggcucccugguugggaagacggccauccacgugaaaggagcucucgucgauggcacagaauuuaccuucgaggggagcuguauguuucccgacggaugcgaugccguggacugcacauucugucgggaauuucugaagaacccucagugcuauccggcgaaaaaguggcuuuucaucauuaucgucauucugcucggcuacgccgggcugaugcuucugaccaaugugcucaaggcuaucggcguuuggggaucuugggugauugcccccgucaaacugcuguuugcuaucaucaagaaacucaugcgcaccguguccugucugaugggcaagcugauggauagagggcggcaaguuauucaugaggaaaucggagagaacagagagggcaaucaggacgaugugcgcauugaaauggcccggccuagacgcguccggcacuggauguauagccccgugauccugacaauucucgccacggggcuggcugagggaugcgacgaaauggugcaugcggauucuaaacuuguuagcuguagacagggcuccgggaacaugaaggagugcgucaccacaggccgcgcccugcucccugcugugaaucccggacaggaggccugucugcacuucaccgccccgggcagcccugacucuaagugccugaaaaucaaggugaaacggauuaaccucaaguguaaaaaguccagcuccuacuuuguccccgaugcuagaucucgcugcacaagcgugcggagaugucgcugggccggggacugccaauccggaugcccuccccauuucaccucuaauagcuuuuccgacgauugggcgggcaagauggaccgggcugggcugggauucucuggcuguagcgaugggugcggcggagccgccuguggcugcuuuaacgcugccccuuccuguaucuucuggagaaaauggguugaaaauccccacgggaucauuuggaaggugagcccgugcgcuacgugggucccuucugccgugaucgagcuuacaaugcccuccggagaaguucggaccuuccaccccaugagcggcauuccuacccagguguuuaaaggggucucugugacauaucugggauccgacauggagguuagcggccucaccgaucugugugaaaucgaggagcugaagucuaaaaagcucgcgcuugccccgugcaaccaggcuggcaugggggugauuggaaaagucggcgaaauccaguguuccagcgaggaauccgcccgcacaaucaagaaggacgggugcauuuggaacgcugaucuggugggaaucgagcugagaguggacgaugccgucuguuacagcaaaauuacgucuguugaagcgguggccaauuauagcgcuauccccaccacaauuggcgggcuccgguucgagagaucccaugacucucaaggaaagaucagcggcuccccucuggauaucaccgccauucgcggcucuuuuagcgugaacuaccgggggcuuagacugucccucucugagaucacagcuaccugcacgggagaagucaccaaugugagcggcugcuacuccuguaugacaggggccaaaguuagcauuaagcugcacucuuccaaaaacagcaccgcccaugugcgcugcaagggagacgagacagcuuucucuguccuggaaggcgugcacuccuauaccguuagccuuuccuuugaucacgcgguggucgacgagcagugucagcucaauugcgggggacaugaaucucaggugacgcugaagggcaaccugaucuuccucgacguucccaaauuuguggauggcagcuacaugcaaacauaucacuccaccgucccuacaggggccaauauucccagcccuaccgacuggcugaacgcucuuuucggaaauggccugucuagauggauccucggggugaucggagugcugcugggcgggcuugcccucuuuuuccugauuaugucccuguuuaagcucggaaccaaacaggucuuccggagccgcacaaagcuggccuga

SEQ ID NO: 14935 - RNA, 3222 nt, Artificial Sequence
  derived and/or modified CDS sequence (opt5) from SFTSV/Phlebovirus(SDYY104/China/2011)__KU239112.1__GP
augaugaaggugaucugguucagcucccugauuugccucgucauccaguguucuggcgacagcgggcccauuaucugcgccggaccuauucacuccaacaagucugcuggcaucccgcaucugcuuggguacagcgagaagaucugucaaauugauagacugauccacguuuccucuuggcuccggaaucauagccaguuucagggauaugugggccagcgcgggggaagaucccaagugagcuacuaucccgccgaaaacucuuacucccgguggagcggccugcuuucuccuugcgacgcggauuggcugggcaugcucgucgugaaaaaggcuaaagaguccgacaugauuguucccgggccuagcuauaagggaaagguguucuuugaacgccccaccuucgauggcuacgucggguggggauguggcucugggaaauccagaacagagagcggagaacugugcuccucugacagcggcacguccagcggccugcucccuucugaucgggugcuguggaucggggacguugccugucagccgaugacccccauuccugaggagacauuucuugaacuuaauuccuucagccagucugaguuucccgauaucugcaagauugacggaaucguguucaaccagugugaaggcgagagccucccucaacccuuugaugucgccuggauggacguggggcacucccauaaaaucauuaugcgcgagcacaagaccaaaugggugcaggaaucuagcuccaaggauuucgucugcuauaaggagggaacaggcccguguagcgaaucugaggaaaaggcuugcaagaccuccgggagcugcagaggagacaugcaguuuuguaaaguugccggcugcgagcacggcgaggaggcuucugaagccaagugucggugcucccuggugcauaaaccuggggaaguggucgugagcuacggaggcaugcgcguuagacccaaguguuacggguucucccggaugauggcgacacuugaggugaauccucccgaacagcgcaucggacaaugcaccggcugucaccuggagugcauuaacgggggcgucagacucaucacgcugaccucugagcugcggagcgccacagugugugcuucccauuuuugcucuagcgccaccuccgggaaaaagagcacagaaauucacuuccacucuggcucccucguugggaagaccgcuauccaugugaaaggagcccuggucgacggcacggaguucacauuugaagggagcuguauguuccccgauggaugcgacgcgguggauugcaccuuuugucgcgaguuccuuaagaauccucagugcuauccggccaaaaaguggcuguuuaucauuaucgucauucuccugggcuacgcugggcuuaugcugcucacaaacgugcugaaagccaucggcguuuggggaucuugggugauugcucccgucaagcugauguucgccaucaucaagaaacucaugagaaccguguccugucugguuggcaaacuuauggaccgggggagacaggugauucacgaagagaucggagagaauggcgaagggaaccaagaugacguccgcauugagauggcccggccuagacgcgugcggcauuggauguauagccccgugauccugaccauucucgcuaucggacuggcggaaggcugcgaugagaugguucacgccgacucuaaacuugucagcuguagacagggguccggcaauaugaaggagugcauuacaacgggacgcgcucugcucccugccgugaaccccggccaggaagccugucugcauuuuaccgcuccggggagcccugauucuaaaugccugaagaucaaggugaaacggaucaaucucaaguguaaaaaguccagcuccuacuucguccccgacgccagaucucgcugcacaagcgugcggagaugucgcugggcgggagauugccaguccggcugcccuccccacuuuaccucuaacagcuucuccgacgacugggcugggaaaauggaucgggccggacugggcuuuucuggguguagcgacggcugcggaggcgccgcuugugggugcuucaaugccgcuccuuccuguaucuuuuggagaaaguggguugagaacccccacggaauuauuuggaaggugagcccgugcgccgcgugggucccuucugccgugaucgaacuuacaaugcccuccggcgagguucggaccuuccaucccaugagcgggauuccuacgcaaguguucaaaggagucucugugacauaucugggcuccgauauggaaguuagcggccucaccgaccugugugagaucgaggaacugaagucuaaaaagcuggcucucgccccgugcaaccaggcugggaugggaguggucggcaaagugggggagauccaguguuccagcgaagaguccgcccgcaccauuaagaaagauggaugcaucuggaaugcggaccuggugggcauugaacugagagucgaugacgccguuuguuacagcaagaucacaucuguggaggcuguggccaacuauagcgcuauucccaccacaaucgggggacuccgguuugagagaucccacgauucucagggcaagaucagcggcuccccucuggacauuacggccauccgcgggucuuucagcgucaauuaccggggacuuagacugucccucucugaaauuaccgccacaugcaccggcgaggugacaaacguuagcgggugcuacuccuguaugaccggagcuaaagugagcaucaagcugcauucuuccaaaaauagcacggcgcacguccgcugcaagggcgaugaaaccgccuuuucugugcuggaggggguucacuccuauauugugagccuuuccuucgaccaugcugucguggaugaacaaugucagcucaacugcggaggccacgagucucagguuacacugaaaggcaaucugaucuuucucgacgugcccaaguucgucgacgggagcuacaugcagaccuaucauuccacagugccuaccggagccaacauccccagcccuacggauuggcugaaugcccuuuuuggcaacgggcugucuagauggauucucggagugaucggcguccugcugggaggacuugcucucuucuuucugauuguuuuccugcucaagcugggcacaaaacaagccuuucggucccgcaccaaacuugcguga

SEQ ID NO: 14936 - RNA, 3417 nt, Artificial Sequence
  derived and/or modified CDS sequence (opt11) from ANDV(Chile-9717869)__AF291703.2__GP
auggaggggugguacuuagucguauugggagucugcuacacacugacacuugccaugccaaaaacaauuuacgaacucaagauggaauguccccacaccgucggccuaggccaaggcuacauuaucgguucuacugaacugggacuaauuuccauagaagcggcaucugacaucaaacucgagagcagcugcaacuucgaccuucacacaacuuccauggcccagaaaucuuucacgcaggucgaauggcgcaagaaaucagacacaacggacaccacaaacgcggccucaaccaccuuugaagcccaaaccaaaaccguaaaccuacgaggaaccuguauccucgcacccgagcuuuacgacacccucaagaaagucaaaaagaccguacucugcuacgaccuaaccugcaaucagacacacugccaaccaaccguauaucuaaucgcucccguauuaacaugcauguccauccgaagcugcauggcaucagucuucaccagcagaauacaaguaaucuaugaaaagacccacugugucacaggccaauuaaucgaaggccagugcuucaauccagcccacacccucacccuaucacaacccgcccacaccuacgauacagucacacuucccauauccugcuucuucacacccaagaaauccgagcaacucaaagugaucaaaaccuuugagggcauucugaccaaaaccggcuguaccgagaacgcgcuccaaggcuauuacguguguuuucuaggcagucacuccgaaccacugaucguaccaucccucgaagacauccggucggccgaaguagucucccgcaugcucguucacccacgaggcgaagaccacgacgcuauccaaaacucacaaucccaucugcgcaucgucggaccaauaaccgcgaaggucccgucaacgucguccaccgacacacucaaaggcaccgccuuugccggcguacccauguacuccucccuauccacgcucguccgaaaugccgaccccgaguucguauucucaccaggcauaguaccggaaagcaaccacuccacgugcgacaagaaaacgguccccaucacuuggaccggcuaccugccaaucucaggggaaauggaaaaagucaccgguugcacuguuuucugcacucuagcaggcccaggcgcaagcugcgaagccuacucagaaaacggcauauucaacauuagcagcccaacaugucucguaaacaaaguacaacgcuuucgaggcuccgaacagaaaauaaacuucauaugccaaagggucgaccaagacgucguagucuacugcaacggccaaaagaaaguaauccucaccaaaacacucgucaucggacagugcaucuacacauuuaccucacuauucagccucaugccagaugucgcgcacucccuugcaguggagcucugcguaccagggcuacacggcugggccaccguaaugcuucuauccacauuuugcuucggguggguccuaauucccgccgucacccugaucauacuaaaaugccuccgaguccucacuuucucgugcucacacuacacaaacgaauccaaauucaaauucauacucgaaaaaguaaaaauagaauaccagaaaacgaugggaucaaugguaugcgacguaugucaccacgagugugagaccgccaaagaacuugaaucgcaccgccaauccugcaucaacggacaaugcccauacugcaugaccauaacagaagcaaccgaaagcgcccuccaagcccacuacucaaucugcaaacugaccggaagguuccaggaagcccuuaagaaaucccuaaagaaacccgagguaaagaaaggcugcuaccgcacgcucggagucuuccgauacaaaucucgcuguuacguaggccuagucuggugccuacuccuaaccugcgaaauagucaucugggcggccucggccgaaaccccgcucauggaauccggcugguccgacaccgcccacggagucggagaaauaccaaugaaaacagaccucgaacucgacuucucucuacccuccuccucaagcuacagcuaccgccgcaaacuuaccaaccccgccaauaaagaagaaaguaucccauuucacuuccaaauggagaaacaaguaauucacgccgaaauccagccucucggccacuggauggacgcaaccuucaacaucaaaacagcguuccacugcuacggcgccugccaaaaauacagcuaccccuggcagaccuccaaauguuucuucgagaaagacuaccaauacgaaacaggguggggcuguaaccccggcgacugcccaggagucgguacaggcuguacugccuguggcgucuaccucgacaaacuaaaaucuguaggcaaagcauacaaaaucaucagccugaaauacacacgcaaaguauguauccaacuaggaacagaacaaacgugcaaacacauugaugccaacgacugccuugugacacccuccgucaaaguaugcaucguuggaaccguauccaaacuccaacccuccgacacccuccuauuucuugguccccuagaacaagggggcaucauccuuaaacaauggugcaccaccuccugcgcauucggagacccaggcgacauaaugucaaccccaagcggaaugcgauguccagagcacacaggcuccuuucgcaaaauaugcggcuucgcaaccacaccggucugcgaauaccaaggcaacacaaucuccggcuacaaaagaaugauggccacgaaagacuccuuccaaucguucaaccucaccgaaccccauaucacaaccaacaaacucgaguggauugaccccgacggcaacacccgcgaccacgucaaccucguccucaaccgugacguaucguuccaagaccucagcgacaaccccugcaaagucgaccuacacacacaggcgaucgaaggcgcuugggguagcggcgucggcuucacacuaaccugcaccguuggacucaccgaaugcccuuccuucaugacuuccaucaaggcaugcgaccucgccaugugcuacggcuccaccgucacaaaccuggccagaggauccaacaccguaaaaguuguaggaaaaggcggccacucaggaagcagcuuuaaaugcugccacgacaccgauugcuccucugaaggccuacuugccuccgcgccacaccuagaacgcguaaccggguucaaccagauagacagcgacaagguguacgacgacggcgcgccuccaugcacuuucaaaugcugguucacaaaaucaggagaauggcucuuaggcauacucaacggcaauuggauaguagucgucguccuaguaguaauacugaucuuaucuaucaucauguucucaguucuuugccccagacgggggcacaagaagacagucuaa

SEQ ID NO: 14937 - RNA, 3417 nt, Artificial Sequence
  derived and/or modified CDS sequence (opt11) from ANDV(AH-1)__AF324901.2__GP
auggaaggaugguaucucgucgcccuaggcguuugcuacacccugacccucgcaaugccuaaaaccauauaugaacuuaaaauggaaugcccacacacagucggacuaggccaagguuacauaaucggcucaaccgaacucggauuaaucucaauagaggcagcaucagauaucaaacuugagagcuccugcaacuucgaccuccacacgaccuccauggcccagaaaucuuucacccaagucgaauggcgcaagaaauccgacaccaccgacacuaccaacgcagcauccaccacuuuugaagcucaaacaaaaacgguaaaccuccgcggcacgugcauucucgcccccgaacuuuaugacacucuuaagaaagugaagaaaacagucuuaugcuacgaccugacaugcaaucaaacucacugccaaccaaccgucuaccuuaucgcucccguccuuacaugcaugucuauucggucgugcauggccucagucuuuaccucucgaauacaaguaauauacgagaaaacccacugcguaacgggacaacuuauagaaggccagugcuucaauccagcccacacgcucacacucucacaacccgcccacaccuacgacaccguaacccucccaauauccugcuuuuucaccccaaagaaaucagaacaacuaaaagucauaaaaacguucgaaggaaucuuaaccaaaacugguugcaccgagaacgcacugcaaggcuacuacgucuguuuccucgguucucacucggagccacucauaguccccucacuugaagacauacgcucagcugaagucgucagccgcaugcucguccacccaaucggugaagaccacgacgccauccaaaauucucaauccuaucuacguauuguuggaccaauuacagcgaaaguccccagcacauccucgaccgauacacucaagggaauagcauucgcaggcgucccaauguacuccuccuucucaacgcuaguccgcaacgccgaccccgaguucguuuucucccccggcaucauccccgaaagcaaccacuccgucugcgacaagaaaaccgucccuaucacuuggacuggcuaccuuccaauuucaggcgaaauggaaaaagucacagguugcacaguauucugcacacuggccggcccaggagccagcugcgaggcauacucagaaaacgguauauucaacaucuccagcccaaccugccuagucaauaaaguccaacguuuccggggcucagagcagaaaauaaacuucauaugccaacgggucgaucaagacguugucguguacugcaauggucagaagaaaguaauccuaaccaaaaccuugguaaucggacaaugcaucuacaccuucaccucacuauucucccugaugcccgacgucgcacacucccuggccguagagcuaugcguaccaggccugcacggcugggccacaguaaugcuacucucaacauucugcuucggaugggugcuaauuccagcggucacccuaauuauacuuaaaugccuucgagugcugacguucaguugcucacacuacacgaacgagucaaaauucaaauucauccuagaaaaagucaaagucgaguaccagaaaaccaugggcagcaugguaugcgaugucugccaccacgagugcgaaacagccaaagaacuggaaucucaccgacaaagcugcauaaacggccaaugcccuuacugcaugaccauaacagaagcaaccgaaagcgcccuccaagcccacuacucaaucugcaaacugaccggccgauuccaagaagcgcucaaaaagagccuaaagaaacccgaagucaagaaaggcugcuaccgaacacuuggcgucuuccgcuauaaaucgcgcugcuacguuggacucguuuggugccuucuacuuacaugugaaauaguaauaugggccgcauccgccgaaaccccgcucauggaaucagguugguccgacaccgcgcacggagucggagaaauccccaugaagaccgaccucgagcucgacuucucacuccccagcuccuccucauacucuuacagacgaaagcuaaccaacccugcuaacaaagaggaaucaauucccuuccacuuccaaauggaaaaacaaguuauacacgccgaaauccaaccacuuggacacuggauggaugcaaccuucaacaucaaaacggccuuccacugcuacggagcgugccaaaaauauucguaccccuggcaaaccucaaaaugcuucuuugaaaaagacuaccaauacgagaccggcuggggcugcaaccccggagauugcccgggcgugggaacgggcugcaccgccugcggugucuaccuugacaagcuaaaauccgucggaaaagccuacaaaaucauaucccucaaguacacccggaaaguaugcauccaacuugguaccgaacaaacaugcaaacauauugaugccaaugauugccucgucacacccucaguuaaagucugcauaguaggcacaguaucaaaacuacaacccagcgacacucuccuguuccucggaccccuggagcaaggcggcauaauccuuaaacaauggugcacaacuucuugcgccuucggcgacccuggagacaucaugucaacccccuccggaaugcggugcccugagcauaccggcagcuuucgcaaaaucuguggauucgcaaccacgcccguuugugaguaccagggaaacacaguaucuggguacaaacgcaugauggcaacaaaagacucuuuccaaucauucaaccucaccgaaccccauaucacaaccaacaaacucgaauggaucgaccccgacggaaacacccgagaccacgucaaccucguacucaaccgcgaugucucguuucaagaucuauccgacaacccaugcaaaguggaccuccacacacaagccauagagggcgcauggggaucaggagucggcuucacccuaaccugcaccgucgggcuuacagaaugccccuccuucaugacaucgaucaaggcaugcgaccuggcaaugugcuacggcagcaccguggcaaaccuggcacgaggaucaaauacaguaaaggucgugggcaaaggaggccacagugguagcagcuucaaaugcugccacgacacagacugcagcagugaaggacuccucgccucggcuccccaccucgagcgagucaccggauucaaccaaaucgacucagacaaagucuacgacgauggugcgcccccgugcacuuuuaaaugcugguucacaaaaucuggcgaguggcuucuaggaauccucaacgggaacuggaucgucgucgucgugcucguagugaucuuaauacucucaauuaucauguucucgguccugugcccgcgccgaggacacaagaaaaccguauaa

SEQ ID NO: 14938 - RNA, 3417 nt, Artificial Sequence
  derived and/or modified CDS sequence (opt11) from ANDV(CHI-7913)__AY228238.1__GP
auggagggcugguacuugguggcccuagguaucugcuacacccuuacgcuggcaaugcccaagacgaccuacgagcucaagauggagugcccgcacaccgucggcuuggggcaggguuacaucaucgguucaaccgagcugggcuugaucuccaucgaggccgccagcgacaucaagcuggaguccagcuguaauuucgacuugcacacgaccuccauggcccagaagucauucacccaggucgaguggcgcaagaaguccgacaccacggacaccacaaaugccgcuagcaccaccuucgaggcucagacuaagaccguuaaccugagagggaccugcauacuggcccccgagcuguacgacacgcucaagaaggucaaaaagaccguccugugcuacgaccugacaugcaaccaaacccacugccaaccgacgguguaccucauugcccccguccugacaugcaugagcauccgcagcugcauggccagaguguucacuucccgcauccaggugauuuaugagaagacucauugcgucacggggcaguugaucgagggccagugcuuuaacccggcgcacacccucacccugucgcagccggcgcacaccuacgacacggugaccuuacccaucuccugcuucuucacccccaaggaaagcgagcagcucaaaguuaucaagaccuucgagggcauccugacuaaaaccggcugcaccgagaacgcccugcagggguacuacgucugcuuccucggcucccacagcgagccgcugaucgugcccucccuugaagacauccggagcgccgagguggucucccgaaugcucgugcacccacgaggcgaagaccacgacgccauccagaacagccagagccaccuccggaucguggggcccaucaccgcuaagguccccuccacgagcuccaccgacacccugaagggaacggccuucgccggggugcccauguacagcucccuguccacccuggugaagaacgcagaccccgaguucgucuucucccccggcaucauuccggagucgaaucacuccgugugcgauaagaagacggugcccaucaccuggaccggcuaccugccuaucagcggggagauggagaaagucaccggcugcacgguguucugcacccucgccgggcccggugcgucuugcgaggccuacuccgagaacggcaucuucaacaucuccagcccgaccugccuggucaacaaggugcagcgguucagaggcucggagcagaaaauaaacuucaucugccagcggguggaccaagacgucgugguguacugcaacggccagaagaaggucauccugaccaagacccucgugaucgggcaguguaucuacacguucaccagccuguucucccugaugcccgacguggcccacagccucgccgucgagcugugugugcccggccuucaugggugggccaccguaaugcucuuauccacguucugcuuuggcuggguccuaauucccgcagugacccucauaauccugaaaugucuccgcgugcucaccuucagcugcagccacuacaccaacgaguccaaauucaaguucauccuggagaaggucaagguggaguaccagaagacgaugggcucaauggugugcgacgucugccaccacgagugcgagaccgccaaagagcuggagucccaccggcagagcugcaucaacggccagugcccguacugcaugaccaucacggaggccacggaguccgcccugcaagcccacuauagcauaugcaagcucacuggccgcuuccaggaggcgcugaaaaagucccugaagaagcccgaggugaagaaggggugcuacaggacccucggcguguuccgcuacaagagcagaugcuacgucgggcugguguggugccugcuccugaccugcgaaaucgucaucugggccgcauccgcugagacgccucugauggaaaguggcugguccgauaccgcucacggggucggggagauccccaugaagaccgaccucgagcuggacuuuagccugcccuccagcuccagcuacuccuaccgccggaagcucaccaaccccgccaacaaggaggagagcaucucguuucacuuccagauggagaagcaggucauccacgccgagauccaaccccugggccacuggauggacgccacguucaacacuaaaaccgccuuccacuguuacggggcgugccagaaauacuccuacccguggcagaccagcaaguguuucuucgagaaggacuaccaguacgagacgggcugggggugcaaccccggcgacugccccggcguggggaccggcugcacggccugcgggguguaucuggacaagcucaaguccgucggcaaggccuacaagaucaucagccugaaguacacccgcaaagugugcauccagcuggggacggagcagaccugcaagcacauagacgccaacgacugucucgucacccccuccgugaaggugugcaucgucggcacggugagcaagcugcagccauccgacacucuacuguuccugggcccgcucgagcaggguggcgucauccucaagcaguggugcacgaccagcugcgcuuucggggaccccggagacauaauguccaccccaagcgggaugcggugcccggagcacacgggcuccuuccgcaagaucugcggauucgcgacuaccccagucugcgaguaccaggggaacacuauaucaggcuacaagcgcaugauggccaccaaggacaguuuccagagcuucaaccugacggagccccacaucaccgccaacaagcuagaguggaucgaccccgacgggaacacccgggaccacgugaaccucgugcugaaccgcgacgucucuuuccaagaccugagcgacaacccgugcaagguggaccuccauacccaggccaucgagggcgccugggggucuggcgugggcuuuacgcuuaccugcaccgucggacugaccgagugccccagcuucaugacguccaucaaggccugugaccuagccaugugcuacggcagcaccguggccaaccucgcacgggggagcaauaccgucaaggucgugggcaagggagggcacuccggaagcuccuuuaagugcugccacgacaccgacugcagcuccgaggggcugcucgcaucagcgccacaccuggaacgcguaacgggcuucaaccagauugacuccgacaaggucuacgacgacggggcgccaccgugcaccuuuaagugcugguuuaccaagucuggcgaguggcugcucggcauccugaauggaaacuggaucgugguggucgugcuggucgugauccucauccugucaaucauaauguucuccgugcugugcccgcggcgcggucacaagaagacggucuag

SEQ ID NO: 14939 - RNA, 3417 nt, Artificial Sequence
  derived and/or modified CDS sequence (opt11) from Hu39694(Hu39694)__AF028023.1__GP
auggaaggcugguaccugaucguguuaggggucugcagcacucugacacucgccaugcccaggacgaucuacgaacucaggauggaguguccccacaccgugggccuggggcagggcuauaucaucgggucaaccgaguuaggccucauccccaucgagaccgugagcgaccugaagcuggaguccagcugcaacuucgaccuccacacuaccuccaugacccagaaguccuacacccaggucgaguggcgcaagaagucggacacgaccgacaccaccaacgccgcgagcacuaccuucgaggcccagaccaagacggugaaccugcggggcacgugcgugcuggcaagugagcucuaugacacucugaagaagaucaagaaaaccguccugugcuacgaccuuaccugcaaccagacgcacugccagccaaccguguaccucauagcccccgucucaacguguauguccauccguagcugcauggccuccgucuucaccaaucggauccaggugaucuacgagaaaacccacugcgugaccggccagcuggucgagggccaguguuucaacccggcgcacacccucacccucucccaacccgcccacacguacgagauggugacccugccagugaccugcuucuucaccccgaaaaaguccgaccagcucaagcugaucaagacguucgaggggaucaucagcaagacggguugcaccgagaacgcccugcaaggguacuacguaugcuuccucggcagccacucggagccacugcacgugcccucccuugaggacauccgcagcguggagguguucagccggaugaucauacacccccgcggcgaggaccacgacccaauccaaaauucccagggguuucuccggaucgugggcccgaucaccgcaaaggugccaagcaccuccucgaccgacacuuugaaggggaccgcuuucgccgguguucccauguacucuagccuguccacccucgugcgcacgaccgauccugaauacguguucuccccgggcaucauccccgaguccaaccacagcacgugcgacaagaagaccauuccccugacauggacgggguaccuccccauagcgggcgaaauggagaaggucaccgggugcacgguguucugcacgcuugcuggcccaggcgccuccugugaggcguacagcgagcacggaauauucaacaucuccagcccgaccugccuggugcacaaggugcagaaauuccguggcuccgagcagaaaaucaacuuuaucugccagcgcguggaccaggacgucguaguguacugcaacgggcagaagaagguuauacugaccaaggacuuggugaucggccaguguauuuacaccuuuacgagccuauuuagccugaugcccgacguggcccacagccucgccgucgagcugugcgugccaggcuugcacggcugggccacagugaugcuccucuccaccuucugcuucggguggauccugauacccgccaucacacucgucgugcugaaguuucugaagauggcgacguucagcugcagccacuacaccaacgaguccaaguucaaguuuauccucgagaaggugaagguagaguaccagaagaccaugggcagcauggucugcgacaucugccaccacgagugcgagaccgccaaggagcuggagucgcacaagcagagcugcaucaacggccaaugccccuauugcaugacuaugaccgaggccaccgaguccgcgcugcaggcccauuacagcauuugcaagcugaccgggcgauuccaggaggcucucaagaagucccuaaagcgccccgaggugaagaagggcugcuaccggacguugggggucuuccgauauaaaagccggugcuacgugggccucgucuggugcguuuuacugaccugugagcucauaguaugggcagccucagccgagacucccuugcuggaguccgggugguccgacaccgcacacggcgugggcgaggucccuaugaagaccgaccucgagcuggacuucagucuucccuccucauccucguauuccuaccgccggaagcucaccaacccagcgaacaaagaggagucuaucccguuccacuuccagauggagaagcaaguuauccacgccgagauccaaacccuggggcauuggauggacgccaccuuuaacaucaagacggcauuucacugcuacggagcaugccagaaguacuccuacccguggcagacugccaagugcuucuuugaaaaggacuaccaguacgaaaccggguggggauguaaccccggagacugucccggcuucggcaccgggugcacggcgugcgguguguaccuggauaagcucaaguccguggggaaggcguacaagauaaucagccugaaguacacccggaaggugugcauccagcugggcaccgagcagacuuguaaacacauugacgccaacgacugccuggugaccccguccgucaaggugugcaucaucggcacagugucuaaacugcagcccuccgacacccuccucuuccugggcccccuggagcagggcgggauccuccugaaacaguggugcaccaccagcugcgcauucggcgaccccggggacaucauguccacgaccagcggcaugcggugcccggaacacaccggcuccuuccgcaagaucugcggguucgcgaccacgccagucugugaguaccagggcaacaccaucagcggauacaagcgcaugauggccacgaaggacuccuuccagucguucaaucugaccgacccacacaucaccacgaacaagcucgaauggaucgaccccgacggcaacacccgggaccacgugaaccuagugcugaaccgcgacgucuccuuccaggaucucucugauaauccgugcaagguggaccugcacacccaggccaucgagggggccuggggauccggcgugggguucacacugaccugcaccgucggccucacggaaugccccucuuucaucacgaguaucaaggcgugcgacauggccaugugcuaugggagcaccguguccaaucucgcccggggcagcaauacggugaaggucguggggaagggcggacacagcgggcuucacucccgcugcugccacgacaccgacugcagcagcgagggcuuaguggccucugcaccgcaccuggagcgggucacgggguucaaucagaucgacuccgauaagguguacgacgacggcgcaccaccaugcacguucaaguguugguucaccaagagcggugaguggcugcucgggauccugaacggaaacuggaucgucgucguagugcuggucgugguucucaucuucuccauaauacuauucaauauccugugcccccgcagggggcacaagaagaccguguag

SEQ ID NO: 14940 - RNA, 3417 nt, Artificial Sequence
  derived and/or modified CDS sequence (opt11) from LECV(Of22819)__AF028022.1__GP
auggaaggaugguaccucauuguccucggcgucugcagcacacucacacucgccaugccaaaaacaaucuacgaacuaaaaauggaaugcccccacaccgucggauugggucaaggcauuauaguaggaagcacagaacucggauuaauccccauagagacagccucggaccuaaaacuagaaucaucuugcaacuucgaucugcacaccacaucaaugacgcagaaaagcuacacucaaguagaauggagaaagaaaucagauaccacggauaccaccaaugccgcagcaacaacguucgaaucacaagcaaaaacggugaaccugcggggaaccugcguguuagcugcagaacuuuacgacacccugaagaaggugaaaaagacaguacucugcuacgaccuaacuugcaaucaaacucacugccaacccaccguauaccucaucgcacccgugauaaccugcaugagcauaagauccugcauggcuuccgucuucaucucacgcauccaaaucauuuacgagaaaacgcauugcgugacuggccagcugaucgaaggucaaugcuuuaaccccgcccacaccuuaaccuuagcccaacccgcccacacauacgaaacaguuacacucccaguaaccugcuucuucacccccaagaaaagcgaccaacucaaacucauuaaaacauuugaaggcauaauauccaaaacaggaugcacugaaaacgcgcuccaaggguauuacgucuguuuucuggguucccacuccgaaccacuucacgucccgagccucaaggacauccguagcgccgaagugguuacccgaaugauagugcacccccgaggagaagaccacgaucccauucaaaacucccaaggguaccuuaggaucgucggcccccugaccgcaaagguuccauccaccucuagcuccgauacccugcaaggcacugccuuugcaggcgucccaauguacucaucacucuccacucuaguccguaacaccgauccugaguucguguucucuccaggaaucauuccagaauccaaccacuccgccugcgauaagaaaaccaucccccuuaccuggacgggcuaucuaccaaucucgggcgaaauggagaaagucacaggaugcacaguuuucugcacccuugcgggccccggcgccuccugcgaggccuacucugaaucuggaaucuucaacauaagcuccccuaccugccucgucaacaaaguccaaaaauuucguggcucagagcagaaaauaaacuucaucugccaacgaguagaccaagacgucgucguauauuguaacggccagaagaaagugauacuaaccaaaacccucguaauuggucaaugcaucuacaccuuuacuucacucuucucccucaugcccgauguugcucacucacuugccgucgaacuuugcguacccggccuccauggaugggccaccguaaugcugcuaagcaccuucugcuucggcuggaucuuaauaccagccaucacccuaguagugcugaaaguguuaaaaguagcgacauucuccugcucacacuacaccaacgaguccaaguucaaauuuauacuagagaaagucaaagucgaauaccagaaaaccaugggcaguaugguaugcgacauuugucaccacgaaugugaaacagccaaagagcucgaaucccacaaacaaucaugcauuaacggccaaugucccuacugcaugacaaugacugaggcgaccgaaagcgcccuccaagcccauuucgccauuugcaaacucaccggccgauuccaagaagcccuaaagaaaagccuaaagaaacccgaaguaaggaaaggcugcuaccgcacauuaggggucuuccguuacaaaucgcgaugcuacgugggccuagugugguguguccuccuaacaugcgaacucaucgucugggcggccuccgccgaaaccccacuauuagagagcggcugguccgacaccgcucacggagugggcgaagucccgaugaaaacagaccuggaacucgacuucucccuccccuccuccuccuccuacuccuaccgaagaaaacucacuaaccccgccaacaaagaagaauccauacccuuccauuuccagauggagaaacaagucauacaugcggagauccaaaaccuaggccauuggauggacgcaaccuuuaacauuaaaaccgccuuccacugcuacggugccugccaaaaauacucuuaucccuggcaaacagcgaaguguuucuucgaaaaggacuaccaauacgaaacgggauggggaugcaaccccggcgacugccccggaguaggcacaggcugcaccgccugcggagucuaccucgacaaacucaaaucggucggcaaggcauacaaaauaaucucccuuaaauacacacgcaaaguuugcauucagcuagguaccgaacaaaccugcaagcauauagacgcaaacgacugccucguaacaccauccguaaaggucugcaucgucgggaccgucucaaaacuccaacccuccgacacacuucuauuccuaggcccccucgaacaaggcggcaucaucuuaaagcaguggugcaccaccagcugugcauucggggaccccggcgacaucaugucaaccaccuccggaaugcgcugccccgaacacacaggcagcuuccgcaaaaucugcggauucgccacaacaccagucugcgaguaccaaggcaacaccauaagcggcuacaaacgcaugauggccacuaaggacucauuccaauccuuuaaccuaacagacccgcacaucacaacaaacaaacucgaguggaucgaccccgacggcaacacccgagaucacgucaacuugguccuaaacagagacguauccuuucaagaccugucugauaaccccuguaagguggaccugcacacccaagccauagaaggugccugggggagcggcgucggguucacucucacuugcaccguggggcucaccgaaugcccaucauucaugaccucgaucaaagcaugcgaccuggccaugugcuacggcucgaccguccacaaccucgcgagggguagcaacaccgucaaagucguuggaaaaggcggccacuccggauccagcuucaaaugcugccacgacaccgauugcucauccgaaggcuuagucgcaucagcuccccaucuagaaagagucaccggguucaaccaaauagacagcgacaaaguuuacgaugacggagccccacccugcacauucaaguguugguucaccaaauccggcgaauggcuccuaggcauccuaaacggaaacuggaucgucguaguuguccucgucgucguacucaucuucagcauaauucucuucucaauccuaugcccccgcaggggccacaagaaaacaguauaa

SEQ ID NO: 14941 - RNA, 3417 nt, Artificial Sequence
  derived and/or modified CDS sequence (opt11) from ORNV(Ol22996)__AF028024.1__GP
auggaaggcugguaccucaucguucuaggcgugugcuccaccguaacacuagccaugccaaagaccaucuacgaacuaaaaauggaaugcccccauacaguuggucugggccaaggauacaucaucggcuccaccgaacucaaccuaauacccaucggugcagccuccgaccuuaaauuagaauccuccugcgacuucgaccuauacacaaccccgaugacccaaaagucuuacacccaagucgaguggcggaagaaaagcgagacuacagacacaacuaacgccgcagccaccacauucgaaucccaaacuaaaaccgucaaccuccggggaacgugcauccuggcauccgaacucuaugacacccuaaacaaaauaaagaaaccgguauugugcuacgaccucaacugcaaccaaacacgcugccaacccaccguguaccuuauugcccccguuaucacaugcauguccauacgcagcugcauggccuccgucuccaauagccgcauccaaaucauauacgagaaaacccauugcgucaccgggcaacugguagaaggccagugcuucaacccaagccacacccucacacuugcacagcccgcccacacauacgaaacagucacacugcccguaacaugcuuuuucacccccaaaaagucugaccagcucaaacuugucaaaacuuucgaaggcaucauaacuaagaccggcugcacagaaaacgcgcuacaaggcuauuacguaugcuuccucggaucacauucagagccccuucacguucccucccucgaggacauacgaagcgccgaggucgucagccguaugaucguccaccccaggggcgaagaccaugacccaauccaaaacucacagggacaccuacguauagucggacccauuaccgcaaaaguaccauccacauccucuuccgacacccuucaaggcaccgccuucucuggcguaccaauguacagcagccucuccacccuaguccgguccgccgaccccgaguucguguucucacccgggauccucccggaaagcaaccauagcguaugugacaaaaagacucucccacucacguggaccggcuaccuaccaaucucgggcgaaauggaaaaagucaccgggugcacggucuuuugcaccuuagcagggcccggugccuccugugaggcauacucugaaaaugguauauucaacauaucuuccccaaccugccuaguaaacaaaguacaaaaauucaggggauccgaacagaaaaucaauuucaucugccaacgcauggaccaagacgucguuguauauugcaacggccaaaagaaaguuaucuugaccaaaacacuuguuaucggccagugcauuuacacauucacuagcuuauucucccuuaugcccgacgucgcucacucccucgccguagaacugugcguccccggccuccacggaugggccacaguaaugcucuuaagcaccuuuuguuucggcuggauccuaaucccggcaauaacccuugucguacuaaaauuccuaaaaauggccacauuuuccugcucacacuauacaaacgaaagcaaauucaaacuaauacucgaaaaaguaaaaguagaauaccagaaaacuaugggcucaaugguaugcgacauuugccaccacgaaugcgagacagcgaaaguccucgaaucucacaagcaaucguguaucaacggccaaugccccuacugcaugacgaugaccgaagcgacagaauccgcccuccaagcccauuacucgauauguaaauuaacuggacgauuccaagaagcccucaaaaagucccugaagaaaccagaggucaaacgcggcugcuacagaacccuaggcgucuuccgcuacaaaucccgaugcuacgucggccuaguauggugcguccuccuaacgugcgaauuaaucgucugggcagcuuccgcagaaacaccccuccuagagucaggaugguccgacaccgcccacggcgucggagaaaucccgaugaaaacggaccucgaacucgacuucagcuuacccucaaguuccagcuacucauacagacguaaacuaaccaacccagcgaauaaagaggagucaaucccauuccacuuccaaauggaaaaacaaguaauacaugccgaaauccaaacccuaggacacuggauggacgcgacauucaacauaaaaaccgccuuccacuguuacggcgcgugccaaaaauacuccuaccccuggcaaaccgccaaaugcuucuucgaaaaagacuaccaauacgagacaggcuggggaugcaaccccggcgacuguccugguguaggaaccggaugcaccgcaugcggugucuaccuagacaaacucaaauccgucggaaaagccuacaaaaucaucucacucaaauacacccgaaaagucugcauccaacucggcaccgaacaaaccuguaagcacaucgacgcaaacgacugucucgugacccccucugucaaggugugcauaguaggcacgguaagcaaacuacaacccucagacacccuccuuuuccuaggcccccucgaacaaggaggcauaauacuaaagcagugguggaccacuucaugcgccuucggagacccaggcgacaucaugagcaccacaucaggcaugcgcugccccgaacacacgggaucauuccgaaagauaugcggcuucgcgacaacacccgucugugaauaccaaggaaauacaauauccgguuacaagaggaugauggcgaccaaagacucauuccaaucguucaaccucaccgacccgcacauaacaacaaauaagcuggaauggauagacccggacggaaacacccgcgaccacgucaaccucguccuaaacagagacgucucauuccaagaccucucagacaacccuugcaaaguggaccuccacacacaagcgauagaaggggcauggggcucaggugucggcuucacccuuacauguaccguuggccuuaccgaguguccauccuucaugaccuccaucaaagcaugcgaccuagccaugugcuacgguagcaccgucaccaaccucgcccggggauccaauacaguuaaggucguaggcaagggaggucauucaggcuccuccuucaaaugcugccacgacacagacugcucaucggaagggcuagucgccagcgcgccacaccuagaaagagugacaggauucaaucaaauagacucagacaaagucuaugacgacggcgcacccccaugcaccuuucguugcugguucacaaaaucaggcgaauggcucuuagggauacucaacggaaacuggaucguaguagucguacuaaucguaguucuaaucuucuccauuguccucuucucuauccuuuguccccgcagaggacacaagaaggccguguaa

SEQ ID NO: 14942 - RNA, 3426 nt, Artificial Sequence
  derived and/or modified CDS sequence (opt11) from BCCV__L39950.1__GP
augggcaggcuguaccuaaucgugcugggaguucugauuaccgccaccgccggcuucccccggagcgugcacgagcucaagaucgaguguccgcacacggugguucuggggcagggcuacgugacgggguccguggagcugggcuucaucgcccucgaccaggucaccgaucugaagaucgagagcucgugcagcuucgaccaucacgccgcccccaccacgacccaaaacuucacccagcugaagugggccaagaccgccuccacuaccgacacgaccaacgcggccgaaacgaccuucgagagcaaguccaccgaggugcaccucaagggcguguguaccauccccucaaacguucuggacgggcccucccgcccggugacgggccggaagaccgugguuugcuaugaucuagcgugcaaccagacccacugccagcccaccgugcaccuccuggcacccauacagacgugcaugagcgugcgcuccugcaugaucagccugcuugcaucccgcauccagguuguuuacgagaagaccuacugcgugacugggcagcugaucgagggccuguguuucaaccccgucccgaaccucgcccuaacccagcccggacacacguacgacaccuucacacuccccaucacgugcuucuuaguggcuaaaaagggugccaaucugaaaaucgcuguggagcuugagaagcucaccaccaaaaccggcugcgcagagaacgcccugcaggccuacuacaucuguuucaucgggcagcacagcgagcccuugaccgugccgaugcucgaggauuaccgcuccgcugagaucuuuacgcggaucaugaugaaccccaagggcgaggaccacgacauggagcaaagcucccagggggcccugcgcauaguggggccaaucaaaggcaagguaccaccgacggaaaccagcgacaccguccaggguaucgcguucgcuggccugcccauguacagcagcuucagcucccugguacggaaggccgagccggaguaccuguucagcccaggcaucaucgccgaguccaaccacagcaguugcgacaagaagacacugccgcucaccuggcgaggcuuccuaagcauguccggggaaaucgagcggaucaccggcugcaacgucuucugcacgcuggccggaccgggggccagcugcgaggcguauuccgaaaacggcauuuucaacauuuccuccccgaccugucuagugaacaagguucagaaguucagaggcagcgagcagagaauaaacuucaucucccagcgaaucgaccaagacguaauaguguacugcaacggccagaagaaggugauucucacgaagacccuggucaucgggcagugcaucuacaccuucaccagcaucuucucccucauccccagcguggcccacucccuggcaguugagcuaugcguucccggcauccacggcugggcuacgaucgcgcucguaaucaccuucugcuucggauggcuacugauuccgaccacgacgaugguagucuugaaaugucugcggcugcuaaccuacagcugcucccacuacagcaccgagagcaaguucaaggugauccuggagaaagugaaggucgaguaccagaagaccaugggcucgauggugugcgacauuugccaccacgagugcgaaacggcgaaggagcuagagagucacaaaaagagcugcgccgacggccaaugccccuacuguaugaccaucaccgaggccacagaaagcgcgcugcaagcccacuacgccgugugcaagcucacgggccgcuuccacgaggcccugaagaaguccuuaaagaagccggagguccagcgcgggugcuacaggacucucggcguuuuccgguacaagagccgcugcuacgugggccuggucuggaugugucugcucacccuggagcugauagugugggccgcguccgccgacacgccccuccuggaacccggguggagcgacaccgcccacggcguuggggacaucccuaugaagaccgaccuggagcucgacuucgcgaucccguccagcaguagcuacuccuaucggaggcgccuggucaaccccgccaacagugaugagacugugcccuuccacuuccagcuggaaagacaggugauccacgcggaaauccagucccucggucacuggauggacgcuaccuuuaacauuauaagcgccuuccacugcuacggcgaaugcaagaaguacuccuauccguggcagacggccaagugcuucuuugagaaggacuaccaguacgagaccagcuggagcugcaacccgccagacugccccggggucggaaccgguugcaccgcgugcggcaucuaccuugauaagcugaaguccgucgguaaggcguacaaagugaucacgcucaaguacgcccggaaggucugcauccaacucggcaccgagcaaaccugcaagaacaucgacgugaacgacugccuggugaccagcuccaucaaagucugcaugauuggcacgaucuccaaguuucagcccggggauacccuccuguuccugggcccgcucgaggagggcgggcuaguccugaagcaguggugcaccacuacgugcuccuucggagacccuggagacaucaugagcaccaccuccggaaugcgaugcccugagcacacugggagcuuccgcaagaucugcggcuucgcaacaacgcccgugugugaguaucaggggaacaccgucuccggauucaagcgacucauggccaccaaagacagcuuccagucguuuaacgucagcgaggugcauaucaccacgacaaaguuggaguggucagaucccgacagcaauauuaaggaccacaucaaccugaucuuaaacagggacgucuccuuccaggaccugagcgacaaccccuguaagguggaccuguccacccaggcgaucgacggggcauggggcagcggcgugggguucaccuuaacgugcaucgucggccugaccgagugcuccagcuucaugacuagcauaaaggugugcgacauggcaaugugcuauggugccuccguggucaaccuggugcggggcucuaacaccgugaagauagucggcaagggcggccacucuggguccacguuccgcugcugccacgauaaagacugcaccuccaacggccuccuggccagcgcgccccaccuggagcgggugaccggguucaaccagaucgacuccgauaagguguacgacgauggcgcgcccccgugcagcaucaagugcugguucgcgaagucaggcgaguggcuccuugggauccugaauggcaacugggucguggucgccguccucgugaucauccugcugaucagcauuuuccucuucaguuucuucugccccauccgcucacacaagaagcaauuauga

SEQ ID NO: 14943 - RNA, 3408 nt, Artificial Sequence; identical to SEQ ID NO: 11657
  derived and/or modified CDS sequence (opt11) from DOBV(DOBV/Ano-Poroia/Afl9/1999)__NC_005234.1__GP

SEQ ID NO: 14944 - RNA, 3408 nt, Artificial Sequence; identical to SEQ ID NO: 11658
  derived and/or modified CDS sequence (opt11) from DOBV(DOB/Saaremaa/160V)__AJ009774.2__GP

SEQ ID NO: 14945 - RNA, 3408 nt, Artificial Sequence
  derived and/or modified CDS sequence (opt11) from DOBV(East Slovakia/400Af/98)__AY168577.1__GP
augaucaugugggggcugcuccugaccaugauccugaucgacuucgggaccagccucagaaacguguacgacaugaagaucgagugcccccacuccaucaacuucggcgagaguuccgucacggggaagguggagcugccgccccugcugcugacagacgccgaggcccuggugccggagagcaguugcaacauggacaaccaccagagcauguccaucauccagaaggucaccaaggugucauggcggaagaaagccgacaaagcccaggccgccaaggauuccuucgagacuacgagcucugaggucaaccucaaggggacaugcacccugagccacaggauggucgaggaguccuaccgaaaccgccggagcgugaucugcuacgaccuguccugcaacagcacccacuguaagcccacgaugcacaugaucgugccgguccacuccugcaacaugaugaaguccugccucguggggcugggcccauacaggauccagguggucuacgagcggacauauugcaccaccggcauccugacggaggggaagugcuucgugcccgaccagagcaucgugaacgucaucaagaacggcgucuucgacaucgcuagcgugagcaucgucugcuucuucauacgcgugaaggggaccaacuauaagaucauggcguccauuaagaccgccaccgccaacaacugcaacgacacggacaacaaagugcagggguacuaccucugcaucgucgggggcaacucaagucccguguacgcccccagcaccaccgauuuccgguccauggaggcgcuggccagccugcuccgcgcgccccacggcgaggaccaugaccuguccggugaggagguggccacguacagcauugcaggccagauagaggggaagaucccucacacggccaacgcggccaacaugcuguuuaccgccuucuccggcaucccaagcuacuccagccucuccgucuacaucgggagccaggaugggccgguggucuacucccccggccuauuccccaagcugaaccagagcuccugcgacaagguggcccucccacugaucugggaaggguacaucgaccugccgggcuauuacgagaccgugcaccccugcaacgucuucugcgugcucagcgggcccggcgcguccugcgaggcauucucugagggcgggaucuucaacaucaccagccccacgugccugguguccaagcagaaccgguuccgcgccgccgagcagcaggucaacuucgugugccagcgggucgaccaggacaucgucaucuacugcaacggccagaagaagaccauauugaccaagacccucgugaucgggcagugcauuuacagugugacgucccuguucagcaucaugccgggcgucgcccacuccaucgcgaucgagcuguguguucccggguuccacggcugggcgacugccgcccuccugaccaccuucugcuucggcuggauccuuauccccucaaucacucucgccguguuagucgugcugaaguucuucgcggccauccuccacaacuccagccaggagaaccgcuucaagauaauacugcggaagaucaaggaggaauuugaaaagaccaagggguccauggugugcgaggucugcaaguacgagugugagaccggcaaggaguugaaggcccacaaucucagcugcccccagucccaguguccguacugcuucacccacugcgagcccacggaaagcgccuuccaggcgcacuacaaggugugccaggccacacaccgcuuccgggacgaccugaagaagaccaucacgccccaguccacgagccccgggugcuaccgcacacugaaccucuuccgguacaagucccgcugcuacauuuucaccgugugggucacccugcugauaaucgagagcaucaugugggcggccuccgccucggagaacgugcucgagccgagcuggaaugacaacgcgcacggcgugggggucgugcccaugcacaccgaccuggagcuggacuucucccuccccagcuccagcaaguacacguacaagcggaagcucaccuccccgcugaaccaggagcaaagcguggaccugcacaucgagaucgagucccagggcaucagcaccuccguccacgcccucggccauugguucgacgggcgccugaaccugaagacgagcuuccacugcuacggcgccuguacaaaguacgaguaccccuggcacaccgccaagugucacuucgagcgcgacuucgaguacgagaacuccugggggugcaaccccgccgacugccccggcaucggcaccgggugcaccgcgugcggccucuacaucgaccagcugaagccgguggggagcgccuacaagcugaucacugugcgguauucccgcaaggucugcgugcaguucggcgaggagaaccucugcaagaccaucgacaugaacgacugcuucgucacccggcacguuaagguaugcaucaucggcaccgugagcaaguuuucccagggcgauacgcuggucuuccugggccccauggagggcggcgggcucaucuucaaggacuggugcacaagcacgugccaguucggcgaccccggggacaucaugucccccaaggacaagggcuucagcugcccggacuucaccggccacuuccgcaagaagugcaacuucgccaccaccccagugugcgaauaugacgggaacaugguguccggcuacaagaaggucauggccaccaucgacagcuuccagagcuucaacaccuccagcauccacuacacugaugagcggaucgaguggaaggaucccgacgggauguugaaagaccaccuaaacauccucgucaccaaagacaucgacuucgaaaaccugggcgagaaccccugcaagguggggcugcaaaccaguagcaucgagggcgccuggggcaguggggucggcuucacccucacgugccagaucagccugaccgagugcucccgcuuccugaccucuaucaaggcgugugacauggccaucuguuacggggcccaguccgugacccucauccggggccagaacacggugaaggucagcgggaagggagggcacuccgggagcuccuucaagugcugccacggcaccgauugcagccagcaggggcugcaggccuccgcgccgcaccuggacaaaguaaacggcauaguggaacaggagagcgaaaaggucuacgacgacggcgcgccccagugcgggaucucuugcugguucgucaagagcggggaauggauuaccgggaucuucaacggaaacuggaucgugaucgugguguuaaucuucuucuucauccugucccugauccuacugagccuccucugccccauccgcaagcacaagcggagcuga

SEQ ID NO: 14946 - RNA, 3408 nt, Artificial Sequence
  derived and/or modified CDS sequence (opt11) from DOBV(East Slovakia/862Aa/97)__AY168578.1__GP
augaucauguggggccugcucuugacgaugagccugaucaaccucggggccucccugcgcaacguguacgaccuccggaucgagugcccucacagcaucaacuucggcgaguccagcgucaccgggaagguggagcucccgcccaucccccugacggacgccgaaacccucguuccagaguccagcugcaacauggacaaccaccagucccucagcaucacacagaaggucaccaaggugucauggcgcaagaaggcggacaaggugcaggccgccaaggacagcuucgagacgacauccagcgagaucaaccugaaggggaccugcacccuggcccaccggauggucgaagagaguuaccgcaaccgcaagagcgugaucugcuacgaccucuccugcaacagcacgcacugcaagccgaccauguacaugaucgugcccguccacuccugcaacaugaugaaguccugccugguggggcuggggcccuaccggauccagguaguuuacgagcggaccuacugcaccacgggcauccucaucgaggggaagugcuucgugcccgaccagagcaucaucagcgugauaaagaacggcgucuucgacaucgccagcguguccaucgugugcuucuucauccgcaucaaggggaacagcuauaagaucaugaccaacaucaagaccgcgaacccaaacaacugcaacgacaccgauaacaagguucagggcuauuaccugugcaucgucggggccaacuccagccccguguacgcccccuccacgaccgacuucaggagcauggaaguccuggccucccuccugcgcagcccccacggcgaggaccacgacuuauccggcgaggagguggcgaccuacagcaucgccggccagguggaaggcaaggucccgcacaccgagaacgccgcuaacaugcuguucacggccuuuuccgggauccccucuuacuccagccucuccgucuucgcgggcaaccaggacgggaccgucaucuacagccccgggcuauuccccaagcucaaccaauccagcugcgagaagguggcccucccgcugaucugggagggcuacaucgaccuccccggguacuacgagacaauccaccccugcaacguguucugcguccuguccggccccggggccagcugcgaagccuucagcgagggcggcaucuucaacaucaccuccccgacgugccuggugagcaagcagaaucgguuccgcgccgcggagcagcagaucaacuucgugugccagcgggucgaccaggacaucgugaucuacugcaacgggcagaagaagaccauccucaccaagacccuggugaucggccagugcaucuacuccgucacgagcuuauucuccaucaugcccgggguggcccacagcaucgccaucgagcucugcgugcccggcuuccacggaugggccaccgccgcgcugcugaccaccuucugcuucggcuggauccucauccccuccaucacgcuggccauccugaucguccucaaguucuucgccgccauccugcacaacagcucucaggagaaccgcuucaaggugauccugcggaagaucaaggaggaguucgagaagaccaagggcagcauggugugcgaggucugcaaguacgagugcgagaccgggaaggagcucaaggcccacaaccuguccugcccgcagagccagugccccuacugcuucacccacugugagcugacggaguccgcguuccaggcccacuaccgcgugugccaggccacccaccgguuccgcgaugaccucaagaagaccaucacgccccagagcaccucucccggcugcuaccggacgcugaaccuguuccgcuacaagagccggugcuacaucuucaccgugugggucgugcuccugaucaucgaguccauccugugggccgcgagcgccagcgagaucgugcuggagccguccuggaacgacaacgcccacggggucggcguggugcccaugcacaccgaccucgagcuggacuucagccugcccuccagcuccaaguacaccuacaagcgcaagcucacgagcccgaucaaccaagagcaguccgucgaccugcacaucgagaucgagagccagcgcaucuccaccagcgugcacgcccugggacacugguucgacggcaggcucaacuugaagaccuccuuccacugcuacggcgccugcaccaaguacgaguaccccuggcacacggcgcgcugucacuuugagcgggacuucgaguacgagaacagcugguccugcaaccccgccgacugcccagggaucggcacagggugcaccgccugcggccuguaccucgaccagcugaagccgguaggcagcgccuacaagcugaucaccguccgcuacucccggaaggugugcgugcaguucggggaggagaaccucugcaagaucaucgacaugaacgacugcuucgucagccgccacgugaaggucugcaucaucggcacggucuccaaguucucgcagggggauacccugguguuccugggccccauggagggcgggggacucaucuucaaggacuggugcaccaccacuugccaguucggggaccccggcgacaucauguccccgaaggacaagggguucagcugcccggacuucacaggccacuuccggaagaagugcaacuucgccaccacccccgugugcgaguacgacgggaacauggucagcggcuacaagaaggugauggcgacgaucgacuccuuccaggccuucaacaccagcuacauccacuacaccgacgagcgcaucgaguggaaggaccccgacggcaugcugaaggaucacauuaacauccuggugaccaaggacaucgacuucgagaaccucggggagaaccccugcaaggucggcuuacagacggccuccaucgagggggccuggggcagcggggugggcuucacccugaccugccagaucucccucaccgaaugcagccgguuccugacguccaucaaggcuugcgacauggcgaucugcuacggcgcccagagcgugaccuuaguccgcgggcagaacaccgugaagguguccggcaagggcgggcacagcggcuccagcuucaagugcugccacggcaccgacuguucccagcagggccuccaggccagcgccccgcaccuggacaaggucaacgggaucguggagcaggaguccacccagguguacgaugacggcgcgccccagugcgggaucucaugcugguucaucaaguccggcgaguggaucaagggcauuuucaacgggaacuggaucgucaucguggugcugaucuucuucuucauccucagccugauccugcuguccuuccugugccccauccggaagcacaagcgcagcuga

SEQ ID NO: 14947 - RNA, 3408 nt, Artificial Sequence; identical to SEQ ID NO: 11661
  derived and/or modified CDS sequence (opt11) from DOBV(A35)__GU904036.1__GP

SEQ ID NO: 14948 - RNA, 3408 nt, Artificial Sequence; identical to SEQ ID NO: 11662
  derived and/or modified CDS sequence (opt11) from DOBV(A6)__GU904033.1__GP

SEQ ID NO: 14949 - RNA, 3408 nt, Artificial Sequence
  derived and/or modified CDS sequence (opt11) from DOBV(B13)__GU904034.1__GP
augaucauguggggccugcuccugaccaugauccugaucgacuucggggccucucuccgcaacguguaugacaugaagaucgagugcccccacuccaucaacuucggcgagagcuccgucaccgggaagguggagcugccgccccugcuccugaccgacgccgaggcccucgugcccgagagcuccuguaacauggacaaccaccagaguauguccaucauccagaaggucaccaaggugagcuggcggaagaaggccgacaaggcccaggccgccaaggacuccuucgagaccaccagcuccgaggugaaccucaagggcacgugcacccugagccaccgcauggucgaggagucauaccggaaucgccggagcgugaucugcuacgaccuguccugcaacagcacccacugcaagcccaccaugcacaugaucgugccgguccacuccugcaauaugaugaaguccugccucguagggcugggccccuaccgcauccaaguggucuacgagcggacguacugcaccaccggcauccugaccgaggggaagugcuucgugcccgaccagagcaucgugagcgucauaaagaacggcguguucgacaucgccagcguguccaucgucugcuucuucauccgcgugaaggggacgaacuacaagaucauggccagcaucaagaccgccaccgccaacaacugcaacgacaccgacaacaaagugcagggcuacuaccucugcaucgucgggggcaacucaagucccguguacgcgccguccacuaccgacuuccggagcauggaggcccuggccucccugcuccgcgcgccccacggcgaggaccacgacuuaagcggggaggaaguggccaccuacuccaucgccggccagaucgaggggaagaucccccacaccgccaacgccgccaacaugcuguucacggcauucagcggcauccccuccuacagcagccucuccgucuucaucggcucccaggacgggccgaucaucuacagcccuggccuguuccccaagcugaaccagagcagcugcgacaagguggcgcucccccugauuugggagggguacaucgaccugccgggcuacuacgagaccguccaccccugcaacguguucugcgugcucuccgggcccggcgcaagcugcgaggccuucagcgagggcgggaucuucaacaucaccucaccgaccugccuggucagcaagcagaaccgguuccgcgccgccgagcagcaggucaacuucgugugccagcgggucgaccaggauaucaucaucuacugcaauggucagaagaaaacgauccugaccaagacccucgugaucgggcagugcaucuacuccgugaccagccuguucuccaucaugcccggcgucgcgcacagcaucgccaucgagcugugcguucccggguuccacggcugggccacggccgcccuccugaccaccuucuguuucggcuggauccugauccccuccaucacccucgcugugcuggucgugcugaaguucuucgcagcuauccuccacaacagcucccaggagaaccgcuucaagaucauccugcggaagaucaaggaggaguucgagaagacgaaggggagcauggugugcgagguaugcaaguacgagugcgagaccggcaaggagcugaaggcccacaaccucuccugcccccagucccagugcccguacugcuucacccacugcgagcccaccgaguccgcguuccaagcccacuacaaggugugccaggccacgcaccgcuuccgggaugaccugaagaagaccaucacgccccagagcaccuccccugggugcuaccgcacccucaaccucuuccgguacaagagccgcugcuacaucuucaccgugugggucacccugcugaucaucgaguccaucaugugggcagccagcgcgagcgagaacgugcucgagccguccuggaacgacaacgcccacggcgugggggucgugcccaugcacaccgaccuggagcuggacuucagccugcccuccagcuccaaguacaccuacaaacggaagcucacgagcccgcugaaccaggagcaguccguggaccugcacauagagaucgagagccagggcaucuccaccagcguucacgcccucggccacugguucgacgggcgccugaaccugaaaaccuccuuccacugcuacggcgccugcaccaaguacgaguaccccuggcacacggccaagugccacuucgagcgcgacuucgaguacgagaacagcugggggugcaaccccgcggacugccccggcaucggcacggggugcaccgccugcggccucuacaucgaccagcugaagccggugggguccgccuacaagcugaucaccgugcgguacagccgcaaggucugugugcaguucggcgaggagaaccucuguaagacgaucgacaugaacgacugcuucgugacacggcacgucaaggugugcaucaucgggaccguguccaaguucagccagggcgacacccugguuuuccugggccccauggucgggggcgggcucaucuucaaggacuggugcaccuccacgugccaguucggagaccccggggacaucaugagccccaaggacaagggcuucuccugcccggacuucaccggccacuuccgcaagaaaugcaacuucgccaccaccccugugugcgaguacgacgggaacauggugagcggcuauaagaaggugauggccaccaucgacagcuuccaguccuucaacaccagcuccauccacuacaccgacgagcggaucgaguggaaggaccccgacgggaugcugaaggaccaccugaacauccucgugacgaaggacaucgacuucgagaaccugggcgagaaccccugcaaggucgggcuucagaccucauccaucgagggcgcguggggcagcggggugggcuucacccugaccugccagaucucucucacagagugcucucgcuuccugaccuccaucaaggccugcgacauggccaucugcuacggggcccagagcgugacccucauccggggccagaacacagucaagguguccgggaagggcggccacagcggguccagcuucaagugcugccacggcacggacugcucccagcaggggcugcaggcgagcgcaccgcaccuggacaaggugaacggcaucgucgagcaggacucagagaagguguacgacgacggcgcgccccagugcgggaucagcugcugguucgugaaguccggcgaguggaucaccgggaucuucaacggcaacuggaucgucauuguggugcucgucuucuucuucauccugagccugauccuccugagccugcucugccccauccgcaaacacaagcgguccuga

SEQ ID NO: 14950 - RNA, 3408 nt, Artificial Sequence
  derived and/or modified CDS sequence (opt11) from DOBV(Aa1854/Lipetsk-02)__EU188453.1__GP
augaucauguggggccugcuccugaccauggcccugaucaaccccggggccacccuccgcaacguguacgacaugcggaucgagugcccccacagcaucaacuucggcgaguccagcgucacggggaagguggagcugccgcccaucccacuggccgacgccgagacccucgugccagaauccagcugcaacauggacaaccaccagucccugagcaucacccagaaagucaccaagguuuccuggcgcaagaaggccgauaaggugcaggccgccaaggacagcuucgagacgaccuccagcgagaucaaccugaaggggaccugcacccucacgcaccggauggucgaggaguccuaccgcaaccgcaagagcgugaucugcuacgaccuguccugcaacagcacccauugcaagcccaccaugcacaugaucgugcccguccacuccugcaacaugaugaaguccugccuggugggccucggccccuaccggauccagguggucuacgagcgaaccuacugcacgaccggcauccugaccgaggggaagugcuucgucccggaccagagcauagugagcgucaucaagaacggcguauucgacaucgccuccgugagcaucgucugcuucuucauccgcauaaaggggaacagcuacaagauaauggccuccaucaaggaggccaaccccaacaacugcaacgacaccgacaacaaggugcaaggcuacuaccugugcaucgugggggccaacagcucccccgucuacgcgcccagcacgaccgacuuccgguccguggaggcccucgccagccugcugcgcuccccucacggcgaggaccacgaccucagcggcgaggagguggccaccuacuccaucgcagggcaggucgagggcaaggugccccacaccgcgaacgccgcgaacaugcuguucacugccuucucagggauccccucccacagcuccuucagcgucuuuaccggcaaccaggacggcaccguuaucuacucccccggguuauucccgaagcucaaucagagcgcaugugacaagguggcgcugccuuuaaucugggaaggcuacaucgaccuccccggguacuacgagacaauccaccccugcaacgucuucugcguccugagcggcccgggggccuccugcgaggccuucuccgagggcggaaucuucaacaucacgagcccuaccugccugguauccaagcagaaccgguuccgcgcugccgagcagcagaucaacuucgucugccagcggguggaccaagacaucgugaucuacugcaacgggcagaagaaaaccaucuuaaccaagacgcuggucaucggccagugcaucuacuccgugaccagccuguucuccaucaugcccgggguggcgcacagcaucgccaucgagcucugcguacccgguuuccacgggugggccaccgccgcccugcugaccacguucugcuucggcuggauucucauacccuccaucacccuggcgauccugaucgugcucaaguucuucgccgccauccugcauaacagcucccaggagaacagguucaagaucauccugcgcaagaucaaggaggaauuugagcgcaccaagggcagcauggugugcgaggucugcaaguacgagugugagaccgggaaggagcucaaggcccacaaccuguccugcccccagagccagugccccuacugcuucacacacugcgagcugaccgaguccgcguuccaggcccacuaccgggugugccaagccacccaccgcuuccgggacgaccucaagaagacgaucacgccccagagcaccuccccgggcugcuaccgcacccugaaccuguuccgauacaaaagccgcugcuacaucuucaccgugugggucgugcuccugaucaucgaguccauccugugggccgccagcgcguccgagaccgugcucgagcccaacuggaacgacaacgcccacggggucggcgugguaccuaugcacacagaccuagagcuggacuucagccugccgucuucgagcaaguacaccuauaagcgcaagcucaccucccccaucaaccaggagcagagcgucgaucugcauaucgagguggagucccaggggauuagcaccuccgugcacgcccugggccacugguucgacggccggcucaaucuaaagacgagcuuccacugcuacggggccugcaccaaguacgaguaccccuggcacaccgcgcgcugccacuucgagcgggacuucgaguacgagaacuccuggagcugcaaccccgcggacugcccgggcaucgggacaggcugcacggccugcggccuuuaccucgaccagcugaagccagucggcuccgccuacaaguuaaucaccgugcgguacagccggcgcguguguguccaguucggcgaggaaaaccucugcaagaccaucgacaugaacgauugcuucgugacccggcaugugaaggucugcaucaucgggacgguguccaaguucagccagggcgacacccugguguuccuggggcccauggaggguggcggccuaaucuuuaaggacuggugcaccaccacgugccaguucggcgaccccggggacaucaugagcccgaaggacaagggauucagcugccccgacuucaccgggcacuuucgcaagaagugcaacuucgcgaccacacccgucugcgaguacgacgggaacaugguauccggcuacaagaaggugauggccacgauagacagcuuccaggcguucaacaccuccaacauccacuacaccgacgagcgcaucgaguggaaggaccccgacgggaugcugaaagaccaccugaacauccucgucaccaaggacaucgacuucgaaaaccugggggagaauccgugcaagguggggcuacagacggccaguaucgagggcgccugggggagcggcgugggcuucacccugaccugucagaucucccucacugagugcagccgguuccugacuuccaucaaggccugcgacauggcgauuugcuacggggcccagagcgucacccucgugcggggccagaauaccgugaagguauccgggaagggcgggcacagcggaagcucauucaagugcugccacggcaccgacugcucccagcaggggcugcaggccagcgcuccgcaccuggacaaagugaacggcauuguugagcaggaguccacgcagguuuacgacgacggggcgccccagugcggcaucagcugcugguucaucaagucaggcgaauggaucaaggggaucuuuaacggcaauuggaucgugaucgugguccucaucuucuucuuuauccugagccuuauccucuuguccuuccugugccccauccgcaagcacaagcggagcuag

SEQ ID NO: 14951 - RNA, 3402 nt, Artificial Sequence
  derived and/or modified CDS sequence (opt11) from DOBV(Ap/Sochi/hu)__JF920149.1__GP
auguggggcuugcuccugacuaugauccugauagacuucggagcgacccuccgcaacguguacgacaugcggauagaaugcccccauagcgucaacuucggagaauccagcguguccgggaagguggagcugccacccguccugcucucagagguugagacgcuggugcccgaguccagcugcaacauggacaaccaccaguccaugagcaucauccagaaggucacccagcugacauggcgcaagaaggccgacaaggcccaggccgcaaaggacuccuucgagaucaccagcggcgaggugagccugaaggggacgugcacccugacccaccgaaugguagaggacagccaccgcaaccggaaguccaucaucugcuacgaccugagcugcaacuccacccacugcaagcccacgaugcacaugaucguucccauccacagcugcaacaugaugaaguccugccucgugggccuaggccccuaccgcauccagguagucuacgagcggaccuacugcaccaccgggauccugacggagggcaagugcuucgugcccgaccaaagcaucguuaacguaaucaagaauggcguguucgauaucgccagcgugagcaucgucugcuucuucgugcggguaaagggcaccaacuacaagaucauggccagcaucaagacggcgacuuccaauaacugcaacgacacggggaacaagguccaaggcuacuaccucugcaucgugggcgggaacagcagccccguguacgucccgagcaccaccgacuuccguagcauggaggcccuggccaguaugcugcgcgcuccccauggcgaggaccacgaccucgcgggagaggaaguggcgaccuacuccaucgccggccaagucgagggcaaggugccccacacggcauccaccgccaacaugcugcugaccgcguucuccggaauccccagcuacuccucacucuccgucuucaccggcagccaggacggaccaaucgucuacucccccggccuauucccuaagcugaaccagagcuccugcgacaagguggggcucccacugaucugggagggcuacauugaccugccgggcuacuacgagacagugcaccagugcaacgucuucugcgugcucagugggcccggggccuccugugaggccuucagcgagggcgggaucuucaacaucaccagccccaacugcaugguguccaagcagaaccgguuccgcgccgccgagcagcaggucaacuucgcgugccagcggguggaccaggacaucuugauauucuguaacggucagaagaagaccaucuuaaccaagacgcucgugaucggucagugcauauacagcaucacaucccuguucagcaucaugcccggcgucgcccacuccauagccaucgaguugugcgugccgggguuccacggcugggccaccgccgcucuccugaccaccuucugcuucgggugggugcugauccccagcaucacucucgccguacugguggugcuaaaguucuuugccgccauucuccauaauuccagccaggagaaccgcuuuaagcugauccugaaaaagaucaaggaggaguucgaaaagaccaagggcuccauggucugcgaggugugcaaguacgagugcgaaaccgggaaggagcucaaggcccacaaccugagcugcccucaaucccagugccccuacugcuucacgcacugugagccgaccgagagugcguuccaggcccacuacaaggugugccaggccacccaccgguuucgggacgacuuaaagaagaccaucacuccgcaguccaccagccccggcugcuaccggacgcucaaccuguuucgcuacaaguccaggugcuacaucuucaccgucuggguggugcugcuggucguggagagcguuaugugggcagcaucugccucggagaccgucuuagagcccagcuggaaugacaaugcccacggcguugggguggucccgaugcacacggaccuggagcuggacuucuccuugcccucauccaguaaguacaccuacaagcgcaagcugaccucccccaucaaccaggagcagagcguggaccugcacaucgagaucgagucacaggggaucagcacgucugugcacgcccucggacacugguucgacggccggcugaaccuuaagacgagcuuucacugcuacggugccugcaccaaguacgaguacccguggcacaccgcgcgcugccacuucgagcgcgauuucgaguaugagaacucaugggggugcaaucccgccgacugccccggaauagguaccggcugcacggccugcgggaucuacauagaccagcucaagcccgucggcagcgcguacaagcugaucaccgugagauacucccgcaaggugugcguccaguucggcgaagagaaccugugcaagacuaucgacaugaacgacugcuucgugacgcgucaugugaaagucuguauaaucggcaccgugagcaaguucucccagggcgauacccucguguuccuagggccgauggagggcggaggccugaucuucaaggacuggugcaccucuacaugccaguucggcgaucccggggacaucauguccccuaaggacaagggcuuuagcugccccgaguucaccgggcacuuccgcaagaagugcaauuuugccaccaccccggucugcgaguacgacggcaacaugguguccggguacaagaaggugauggcgaccaucgacagcuuccaggccuucaauaccuccuccauccacuacacggaugagcggaucgaguggaaggaccccgacggcaugcucaaggaccaucugaacauccuggucaccaaggacaucgacuucgagaaccuaggcgauaaccccugcaagguggggcugcagaccgugagcaucgagggcgccuggggguccggagucgguuuuacgcugaccugccaggugagucucacagagugcucccguuuccugaccagcaucaaggccugcgacaaggccaucuguuacggugcgcaauccucaacucugauccggggucagaacaccgugaaggucuccgggaagggagggcacagcggguccagcuucaagugcugccacggcacggacugcucccagcaggggcuccaagccagcgcgccccaccucgacaagaucaacggcaucguggagcaggagaacgagaaggucuacgacgacggggcgccacagugcggcaucuccugcugguuugucaaaagcggagaguggauccagggaaucuucaacgggaacuggauugugaucguggugcugaucuucuucuucauccucucccugaucuuacucucgaucuucugccccauccgcaagcacaagcgguccuga

SEQ ID NO: 14952 - RNA, 3402 nt, Artificial Sequence
  derived and/or modified CDS sequence (opt11) from DOBV(Ap1584/Sochi-01)__EU188450.1__GP
auguggggccugcuccugaccaugaucuuaaucgacuucggggccacccuccgcaacguguacgacaugcggaucgagugcccccacagcgucaacuucggcgaguccagcguguccgggaagguggagcugccacccguccugcucagcgagguggagacgcuggugcccgaguccagcugcaacauggacaaccaccaguccaugagcaucauccagaaggucacccagcugacguggcgcaagaaggccgacaaggcgcaggccgccaaggacuccuucgagaucaccagcggcgaggugagucucaaggggacgugcacccugacccaccggaugguggaggacagccaccgcaaccggaaguccaucaucugcuacgaccugagcugcaauuccacccacugcaagcccacaaugcacaugaucgucccgauccacagcugcaacaugaugaaguccugccucgugggccugggcccuuaccgcauccagguggucuaugagcggaccuacugcaccaccgggauccugacggagggcaagugcuucgugcccgaccagagcaucgugaacgucaucaagaacggggucuucgacaucgccagcgugagcaucgucugcuucuucgugcgcgugaagggcaccaacuacaagaucauggccagcauaaagaccgcuaccuccaacaacugcaacgacaccgggaacaagguccagggcuacuaccucuguaucgugggcgggaacagcucccccguguacgucccgucgaccaccgacuuccggucuauggaggcccuggccagcaugcugcgcgcgccccacggcgaggaccacgaccucgccggagaagagguggccaccuacuccaucgccggacaggucgagggcaaggugccccacacggccaacgccgcgaacaugcugcugacagccuucagcggggugcccuccuacagcucccucagcgucuucaccggcucccaggacgggccgaucguguacagccccggucuguuccccaaguuaaaccaauccagcugcgacaagguggggcucccccugaucugggagggcuacaucgaccugccgggcuacuacgagaccguccaccagugcaacguguucugcgugcucuccgggcccggagccagcugcgaggccuucuccgagggugggaucuucaacaucacgagccccaacugcaugguaagcaagcagaaccgguuccgcgcagcggagcagcaggucaacuucgccugccaguccguggaccaggauauccugaucuucugcaacgggcagaagaagaccauccugaccaagacccucgugaucggccagugcaucuaccccaucacgagccuguucuccaucaugccgggcguggcccacagcaucgccauagagcucugcgugcccggguuccacggcugggccaccgcggcccuccugaccaccuucugcuucggcuggguccugauccccuccaucacgcucgccgugcuggugguccugaaguucuucgccgccauccuccacaacagcucgcaggagaaccgguucaagcugauccugaagaagaucaaggaggaguucgagaagaccaagggcucuauggugugcgagguguguaaguacgagugcgagaccgggaaggagcucaaggcgcacaaccuguccugcccccagagccagugcccguacugcuucacccacugcgagcccacggaguccgccuuccaggcccacuacaaggucugccaggccacccaccgcuuccgggacgaccugaagaagaccaucacgccccagagcaccucccccggcugcuaccgcacccucaaccuguuccgguacaagagccgcugcuacaucuucaccgugugggugguccugcuugugguggaguccgugaugugggcggccagcgccuccgagaccgugcuggagccgagcuggaacgacaacgcccacggcgugggggucgugcccaugcacaccgaucuggagcuggacuucagccuccccuccagcuccaaguacacguacaagcggaagcugaccagcccgaucaaccaggagcaguccguggaccugcacaucgagaucgagucgcagggcaucuccaccagcguccacgcccucgggcacugguucgacggccgccugaaccugaagacguccuuccacugcuacggcgcgugcacgaaguacgaguaccccuggcacaccgcccggugccacuucgagagagacuucgaguacgagaacagcugggggugcaaccccgccgacugccccggcaucgggaccggcugcaccgccugcgggaucuacaucgaccagcucaagccggugggcuccgccuacaagcugaucacgguacgcuacagccggaaggucugcgugcaguucggcgaggagaaccugugcaagaccaucgacaugaacgacugcuucgugaccagacacgucaaggugugcaucaucgggaccguguccaaguucagccagggggacacgcucguguuccuggggcccauggagggcggaggccugaucuucaaggacuggugcaccuccacgugccaguucggagaccccggggacaucaugagccccaaggacaagggcuucuccugcccggaguucaccgggcauuucaggaagaagugcaacuucgcgaccacccccgugugcgaguacgacggcaacauggugagcggcuacaagaaagucauggccaccaucgacuccuuccaggccuucaacaccucgagcauccacuacacggacgagcgcaucgaguggaaggaccccgacggcaugcucaaggaccaccucaacaucuuagugaccaaggacaucgacuucgagaaccucggcgacuccccuugcaagguggggcugcagaccgucuccaucgaaggcgcuuggggguccggcgugggauucacccucacgugccaggugagccucaccgagugcucccgguuucugaccagcaucaaggccugcgacaaggcaaucugcuacggcgcccaauccagcacccugauccgcggccagaacacggucaagguguccgggaagggcgggcacagcggcuccagcuucaagugcugccacggcaccgacugcucccagcaggggcuccaggccagcgccccgcaccuggacaagaucaacggaaucgucgagcaggagaaugagaagguguacgacgacggggcgccucagugcggcaucuccugcugguucgucaagagcggggaauggauccagggcaucuucaacggcaacuggaucgugaucgugguacugaucuucuucuucaucuugucccugauccugcucucaaucuucugccccauucggaagcacaagcgcuccuaa

SEQ ID NO: 14953 - RNA, 3408 nt, Artificial Sequence
  derived and/or modified CDS sequence (opt11) from DOBV(GER/05/477/Af)__GQ205411.1__GP
augaucauguggggccugcucuuaacccugagccucaucaaccugggggccucccugcgcaacguguacgacaugaagaucgagugcccgcauagcaucaacuucggcgaguccagcgucaccgggaagguggagcucccgccccugcugcucacggacgccgaggcccuggugcccgaguccagcugcaacauggacaaccaccagucccugagcaucacccagaaggucaccaagguguccuggcggaaaaaggccgacaaggugcaggccgccaaagacagcuucgagaccacguccagcgaggucaacuucaaggggaccugcacccucacccaccgcaugguggaggaguccuaccggaaccgcaagagcgugaucuguuacgaccuguccugcaacagcacgcacugcaagcccaccaugcacaugaucgucccggugcacuccugcaacaugaugaaguccugccugguggggcucggccccuaccgcauucaggucguguacgagagaaccuacugcaccacgggcauccugaccgaggggaagugcuucgugccagaccaguccaucaucagcguccugaagaacggcguguucgacaucgccagcguguccauagucugcuucuucauccggaucaaggggaccagcuauaagaucaugaccuccaucaaggaggcgaaccccaacaauugcaacgacacggacaauaaggugcagggcuacuaucucugcaucgugggggccaacagcuccccgguuuacgcccccagcaccaccgacuuccgcuccguggaggcccuggcgagccugcuccggagcccccacggcgaggaccacgaccuggccggcgaggagguggccaccuacagcaucgccgggcaggucgaggggaaggugccccacacggccaacgcggccaacaugcuguucaccgccuucuccgggaucccgagcuacuccagcuucuccgucuuuaccggcaaccaggagggcaacgugaucuacagccccggccucuuccccaagcugaaccaguccagcugcgagaagguggcccugccccucaucugggagggcuacaucgaccugccgggguacuacgagaccguccaccccugcaacguguucugcgugcuguccggccccggggccagcugcgaggcguucagcgagggcggcaucuucaacaucacguccccgaccugccucgucagcaagcagaaccgcuuccgggcagcagagcagcagaucaacuucgugugccagcgcguggaccaggacaucgucaucuacugcaacgggcagaagaagacuauccugaccaaaacgcuggugaucgggcagugcaucuacuccgugaccagccucuucuccaucaugcccggugucgcccacagcaucgccaucgagcugugcguccccggcuuccacgggugggcgacagccgcccugcucaccacguucugcuucggcuggauccugauccccuccauuacccuggccauccucaucauccuuaaguucuucgccgcgcuauuccacaacagcucccaggagaaccgguucaagaucauccucaagaaaaucaaggaggaguucgagaagaccaagggcagcauggugugcgagguaugcaaguacgagugcgagaccgggaaggagcugaaggcccacaaccuguccugcccccagagccagugcccuuacugcuucacgcacugcgagcucaccgaguccgccuuccaggcccacuaccgcgugugccaggcgacccaucgcuucagagacgaccugaagaagaccaucacgccccagagcacgucccccggcugcuaccggacccugaaccucuuccgcuacaagagccggugcuacaucuucaccgugugggucauccugcugaucaucgaguccauccugugggccgccagcgccagcgagaccgugcucgagcccuccuggaacgacaacgcccacggggugggcgucgugccaaugcacacggaccuggagcuggacuucagccucccauccagcuccaaguacaccuacaagcgcaagcugaccagccccaucaaccaggagcaguccguggaccugcacaucgagaucgagagccaggggaucuccaccagcguccacgcgcucggccacugguucgacggccggcugaaccuaaagacguccuuccacugcuacggggccugcaccaaguacgaguacccguggcacaccgccaagugccacuucgagcgcgacuucgaguacgagaacagcugguccugcaaccccgccgacugccccggcaucgggaccggcugcacggccuguggccuuuaccuggaccagcucaagcccgucgggagcgccuacaagcucaucaccgugcgcuacucgcggaaggucugcgugcaguucggcgaggagaaccugugcaaaaccaucgacaugaacgacugcuucgugacccgccacgucaaggugugcaucaucgggacggugagcaaguucucccagggcgacacccuggucuuccucgggccgauggagggcggcgggcugaucuucaaggacuggugcaccaccacgugccaguucggcgaccccggggauaucaugagucccaaggauaagggcuucuccugccccgacuuuaccgggcacuuccggaagaagugcaacuucgccaccaccccggugugcgaguacgacggcaacauggugagcggcuacaagaaggucauggccacgauugacagcuuccaggccuucaacaccuccaacauccacuacaccgacgagcgcaucgaguggaaggaccccgacgggaugcugaaggaccaccucaacauccuggugaccaaagacaucgacuucgagaaccugggcgagaaccccugcaagguggggcuccagacggccagcaucgacggcgcguggggguccggcguuggauucacccugaccugccagaucagccuuaccgagugcucccgguuccucacgagcaucaaggccugcgacauggccaucugcuacggggcccaguccgugacccugguccggggccagaacaccguccgggugagcgggaagggcgggcacuccggcagcuccuuuaagugcugccauggcacugacugcagccagcaggggcugcaggcguccgcgccccaccucgacaaggugaacggcaucgucgagcaggagagcacccagguguacgacgacggggccccgcagugcggaaucuccugcugguucgucaaaagcggcgaguggaucaaggggaucuuuaacggcaacuggaucgugauaguugugcugaucuuccuguuccuccugucccugauccuccugagcuuccugugccccauccgcaagcacaagcgguccuga

SEQ ID NO: 14954 - RNA, 3408 nt, Artificial Sequence
  derived and/or modified CDS sequence (opt11) from DOBV(GER/07/607/Af)__GQ205410.1__GP
augaucauguggggccugcucgugaccuuaagccugaucaaccucggggccucccugcgcaacgucuacgauaugaagaucgagugcccccacagcaucaacuucggcgaguccagcgugaccgggaagguggagcugccgccccucccccugacggacgccgagacccugguccccgaguccucgugcaacauggacaaccaccagucccucagcaucacccagaaggugaccaagguguccuggcggaagaaggccgacaagguccaggccgccaaggacagcuucgagacgaccuccagcgagaugaaccugaaggggaccugcacccugacgcaccgcaugguggaggaguccuaccggaaccgcaagagcgugaucugcuacgaccucuccugcaacagcacccacugcaagccgaccaugcauaugaucgucccggugcacuccugcaacaugaugaaguccugccuggugggccugggccccuaccggauccaggucguguacgagcgcaccuacugcacgaccggcauccucaccgaggggaagugcuucgugcccgaccaguccaucaucagcgucaugaaaaacggcguguucgacaucgccagcguguccaucgucugcuucuucauccggaucaaggggaccagcuacaagaucaugacgucaaucaaggaggccaacccgaacaacugcaacgacaccgacaccaaggugcagggcuacuaccugugcaucgugggggcgaacagcucccccgucuaugcacccagcaccacggacuuccgcaguguggaggcucuggccagccuccugcggagcccccacggcgaggaccacgaucuggcgggcgaggaggucgccaccuacagcauugccgggcagguagagggcaaggugccgcacaccgcgaacgccgcgaacaugcuguucaccgccuucuccgggauccccagcuacuccagcuucuccgucuucacgggcaaccaggacggcaccgugaucuacagcccaggccucuuccccaagcugaaccaguccagcugcgacaagguggcccucccgcuaaucugggagggguacaucgaccugcccggguacuacgagaccguccaccccugcaacguguuuugcgugcucuccggcccuggggccagcugcgaggccuucagcgagggcggcaucuucaacaucaccuccccgacgugccuggucagcaagcagaaccgcuuccgggcggccgagcagcagauuaacuucgugugccagcgcguggaccaggacaucgucaucuacugcaaugggcagaagaagaccauccuaaccaagacccucgugaucggccagugcaucuacuccgugacgagccuguuuuccaucaugcccggggucgcacacagcaucgccaucgagcugugcgugcccggcuuccacgggugggccaccgcggcacugcugaccaccuucugcuucggcuggauccugauccccuccaucacgcucgccauccugaucgugcugaaguucuucgccgcacuccugcacaacagcucccaggagaaccgguucaagaucaucuuaaagaagaucaaggaggaguuugagaaaaccaagggcagcauggucugcgaggugugcaaguacgagugcgaaaccgggaaggagcucaaggcucacaaccuguccugcccgcagagccagugccccuacugcuucacccacugcgagcugaccgaguccgccuuccaggcccacuaccgcgugugccaggccacgcaccgguuccgcgacgaccucaagaagaccaucacgccccagagcaccucccccggcugcuaccggacccugaaccuguuccgcuacaagagccggugcuacaucuucaccgucugggugauccuccugauuaucgaguccauccugugggcggccagcgccagcgaaaccgugcuggagccguccuggaacgacaaugcccacggggucggcguggugccuaugcacgccgaccucgagcuggacuucagccugcccuccagcuccaaguacaccuacaagcgcaagcucacaagcccgauaaaccaagagcaauccgucgaccugcacaucgagaucgagagccaggggaucuccaccagcgugcacgcgcugggccacugguucgacggccggcucaaccugaagaccuccuuccacugcuacggggccugcaccaaguacgaguaccccuggcacacggccaagugccacuucgagcgcgacuucgaguacgagaacagcugguccugcaaccccgccgacugccccggcauagggaccggcugcaccgcuugcggccuguaccucgaccagcugaagcccguggggagcgcguacaagcugaucaccguccgguacucccggaaggugugcgugcaguucggcgaggagaaccucugcaagacgaucgauaugaacgacugcuucgucacccgccacgugaaggugugcaucaucggaaccgucagcaaguucucccagggcgacacccugguguuccuggggcccauggagggcggcgggcucaucuucaaggacuggugcacgacgaccugccaguucggggaccccggggacaucaugagccccaaggacaagggcuucuccugcccggacuucaccgggcacuuccggaagaagugcaacuucgccaccacccccgugugcgaguacgacggcaacauggucagcggauacaagaaggugauggccaccaucgacagcuuccaggccuucaacaccaguaacauccacuacacggacgagaggaucgaguggaaggaccccgacggaaugcugaaggaccaccugaacauucucgugaccaaggacaucgacuucgagaaccugggcgagaaccccugcaaggucgggcugcagaccgccagcaucgacggcgcguggggguccggcgugggcuucacccucacgugccagaucagccugaccgagugcucccgauuccugaccagcaucaaggccugcgacauggccaucugcuacggggcccaguccgugacccucguccgcggccagaacacggugaaggugagcgggaagggcgggcacuccggcagcuccuucaagugcugccacggcaccgacugcagccagcaggggcugcaggcguccgccccgcaccuggacaaggucaacggcaucguggagcaggagagcacccagguguacgacgacggggcgccccaguguggcaucuccugcugguucgucaagagcggcgaguggaucaaggggaucuucuccggcaacuggaucgugaucgugguccucaucuuccuguuccugcucagccugauccugcucuccuuccugugccccauccggaagcacaagcgcagcuga

SEQ ID NO: 14955 - RNA, 3408 nt, Artificial Sequence
  derived and/or modified CDS sequence (opt11) from DOBV(GER/08/118/Aa)__GQ205412.1__GP
augaucauguggggacugcucguaauccugagccugauuaaucuuggggccucccugcgcaacgucuacgacaugaagaucgagugcccccacagcaucaacuuuggcgaguccagcgugaccgggaagguggagcugccgccccucccccugaccgacgccgagacgcugguucccgaguccagcugcaacauggacaaccaccagucccucagcaucacccagaaggugaccaaggucuccuggcggaagaaggcggacaagguccaggccgcgaaagacucauucgaaaccacguccagugagauuaaccugaaggggaccugcacccugacucaccgcaugguggaggaguccuaccggaaccgcaagagcguaaucugcuacgaccucuccugcaacagcacgcacugcaaaccgaccaugcacaugaucguccccgugcacuccugcaacaugaugaaguccugccugguaggccugggccccuaccggauccaggugguguacgagcgcaccuacugcaccacgggcauccucacugaggggaagugcuucguucccgaccaguccaucaucagcgucaugaagaacggcguguucgacaucgccagcguguccaucgucugcuucuucauccggauaaaggggaccagcuacaagauuaugacuuccaucaaggaggccaacccgaacaacugcaaugacacagacaacaaagugcagggcuacuacuuaugcauagugggggcgaacagcucccccguguacgcgcccagcaccaccgacuuccgauccguggaggcccuggccagccuccuucggagcccccacggcgaggaccaugaccuggcgggcgaggagguggccaccuacagcaucgccgggcaggucgacggcaaggugccgcacacggccaacgccgcgaacaugcuguuuaccgccuucuccgggaucccaagcuacuccagcuucuccgucuucaccgguaaccaagacggcacagugaucuacagccccggccucuuccccaaacugaaucaguccucuugcgacaagguggcccucccgcugaucugggagggguacaucgaccugcccggguacuacgagacgguccaccccugcaacguguucugcgugcucuccgggcccggugccagcugcgaggccuucagcgaagggggcaucuucaacaucaccuccccgaccugucuggucagcaaacagaaccgcuucagagcggccgagcagcagaucaacuuugugugccagcgcguggaccaggacaucgucaucuacugcaaugggcagaaaaagaccauacugacgaagacccuggugaucggccagugcaucuacuccgugaccagccuguucuccaucaugcccggggucgcccacagcaucgccaucgaacugugcgugcccggcuuccacgggugggccaccgcugcccuccugacgacauucugcuucggcuggauccugauccccuccauaacccucgccauccugauaguucugaaguucuucgccgcccuccugcacaacagcucccaggaaaaccgguucaagaucauccugaagaagauuaaggaggaguucgagaagaccaagggcagcauggucugcgaggugugcaaguacgagugcgagacggggaaggagcucaaagcgcacaaucuguccugcccgcagagccagugccccuacugcuucacccacugugagcugaccgaguccgccuuccaggcccacuaccgcgugugccaggccacccaccguuuccgcgacgaccucaaaaagaccaucacgccccagagcacaucccccggcugcuaccggacccugaaccuguuccgcuacaagagcagauguuacauauucaccgucugggugauccuccugaucaucgaguccaucuuaugggcggccagcgccagcgagacgauccuggagcccuccuggaaugacaacgcccacggggugggcgucgugcccaugcacacagaccucgagcuagacuucagccugcccuccucuuccaaauacaccuauaagcgcaagcucaccagcccgaucaaccaggagcaguccguggaccugcacauagagaucgaaagccaagggaucuccacgagcguacaugcccucggccacugguuugauggccggcucaaccugaagaccuccuuucacugcuacggggcaugcaccaaguacgaguaccccuggcacacugccaaaugccacuucgaacgcgacuuugaauacgagaacagcugguccugcaaccccgccgacugccccggcaucgggacgggcugcaccgcuugcggccuguaccucgaccagcugaagccgguggggagcgccuacaagcugaucaccgugcgcuacucccggaaggucugcgugcaguuuggcgaggagaaucucuguaagaccauagacaugaacgacuguuucgugacgcgccacgucaaggugugcaucaucgggaccgugagcaaguucucccagggugacacccuggucuuccuggggcccauggagggcggcggauuaaucuucaaggacuggugcaccacgacaugucaguucggugaccccggggacaucaugagccccaaggacaagggcuucuccugcccggacuucaccggucauuuccggaagaagugcaacuucgcgaccacgcccgugugcgaguacgacggcaacauggugagcggcuacaagaaggucauggccacgaucgacucguuccaagccuucaacaccuccaacauccacuacaccgacgagcgcaucgagugggaggaccccgaugggaugcugaaggaccaccugaacauucucgugacgaaagauaucgacuucgagaaccugggcgagaaccccugcaaaguggggcugcagaccgccagcaucgacggcgccuggggcuccggcguaggcuucacccugaccugccagauuagucucacggagugcucccgguuccugaccagcaucaaggcgugcgacauggccaucuguuacggggcccaguccgugacccuagugcgcggccagaacaccgucaaggugagcgguaagggcgggcacuccggcagcucauuuaagugcugccacggcacggauugcagccaacaggggcugcaggcauccgcgccgcaccuggauaaggugaacggcaucgucgagcaggagagcacacagguguacgacgacggcgcgccucagugcgguaucuccugcugguucgucaagagcggggaguggaucaaggggguguucuccggcaacuggaucgugaucgugguccucaucuuccuguucuuacucagcuuaauccugcucuccuucuugugccccauccggaaacauaagcgcagcuga

SEQ ID NO: 14956 - RNA, 3408 nt, Artificial Sequence
  derived and/or modified CDS sequence (opt11) from DOBV(GER/08/131/Af)__GQ205413.1__GP
augaucauguggggccugcuccugacccugagccucaucaaccugggggccucccuacgcaacguguacgacaugaagaucgagugcccccacagcaucaacuucggcgagucuagcgucaccggaaagguggagcuuccgccccugcugcucacggacgccgagacccugguucccgaguccagcugcaacauggacaaccaccagucccugagcaucacccagaaagucaccaaaguguccuggcggaagaaggcggacaaggugcaggccgccaaggacagcuucgagacgaccuccagcgaggucaaccucaaggggaccugcaccuuaacgcaccgcaugguggaggaguccuaucggagccgcaaguccgugaucugcuacgaccugucaugcaacuccacccacugcaagcccaccaugcacaugaucgucccggugcauagcugcaacaugaugaaguccugccucguggggcugggccccuaccggauccaggucgucuacgagcgcaccuacugcacgaccggcauccugaccgaggggaagugcuucgugcccgaccagagcaucaucagcgucaucaagaauggcguguucgacaucgccuccguaucaaucgucugcuucuucauccggaucaaggggaccuccuacaagaucaugacgagcaucaaggaguccaaccccaacaacugcaacgacaccgacaacaagguacagggcuacuaccucugcaucgugggggccaacagcuccccggucuacgcgcccagcaccaccgacuuccgcuccguggaggcccuggccagccugcuccgaucccccuacggcgaggaccacgaccuggccggcgaggagguggcgacguacagcaucgcagggcaggucgagggcaaggugccccacaccgccaaugccgccaacaugcuguucaccgcguucuccgggaucccgagcuacuccagcuucuccgucuucaccggcaaccaggacggcaacgugaucuacagccccggccuguuccccaagcugaaucaguccagcugcgagaagguggcccugccccucaucugggagggcuacaucgaccugccgggguacuacgagacgguccaccccuguaacguguucugcgugcugagcggccccggggccuccugcgaggccuucagcgagggcggcauauucaacaucacguccccgaccugccucgucagcaagcagaaccgcuuucgggccgcggagcagcagaucaacuucgugugccagcgcguggaucaggacaucgugaucuacugcaacgggcagaagaagaccauccugacgaagacucuggugaucggccagugcaucuacuccgugaccagccucuucuccauuaugcccgggguggcccacagcaucgccaucgagcugugcguucccggcuuccacgggugggccaccgccgcgcugcucacgaccuucugcuucggcuggauccugaucccguccaucacccuggccauccucaucgugcugaaguucuucgccgcccugcuccacaacagcucccaagagaaccgguucaagaucauccugaagaagaucaaggaggaguucgagaagaccaagggcagcaugguuugcgaggucugcaaguacgagugcgagacggggaaggagcugaaggcccacaaccuauccugcccccagagccagugcccguacugcuucacccacugcgagcugaccgaguccgcguuccaggcccacuaccgcgugugccaggccacccaccgguuccgcgacgaccugaagaagaccaucacgccccagagcaccucccccggcugcuaccggacccucaaccucuuccgcuacaagagccggugcuacaucuucaccgucugggugauccugcugaucaucgagagcauucucugggccgcguccgccagcgagaucgugcuggagcccucguggaacgacaacgcccacggggucggcguggugccgaugcacacggaccuggagcucgacuucagccugcccuccagcucaaaauacaccuacaagcgcaagcugaccagccccauaaaccaggagcaguccgucgaccuccacaucgagaucgagagccaggggaucuccaccucagugcacgcccugggccacugguucgacggccgguuaaaccucaagacguccuuccacugcuacggggccugcaccaaguacgaauacccguggcacaccgcgaagugccacuucgagcgcgacuucgaguacgagaacagcugguccugcaaccccgccgacugccccggcaucgggaccggcugcacggccugcggccuguaccuggaccagcucaagcccguggggagcgccuacaagcugaucaccguccgcuacagucggaaggugugcgugcaguucggcgaggagaaccugugcaagaccaucgacaugaacgacugcuucgucacucgccacgugaagguaugcaucauugggacugucuccaaguucucccagggcgacacccucguauuccuggggccgauggagggcggcggccugaucuucaaggacuggugcaccaccacgugccaguucggcgaccccggggacaucaugucccccaaggacaagggcuucagcugccccgacuucaccgggcacuuccggaagaagugcaacuucgccacuaccccggugugcgaguacgacggcaauaugguguccggcuacaagaaggugauggcgacgaucgauucguuccaggccuuuaacaccuccaacauccauuacaccgacgagcgcaucgaguggaaggacaccgacgggaugcucaaggaccaccugaacauccuggugacgaaggacaucgacuucgaaaaccucggcgagaaccccugcaaggucgggcugcagaccgccuccaucgacggcgccugggggucaggcgugggcuucacccugaccugccagaucagccucacggagugcagucgguuccugaccagcaucaaggccugcgacauggcgaucugcuacggggcccaguccgugacccugguccgcggccagaacaccgugcgggugagcgggaagggcgggcacuccggcucguccuucaaguguugccacggcaccgacugcagccaccaggggcuccaggccuccgccccgcaccuggacaaggucaacggcauuguggagcaggagagcacccagguguacgacgacggugcgccccagugcggcaucuccuguugguucgucaagagcggcgaguggaucaaggggaucuucuccggcaacuggaucgugaucgugguccugaucuuccucuuccugcugagccucauccugcugagcuuccucugccccauccgcaagcacaagcgguccuga

SEQ ID NO: 14957 - RNA, 3408 nt, Artificial Sequence
  derived and/or modified CDS sequence (opt11) from DOBV(GRW/Aa)__JQ026205.1__GP
augaucauguggggccugcuccugacccugagccucaucaaccugggcgccagucugcgcaacguguacgacaugaagaucgagugcccccacagcaucaacuucggcgaguccagcgucaccgggaagggcgaacucccgccccugcugcucacggacgccgagacccugguccccgaguccagcugcaauauggacaaccaccagucccugaguaucacccagaaggugaccaaggucuccuggcggaagaaggcagacaaggugcaggccgccaaggacagcuucgagacgaccuccagcgaggugaaccucaaggggacuugcacccugacgcaccgcauggucgaggaguccuaccggagccgcaaaucagugaucugcuacgaccugagcugcaacucuacccauugcaagcccaccaugcacaugaucgugccgguccacagcugcaacaugaugaaguccugccucgucggccugggcccuuaccggauccagguggucuacgagcgcaccuacugcacgacagggauccugaccgagggcaagugcuucgugcccgaccagagcaucaucagcgugaucaagaacggggucuucgacaucgccuccgugagcaucgugugcuuuuucauccggaucaaggggaccuccuacaagaucaugacgagcaucaaggaguccaaccccaacaacugcaacgacacagacaacaagguccagggguacuacuugugcaucgugggcgccaacagcuccccgguuuacgcgcccagcaccaccgacuuccgguccgucgaggcucuggccagccugcuccggucccccuacggcgaggaccacgaccuggccggggaggagguggcgacuuacagcaucgccggccagguggaagggaaggucccccacaccgccaacgccgccaacaugcuguucaccgcguucuccggcaucccgagcuacuccagcuucuccguguucacuggaaaccaggacgggaacgucaucuacagccccggccucuuucccaagcucaaccaguccagcugcgagaaagucgcccugccccucaucugggagggguacaucgaccugccgggcuacuacgaaacggugcaccccugcaacgucuucugcgugagcuccgggcccggcgccagcugugaggcuuucuccgaaggcggaaucuucaacaucaccagccccacgugccugguguccaagcagaaccgcuuccgggccgcggagcaacagaucaacuucgucugccagcgcguggaccaggacaucgugauuuacugcaacggccagaagaagaccauccucacgaagacccuggucaucgggcagugcaucuacagcgugaccucccuguucagcaucaugccgggcguggcucacaguauagccaucgagcugugcguccccggguuccauggcugggccaccgccgcgcugcugacaaccuucuguuucggcuggauccuaauccccagcauaacccuggcuauccugaucgugcucaaguucuucgccgcccugcugcacaacuccagccaggagaaccgguucaagaucauccucaagaagaucaaggaggaguucgagaagaccaagggguccauggugugcgaggucugcaaguacgagugcgagacgggcaaggagcugaaggcccacaaccugagcugcccccaaucccagugcccguacugcuucacccacugcgagcucaccgagagcgcguuccaggcccacuaucgcgugugccaggccacccaccgguuccgcgacgaccugaagaagaccaucacgccccaguccaccagccccgggugcuaucggacccugaaccucuuccgcuacaagagccggugcuauaucuucaccgugugggucauccuucugaucaucgaguccauccugugggccgcgagcgccuccgagaucgugcucgagcccagcuggaacgacaacgcucacggcgugggggucgugccgaugcacacggaccuggagcuggacuucucccuccccagcuccagcaaguacaccuacaagaggaagcugaccucccccaucaaccaggagcaaaguguggaccugcacaucgagauagagucacagggcaucagcaccuccguccacgcccucggccacugguucgacgggcggcugaaccugaagacgucguuccacugcuacggcgccugcaccaaauacgaguacccguggcacaccgcgaagugccacuucgagcgcgacuucgaguacgagaacuccuggagcugcaaccccgccgacugucccgggaucggcaccggcugcacggccugcgggcucuaccuggaccagcugaagcccgugggcuccgccuacaagcucauaaccguacgcuacagccggaaggucugcgugcaguucggagaagagaaccugugcaagaccaucgacaugaacgacugcuucgugacccgccacgucaaggugugcaucaucggcacgguguccaaguucagccagggggacacccuggucuuccucgguccgauggagggcgggggccugaucuucaaggacuggugcaccaccacgugccaguucggggaccccggcgacaucaugucacccaaggacaagggguucuccugcccggacuucaccggccacuuccggaagaagugcaacuucgccaccacuccggugugcgaguacgacggaaacauggugagcggguacaagaaggucauggcgacgaucgacuccuuccaggccuucaacaccucgaacauccacuacaccgacgagcgcaucgaguggaaggaccccgacggcaugcugaaggaccaccucaacaucuuggugaccaaggacaucgacuuugagaaccugggugagaaccccugcaaggugggccuccagacggcuuccaucgacggggccuggggcagcggcgucggguucacccugaccugccaaaucucccugaccgagugcagccgguuccucacguccaucaaggccugcgacauggcgaucugcuacggcgcccagagcgugacccuggugcgcgggcagaacaccguccggguguccggcaagggcgggcacagcggcuccuccuucaagugcugccacgggaccgacugcucccaccagggccugcaggcgagcgcgccccaccucgacaaggugaacgggauaguagagcaggaguccacccagguguacgacgacggcgccccgcagugcggcaucagcugcugguucauuaaguccggggaguggaucaagggcaucuucagcgggaacuggaucgugaucgucgugcugaucuuccuguuccuccugagccugauccuccucuccuuccugugccccauccgcaagcacaagcggagcuga

SEQ ID NO: 14958 - RNA, 3408 nt, Artificial Sequence
  derived and/or modified CDS sequence (opt11) from DOBV(Slo/Af-BER)__GU904035.1__GP
augauaauguggggcuugcuccugaccaugauccugaucgacuucggggccagccuacggaacguguacgacaugaagaucgaaugcccccacuccaucaauuucggcgagagcuccgucaccgggaagguggaacuaccuccccuacuccugacggacgcggaggccuuagugcccgagagcuccuguaacauggacaaccaccagagcauguccauaauccagaaggucaccaaaguguccuggcggaagaaagccgacaaggcccaggcagcgaaggacuccuucgagaccaccucguccgagguaaacuuaaaaggcacgugcacccugagccaccgcaugguagaggaauccuaccgaaaucgccguagcgugaucugcuacgacuuguccugcaacagcacccacugcaagcccaccaugcacaugauagugcccgugcacuccugcaacaugaugaaguccugcuuagucggacugggaccuuaucgcauccaagugguguacgagcggacguauugcacaacaggcauccucaccgagggcaaaugcuucguccccgaccagagcaucguuagugucaucaagaauggaguauucgacaucgcgucaguauccaucgugugcuucuucauuagagugaaggggacgaacuacaagaucauggccagcauaaaaaccgcgacugccaacaacugcaacgacacugauaacaaggugcaaggcuacuaccucuguaucgucgggggaaauuccucgcccguguacgcgcccuccacaacugacuuccguagcauggaggccuuagcgagcuugcuccgcgcaccccacggcgaggaccacgaccugucaggggaagagguggccacguacucgauagccggccagaucgaggggaaaaucccccacaccgcuaacgccgccaauauguuauucaccgccuucagcggcauuccuaguuacucuagucucagcguauucaucggcucucaggacgggccgaucauauauagccccggccucuuccccaaacugaaucagaguagcugcgacaagguggcccugccccuaaucugggaggguuacaucgaccugccaggcuacuacgaaacaguccaccccuguaacguauucugcgugcuuuccgggccaggugccaguugcgaggccuucagcgagggcgggauauuuaacaucaccuccccaaccugccuggucagcaaacagaaccgguuucgggcagccgagcagcaggucaauuucgugugccaacggguggaccaggacaucaucaucuacugcaauggccagaagaagacgauccugaccaagaccuugguaauagggcaguguaucuacuccgugaccucgcuauuuucaauaaugcccggcgucgcgcacagcaucgccaucgagcugugugugcccggguuccacgguugggcuacugccgcccuccugaccacauuuugcuucggcuggauccugaucccuuccaucacuuuggcgguccucguggugcuuaaguucuucgccgccauccuccacaacucuucacaggagaaccgcuucaagaucauccugcggaagauaaaagaggaguucgagaagacgaaaggaagcauggugugcgaagucugcaaguacgaaugcgagacagggaaggaauugaaggcccacaaucucaguuguccacagagccagugcccauacuguuucacgcacugcgagcccacggaaagugcguuccaggcacacuacaaggugugccaggccacgcaccgcuuuagagacgaccugaagaagaccauuacgccacagucaaccucuccgggcuguuaccgcacccuuaaccucuuucgguacaagagccgcugcuauaucuucaccgucugggucaccuuacugaucaucgaguccaucaugugggcagccucagcgagcgagaaugugcuggagccgagcuggaacgacaacgcccacggcguuggggucguccccaugcacaccgacuuagaguuagacuucagccugcccuccuccucgaaguacacguacaagcgaaaguuaacaagcccguugaaccaagagcagucaguagaccuacacaucgagaucgagagccagggaauuucaacgagcgugcacgcccugggccacugguucgacgggcgccugaaccugaagacauccuuccacugcuacggcgccugcaccaaguacgaguaccccuggcacacggccaagugccacuucgaacgcgacuucgaguacgagaacagcugggggugcaaucccgcggauugucccgguaucggcaccggguguacagcguguggccucuacaucgaccaacuaaagccgguggguucugccuacaaauuaaucaccguacgguacagccgcaaggucugugugcaguucggcgaggaaaaccucugcaagacuaucgacaugaaugacugcuucgugacccgccacgucaaaguguguaucaucgggaccguguccaaauuuagccagggcgacacccuggucuuccuaggccccauggagggcggaggccucaucuucaaggacuggugcacguccacgugccaguucggggaccccggggacaucaugagcccuaaggacaagggauucagcugcccggacuuuaccggccacuuccgaaagaaaugcaacuucgcgaccaccccggugugcgaauaugacgggaacauggucucgggauacaagaaagucauggcaaccauagacagcuuucagucauucaacacuuccuccauucacuauaccgacgaacggauagaguggaaagaccccgacgggaugcugaaagaccaccugaauauccucgugacgaaagacaucgauuucgagaaccugggggagaaccccuguaaagucgggcuccagacgucuucgaucgagggcgcguggggcucggggguaggguuuacccuaaccugccagaucucucucacggaguguagcagguuucugaccuccaucaaggccugcgacauggcaaucugcuacggagcccaaagcgugacccucauccggggccagaacacggugaaggugagugggaagggcggacacagcgguuccucauucaaauguugucauggcacugacugcucccagcagggauugcaagcgagcgccccgcaccucgacaaggugaacggcaucguggagcaagacucggagaagguuuacgacgacggcgcaccccagugcggcaucucgugcugguucgugaaaucaggagaguggauuacugggaucuucaacggaaauuggaucgugaucgucguucucguguucuucuucauccugagccugauucugcucagucuucucugcccgauccgcaagcacaagcggucauga

SEQ ID NO: 14959 - RNA, 3408 nt, Artificial Sequence
  derived and/or modified CDS sequence (opt11) from HTNV(76-118/POR)__KT885048.1__GP
augggcaucuggaaguggcuggugauggcaagccucgucuggcccgugcuuacccugcgcaacguguaugacaugaagaucgagugcccgcacacagucuccuucggggguaacagcguuaucggguacguggagcucccgcccguccccuuggccgacacggcgcagaugguccccgagucaucgugcuccauggacaaccaccagagccugaacacaaucaccaaguacacccagguguccuggcggggcaaggcggaccagagccaguccagccagaacuccuucgagacggucagcacagagguggaccucaaggggaccuguguacugaagcacaagauggucgaggaguccuaccgcagccggaaguccgugaccugcuacgaccugagcugcaacuccacauacugcaagcccacccucuacaugaucgugcccauccacgccugcaacaugaugaagucuugccugauagcacugggccccuaucgcguccaggugguuuacgagcggacguacugcaugaccggcguccucaucgagggcaagugcuucgugccggaccaguccguggucaguaucaucaaacacggcaucuucgacaucgccagcgugcacaucguuugcuucuucgucgcuguuaagggaaacacguacaagaucuucgagcaggucaagaaguccuucgagagcacaugcaacgacaccgagaacaaggugcaaggcuacuacaucugcaucgucgggggcaacuccgcucccaucuacgugcccacccuggacgacuuccgcagcauggaggccuucacagggaucuuccggagcccccacggggaggaccacgaccuggccggcgaggagaucgcgagcuacuccaucguggggccggccaacgccaaagugccccacagcgccagcagcgacacccuccgccugauagccuacuccggcauccccagcuacuccagcuuguccauccucaccagcuccaccgaggcgaagcacgucuucagccccggccuguucccgaagcugaaccacacgaacugcgacaaguccgccaucccccucaucuggaccgggaugaucgaccugcccggcuacuacgaggccguccaccccugcacaguguucuguguccugagcgggccaggcgccuccugcgaggccuucuccgagggcggaaucuucaacaucaccagcuccaugugccucguguccaagcaaaaccgguuccgccugaccgagcaacaggucaacuucgugugucagcggguggacauggacaucgucgucuacuguaauggccagcgcaaggugauccugacuaagacccucgugaucgggcagugcaucuacaccaucacgucccuguucagccugcuccccggcguagcgcacuccaucgccguggagcugugcgugcccggguuccacggcugggccacggcggcccugcucgucaccuucugcuucgggugggugcuuauccccgcgaucaccuucaucauccugacggugcucaaguucaucgccaacaucuuccacacgagcaaccaggagaaccgucugaaguccguccugcggaagaucaaggaggaguucgaaaagaccaagggcucaauggugugcgaugugugcaaguacgagugcgagaccuacaaagagcucaaggcccacggcguauccugcccgcagagucagugccccuacugcuucacgcauugcgagcccaccgaggccgccuuccaggcgcacuauaaggugugucaggugacccaccgguuccgcgacgaccugaagaagaccgucacaccccagaacuucaccccgggcugcuaccggacccugaaccucuuccgcuacaagucccggugcuacaucuucaccauguggaucuuccugcuggugcucgaaagcauccugugggccgccuccgccagcgagacgcccuugacccccguguggaacgacaacgcgcacggcgucggguccgugccgaugcacaccgaccucgagcuggacuucagccugacuagcuccagcaaguacaccuaccggcgaaagcugacgaacccccucgaggaggcccaguccaucgaccugcacaucgagaucgaggagcagacgaucggcguggacguccacgcccuggggcacugguucgacggccggcucaaccugaagaccagcuuccacugcuacggcgccugcacgaaguaugaguaucccuggcacacggccaagugccacuacgagcgcgacuaccaguacgagaccuccuggggaugcaaccccagcgauuguccgggcguggggaccggcuguaccgcgugcggccuguaccucgaccagcugaagcccgugggguccgccuacaagaucaucacgauccgauacagccguagggucugcgugcaguucggcgaggagaaucuguguaagaucaucgacaugaacgacugcuucgugucccgccacgucaaggugugcaucaucgggaccgugagcaaguuuucccagggcgacacgcuccuguucuuuggcccccuggagggcggcgggcucaucuuuaagcacuggugcaccagcacgugccaguuuggcgaccccggggacaucauguccccgcgcgacaagggcuuccugugccccgaguuccccgggagcuuccgcaagaaaugcaacuuugcgaccaccccuaucugcgaguacgacggcaacauggucuccggcuacaagaaggugauggccaccaucgacagcuuccaguccuucaacacgagcaccaugcacuucaccgacgagcggaucgaguggaaggacccggacggcaugcugcgcgaccacaucaacauccucgugaccaaggacaucgacuucgacaacuugggcgagaaucccugcaagaucgggcugcagaccuccagcaucgagggcgccugggggagcggcgucggcuucacccuaaccugccucgugucccugaccgaaugucccacguuccucaccagcaucaaagcgugcgauaaggccaucugcuacggggcggaguccgugacccugacccgaggccagaacacggucaaggugagcgggaagggcggacacuccggcagcaccuucaagugcugccacggcgaggacugcucccagaucgggcugcacgccgcggcgccccaccucgacaaggucaacggcaucucagaaaucgagaacuccaagguguacgacgauggggcaccucaguguggcaucaaaugcugguucgucaagagcggcgaguggaucuccgggaucuucagcggcaacuggaucguguugauuguccugugcguguuccuccuguucucccugguccuccugagcauccugugccccgugcgcaagcacaagaaauccuga

SEQ ID NO: 14960 - RNA, 3408 nt, Artificial Sequence; identical to SEQ ID NO: 11674
  derived and/or modified CDS sequence (opt11) from HTNV(76-118)__Y00386.1__GP

SEQ ID NO: 14961 - RNA, 3408 nt, Artificial Sequence
  derived and/or modified CDS sequence (opt11) from HTNV(A16)__AF288645.1__GP
augggccuguggaaguggcucauuauggccgugcuggucuggcccugcuucgcccugcgcaacguguacgacaugaagaucgagugcccgcacaccguuaacuucggggagaacagcgucgugggcuacguggagcucccgcccaugccuaucgccgacaucacccagaugaugccggaguccagcugcuccauggacaaccaccagagccugaacacgaucaccaaguacacccaggucuccuggcggaagaaggccgaccaggcccagagcucccagaccagcuucgagacgguguccagcgagguggacuucaaggggaccugcgugcugaagcacaagaugaucgaggacuccuaccgcagccggcgcuccaucaucugcuaugaccucagcugcaacuccacguucugcaagcccacccuguaucugaucgugcccgugcacgccugcaacaugaugaaguccugccucaucgcccugggccccuaccggguccaggugguguacgaacgcacguacugcauguccgggguccugcucgagggcaagugcuucgugccggaccagagcguggucuccaucaucaagcacggcaucuucgacaucgcgagcgugcacaucguguguuucuucgucgccaucaaggggagcaccuacaagauccuggagcaggucaagaaauccuucgagcugaccugcaacgacaccgacaacaagauccagggcuacuacaucugccucgucgggggcaacagcgcccccaucuacgugcccacgcuggacgacuuccggagcauggaggccuucgcggggaucuucaagagcccccacggcgaggaccacgaccuggccggcgaggagguggcguccuacagcaucguggggccggccaacgccaaggugccccacuccgcgagcgccgacacccucggccugguggccuucuccgggauccccagcuacuccuccuucuccguccugaccggcagcaccgacgcccgccacguguucucccccggcuuuuucccgcaacucaaccagacgcggugcgacaagacugccaucccccugaccuggaccgggaugaucgaccugcccggcuacuacgaggcggugcaccccugcacggucuucugcgugcucagcgggccgggcgccuccugcgaggccuucuccgagggugggaucuucaacaucaccucucccaugugcuuagugagcaagcagaaccgcuuccggagcuccaagcagcaggucaauuucgugugccagcgcguggacauggacaucgucguguauugcaauggccagaagaaggugauccugaccaagacccucgucaucgggcagugcaucuacacgaucaccagccuguucucccugcuccccggcguggcccacagcaucgccguggagcugugcguccccggguuccacggcugggcgacugcggcccugcucgugaccuucugcuucgggugggugcugaucccggccgucacgcuagucauccucaccauacugaaauucaucgccaacaucuuccacaccuccaaccaggagaaccggcucaagagcgugcucaagaagaucaaggaggaguucgagaagaccaagggcuccauggucugcgacgugugcaaguacgagugcgagacguacaaggagcugaaggcacacggcgugagcugcccccagucccagugucccuacugcuucacccacugcgagcccaccgaggccgccuuccaggcccacuacaaggucugccaggugacccaccgcuuccgggacgaccugaagaagacggugaccccgcaaaacuucacccccggaugcuaccgcacccucaaccuguuccgguacaagagccgcugcuacaucuucacaaugugggucuuccugcucauccuggaguccauccugugggcggccagcgccuccgagacgccccucaccccgaucuggaacgacaacgcccacgggguggggagcauccccaugcacaccgaccuggagcuggacuucucccugaccagcuccagcaaguacacuuaccggcgcaagcucaccaacccucuggaggagacccaggccguggaccugcacaucgagcucgcggagcaaacgaucggcgucgacgugcacgcccuggggcacugguucgacggccggcugaaccucaagacgagcuuccacugcuacggcgccugcaccaaguacgaguacccauggcacaccgccaagugccacuacgagcgcgacuaccaguacgagaccuccugggggugcaacccgagcgacugccccggaguggggacgggcugcacagccugcggccuguaccuggaccagcucaagcccgucggguccgcguacaagaucaucaccauccgcuacagccgucgcgugugcgugcaguucggcgaggagaacuugugcaaggucaucgacaugaacgacugcuucguaucccggcacgugaaggucugcaucaucgggaccguuagcaaauucucccaaggcgacacccugcuguucuucgggccccuggagggcggcgggcugaucuucaagcacuggugcaccagcacgugccaguucggcgauccgggggacaucaugagcccccgcgacaagggcuuccugugccccgaguuccccgggagcuuccggaagaagugcaacuucgcaaccaccccgcugugcgaguacgacggcaacaugaucuccggcuacaagaaggugauggccaccaucgacagcuuccaguccuucaacaccagcaccaugcauuucacggacgagcgcaucgaguggaaggaccccgacgggaugcugcgugaccacaucaacauccucgucaccaaggacaucgacuucgacaaccugggcgagaaccccugcaagauagggcugcagaccuccagcaucgagggcgccugggggucuggcgugggcuucacccucacgugccuggugucucugaccgaaugccccaccuuccucaccuccaucaaggccugcgacaaggcgaucugcuacggggccgagagcgucacgcugacccguggccagaacaccgugaaggugagcggcaagggcgggcacuccggcagcacuuucaagugcugccacggcgaggacuguucccagacgggucugcacgccgccgcgccgcaccucgacaaggucaauggcaucagcgagauugagaacuccaagguguacgacgacggggcgccccagugcggcaucaagugcugguucgucaagagcggcgaguggaucuccgggaucuucagcgguaacuggaucgugcugaucgugcugugcgucuuccuccuguucucccuggugcuccugagcgugcugugccccguccggaagcacaagaaauccuga

SEQ ID NO: 14962 - RNA, 3408 nt, Artificial Sequence; identical to SEQ ID NO: 11676
  derived and/or modified CDS sequence (opt11) from HTNV(A9)__AF035831.1__GP

SEQ ID NO: 14963 - RNA, 3408 nt, Artificial Sequence
  derived and/or modified CDS sequence (opt11) from HTNV(84FLi)__AF345636.2__GP
augggcguguggaaguggcuggucauggcaagccucguguggcccgccugcacccugcgcaacguguacgacaugaagaucgagugcccgcacaccgucuccuucggggagaauagcgugaucggcuacguggagcugccgccaaugccccucgccgacacgacccaacugguccccgaguccagcugcuccauggacaaccaccagagccugaacaccaucaccaaguacacccagguguccuggcggaagaaggccgaccaggcccagagcucccagaacagcuucgagacgguguccgucgagguggaccucaaggggaccugcgugcugaagcacaagaugaucgaggagagcuaccgcucccgcaagaguaucacgugcuacgaccuguccugcaacagcacguacugcaagcccacccucuacaugaucguccccauccacgccugcaacaugaugaaguccugccugaucgcucugggcccauaccggguccaggugguguacgagcggacuuacugcaugaccggggugcucaucgagggcaagugcuucgugccggaccagagcgucgucuccaucaucaagcacggcaucuucgacaucgcgagcgugaagauagucugcuucuucguggccgugaagggcaacacguacaaguuguucgagcaggucaaaaagagcuucgacuccacgugcaacgacaccgagaacaaggugcagggcuacuacaucugcaucgucggugguaacagcgcccccaucuacgugcccacccuggacgacuuccgcuccauggaggccuucagugggaucuuccggagcccccacggcgaggaccacgaccucgcaggcgaggagguggccagcuacuccaucguagggccggccaacgccaaggugccccacagcgccuccagcgacacccugucccugaucgcguacagcggcauccccuccuacagcucccucagcauccugaccuccagcaccgaggccaagcacguguucucccccggguucuucccgcagcuaaaccacaccaagugcgacaagacggccaucccccucaccuggacaggcaugauagaccugcccggcuacuacgaggccauccaccugugcaccgucuucuguguacucagcgggcccggcgccagcugcgaggcguucuccgagggcgggaucuucaacaucacgagcccgaugugccuuguguccaagcagaaccaguuccgccugaccaagcagcaggucaacuucgugugccagcggguggacauggacauagucguguacugcaacgggcagcgcaaggugauccucaccaagaccauggucaucgggcagugcaucuacacgaucaccagccuguucucccugcuccccggcguggcccacagcaucgccguggagcugugcguccccggguuccacggcugggccacugccgcgcuucucgugaccuucugcuucgggugggugcuuaucccugccgucacguucaucauccugaccgugcucaaguucguagccaacaucuuccauaccucgaaccaggagaaccggcucaagagcgugcugcgcaagaucaaggaggaguucgagaagaccaagggcuccauggugugcgacgugugcaaguacgagugcgaaacguaccgagagcugaaggcccacggggucagcugcccgcagucccagugccccuacugcuucacccacugcgagcccaccgaggccgcguuccaggcccacuaccgcguuugccaggugacccaccgguuccgcgacgaucugaagaagaccgucacgccccagaacuucaccccgggcugcuaccggacccugaaccucuuccgcuacaaaagccggugcuacaucuucaccauguggguguuccugcuggugcucgagaguauccugugggccgccagcgcguccgaagucccccugaaccccaucuggaacgacaacgcccacgguguggggagcgugccgaugcacacggaccucgagcuggacuucucccugacuagcagcuccaaguacaccuaccgcagaaagcugaccaacccccucgaggagacgcaggcuaucgaccuacacaucgagaucgaggagcagaccaucggcgucgacgugcaugcccuggggcacugguucgacggccgccucaaucugaagaccagcuuccacuguuacggggccugcaccaaguacgaguaccccuggcacacggcgaagugccacuacgagagagacuaccaguacgagaccuccuggggcugcaaccccagcgacugcccgggcguggggacgggcugcaccgccugcgggcuguaccucgaccagcugaagccugucggcuccgccuacaagauaaucacuauccgguacagccgccgggugugcgugcaguucggcgaggagaaccugugcaaggucaucgacaugaacgacugcuucgugucccgccacgugaaggucugcaucaucgggaccgugagcaaguucucccagggcgacacccuccuguucuucgggccccuggagggcgggggccucaucuucaagcacuggugcaccagcacgugccaguucggcgaccccggggacauuauguccccgcgggacaagggcuuccugugccccgaguucccggggagcuuccgcaagaagugcaacuucgccaccacgcccuuaugugaguacgacggcaacaugaucuccggguacaagaaggugauggccaccaucgacagcuuucaguccuucaauaccagcaccaugcacuuuaccgacgagcggaucgaguggaaggacccggacggcaugcuccgcgaccacaucaacauccuggucacuaaggacaucgacuucgacaaucugggcgagaaccccugcaagaucgggcuccagacguccucgaucgagggcgcguggggguccggcguuggguucacccugaccugccuggugagccucaccgaaugccccacguuccugaccagcaucaaggccugcgacaaggccaucugcuacggcgccgaguccgucacccugacccggggccagaacacggugaaggucagcgggaagggcgggcacuccggcaguaccuucaagugcugccacggggaggacugcucccagaccggccuccacgccgcggcgccccaccuggacaaggugaacggcaucagcgagaucgagaacuccaagguguacgacgacggggccccgcagugcggaaucaagugcugguucguaaccagcggggaguggaucuccggcaucuucagcggcaacuggaucgugcugaucgugcucugcgucuuccugcuguucucccucgugcugcugagcgugcucugccccguccgcaagcacaagaaguccuga

SEQ ID NO: 14964 - RNA, 3408 nt, Artificial Sequence
  derived and/or modified CDS sequence (opt11) from HTNV(Aa03-161)__KT934990.1__GP
augggcaucuggaaguggcuggugauggccagccucgucuggcccgugcugacccugcgcaacguguacgacaugaagaucgagugcccgcacaccgucuccuucggggagaacagcgugaucggcuacguggagcucccacccaugccccuggccgacacggcccagcugguccccgaguccaguugcucuauggacaaccaccaaagccucaacaccaucaccaaguacacccagguguccuggcgggggaaggccgaccagagccaguccagccagaacuccuucgagaccguguccaccgaagucgaccugaagggcacaugcgugcugaagcacaagaugguggaggaguccuaccgcucucggaaguccauaaccugcuacgacuuaagcugcaacuccacguacugcaagcccacccuguacaugaucguccccauccacgccugcaacaugaugaaaagcugccugaucgcccucgggccauaccgcguccaggugguguacgagcggaccuauugcaugaccggcgugcugaucgagggcaaguguuucgucccggaccaguccgucgugagcaucaucaagcacgggaucuucgacaucgccagcgugcacaucgucuguuucuucguggcggugaagggcaacacguacaagaucuucgagcaagucaagaaguccuucgagagcacgugcaacgacaccgagaacaaggugcagggguacuacaucugcaucgucggcgggaacuccgcccccaucuacgugcccacccuggacgacuuccgcagcauggaggccuucaccggcauauuccguagcccccacggcgaggaccacgaccucgccggggaggagaccgcgaccuacuccaucgugggcccggccaacgccaaggucccccauuccgccagcuccgacacccugagccuuaucgccuucagugggauccccagcuacuccagccucuccauccugacgagcuccaccgaggcgaagcacguguucagccccggccuguucccgaagcucaaccacaccaacugcgacaagggcgccaucccccugauguggaccgggaugaucgaccugccgggcuacuacgaggccauccaccccugcacgguguucugcguacucuccgggccgggcgccagcugcgaggccuucagcgaagggggcaucuucaacaucacaucccccaugugccuggugagcaagcagaaccgcuuccggcugaccgagcagcagguaaauuucgucugccagcgcguggacguggacauugucguguacugcaacggccagcggaaggugauccucaccaagacgcuggucaucgggcagugcaucuacaccaucaccucccucuucagccuccugcccggcguggcgcacuccaucgccguagagcugugcguccccggguuccacggcugggccaccgccgcccuccuggugacguucugcuucgggugggugcugaucccggcgaucacguucaucauccuuaccauccugaaguucaucgccaacauuuuucacaccagcaaccaggagaacagacugaaguccguccuccggaagaucaaggaggaguucgagaaaacgaagggcagcauggugugcgacgugugcaaguacgagugcgagaccuacaaggagcugaaggcccacggcgucuccugcccccagagccagugccccuacugcuuuacccacugugagcccaccgaggccgccuuccaggcgcacuacaaggucugccaggugacccaccgcuucagggacgaccugaagaagacggucaccccgcagaacuucacccccgggugcuaccgcacccucaaccuguuccgguacaagucccgcugcuacaucuucacgauguggaucuucuugcucgugcuggagagcauccugugggccgccuccgccagcgagacgccccucaccccgguguggaacgacaacgcgcacggcgucggguccguccccaugcacaccgauuuggagcuggacuucagccugaccuccagcagcaaguacaccuaccgacgcaagcucaccaacccccuggaggaggcgcaauccaucgaucugcacaucgaaaucgaggagcagaccauaggcguggacguccacgcccucgggcacugguucgacggccggcugaaccugaagacgagcuuccacugcuacggcgccugcaccaaguacgaguaccccuggcacaccgccaagugccauuacgagcgcgacuaccaguacgagacauccugggggugcaacccgagcgacugccccggcgucgggacggggugcaccgcgugcggccucuaccuggaccgccugaagcccgugggguccgccuacaagaucaucaccauccgauacagccgccgggucugcgugcaguucggcgaggagaaccucuguaagaucaucgacaugaacgacugcuucgugucccgccacgucaagguguguaucaucgggaccgugagcaaguucucccagggcgacacgcugcuguucuucgggccccucgaaggcggcgggcugaucuucaagcacuggugcaccagcacgugccaguucggcgacccgggggacaucaugagcccccgggacaagggcuuccugugccccgaguuccccggguccuuccgcaagaagugcaacuucgccaccaccccgauuugcgaguacgacggcaacauggucuccggcuaccggaagguaauggccaccaucgacagcuuccaguccuucaacaccucaaccaugcacuucacggacgagcguaucgaguggaaggaccccgacgggaugcuccgggaccacaucaauauccuggugaccaaggacaucgacuucgacaaccugggcgagaaccccugcaagaucgggcuacagaccuccagcaucgagggcgccuggggguccggcgucggcuuuacccugacgugccuggugagccucaccgagugucccacauuccugaccagcaucaaggcgugcgacaaggccaucugcuacggggccgaguccgugacacugacccgcggccagaacaccgucaaggugagcgggaagggcgggcacuccggcagcaccuucaagugcugccacggcgaggacugcucccagaucggucuccacgccgccgcgccgcaccuggacaaggugaacggcaucagcgagauggagaacuccaaggucuacgacgacggggcgccccagugcgggaucaagugcugguucgucaagagcggcgaguggaucuccgggaucuucagcggcaacuggauagugcugaucgugcucugcguguuccugcuguuuucccucguccugcugagcauccucugccccgugcggaagcauaagaagucauga

SEQ ID NO: 14965 - RNA, 3408 nt, Artificial Sequence
  derived and/or modified CDS sequence (opt11) from HTNV(Aa03-386)__KT934991.1__GP
augggcaucuggaaguggcuggugauggccagccucguguggcccgugcugacccugcgcaacguguacgacaugaaaaucgagugcccacacaccaucuccuucggcgagaacagcgucaucggcuacguggagcucccucccaugcccuuggccgacacggcgcagcugguaccggaguccagcugcuccauggacaaccaccagagccucaacaccaucaccaaguacacccaggucuccuggcgggggaaggccgaccagagucaguccagccagaacuccuucgagacggugagcaccgagguggaccugaaggggaccugcguccugaagcacaagaugguggaggaguccuaccgcagucggaaguccauuaccugcuacgaccucagcugcaacuccacguacuguaagcccacccuguacaugaucgugcccauccacgccugcaacaugaugaaaagcugccugaucgcccucgggcccuaccgcguccaggugguguacgagcggaccuacugcaugaccggcguccugaucgagggcaagugcuucgugccugaccaguccguggucagcaucaucaagcacgggaucuucgacaucgccagcgugcacaucgugugcuucuucgucgcggugaagggcaacacguacaagaucuucgaacaggugaagaaguccuucgaguccacgugcaacgacaccgagaacaagguccagggguacuauaucuguaucgugggugggaacuccgcccccaucuacguccccacccuggacgacuuccgcagcauggaggccuucaccggcaucuuccggagcccccacggcgaggaccacgaccuugccggggaggagaccgcgaccuacagcaucgugggcccggccaacgccaaggugccccauuccgccucauccgacacccugagccugaucgccuucuccgggauccccagcuacuccagccucuccauccugacgaguuccaccgaggcgaagcacgucuucagccccggccuguucccgaagcucaaccacaccaacugcgacaagggcgccaucccccugauguggaccgggaugaucgaccugcccggcuacuacgaggccauccaucccugcacgguauucugcgugcucuccgggccgggcgccagcugcgaggccuucagcgagggcggcaucuucaacaucaccucccccaugugccuggucagcaagcagaaccgcuuccggcugaccgagcaacaggugaacuucgugugccagcgcgucgacguggacaucguggucuacugcaacggccagcggaaggugauccucaccaagacgcuggugaucgggcagugcaucuacaccaucaccucccuguucagcuugcugcccggcgucgcgcacuccaucgccguggagcugugugugcccggguuccacggcugggccaccgccgcccuccuggucacguucugcuuugggugggugcugaucccggcgaucaccuucaucauccucaccauccugaaguucaucgccaacaucuuccacaccagcaaccaggagaaccgccugaaguccguucuccggaagaucaaggaggaguucgagaagacgaagggcagcauggucugcgacgugugcaaguaugagugcgagaccuacaaggagcugaaggcccacggcguguccugcccccagagccagugccccuauugcuucacccacugcgagcccaccgaggccgccuuucaggcgcacuacaaggucugccaggugacccaccgcuuccgggacgaccugaagaagacggugaccccgcagaacuucacccccgggugcuaccgcacccucaaccuguuccgguacaagucccgcugcuacauauucacgauguggaucuuccuacucguccuggagagcauccugugggccgccuccgccagcgagacgccccucaccccgguguggaacgacaaugcgcacggcgugggguccguccccaugcacaccgaccuggagcuggacuucagccugaccuccagcagcaaguauaccuacaggcgcaagcucaccaacccccuggaggaggcccaguccaucgaccuacacaucgagauugaggagcagaccaucggcguggacgugcacgcccucgggcacugguucgacggccggcugaaccugaagacguccuuccacuguuacggcgccugcaccaaguacgaguacccuuggcacaccgccaagugccacuacgagcgcgauuaccaguacgagaccucgugggggugcaacccgagcgauugccccggcgucgggacgggcugcaccgcgugcggccucuaccuggaccgccugaaacccgugggguccgccuacaagaucaucaccaucagauacagccgccgggugugcguucaguucggcgaagagaaccucugcaagauaaucgauaugaacgacugcuucgugucccgccacgugaaggucugcaucaucgggaccgugagcaaguucucccagggcgacacgcugcuguucuucgggccccucgaaggcggcgggcugaucuucaagcacuggugcaccagcacgugccaguucggagacccgggggacaucaugucccccagggacaagggcuuccugugccccgaguuccccgggagcuuccgcaagaagugcaacuucgccaccacgccgaucugcgaguacgacggcaacaugguguccggcuacaagaaggucauggccaccauagacagcuuccaguccuucaacaccagcaccaugcacuucacggacgagcgcaucgaguggaaggaccccgacgggaugcuccgcgaccacaucaacauccucgugaccaaggacaucgacuucgacaaccugggcgagaaccccugcaagaucgggcuccagaccuccagcaucgagggggccuggggauccggcgugggcuucacccugacgugccuggucagccucaccgagugccccaccuuucugaccaguaucaaggccugcgacaaggccaucugcuacggggccgaguccgugacgcugaccaggggccagaacaccgugaaggucagcgggaagggcgggcacuccggcagcaccuucaagugcugccacggcgaggacugcucccagaucggucuccacgccgccgcgccgcaccuggacaaggugaacggcaucagcgagauggagaacuccaagguguacgacgacggggcaccccagugcggcaucaagugcugguucgucaagagcggcgaguggauauccgggaucuucagcggcaacuggaucgugcugaucguccucugcaucuuccugcuguucucccuggugcugcugagcauccucugccccgugcgcaagcacaagaaguccuga

SEQ ID NO: 14966 - RNA, 3408 nt, Artificial Sequence
  derived and/or modified CDS sequence (opt11) from HTNV(Aa04-722)__KU207182.1__GP
augggcaucuggaaguggcuggugauggccagccucgucuggcccgugcugacccuacgaaacguguacgacaugaagaucgaguguccgcacaccgucucuuucggggaaaauagcgugaucggcuacguggagcucccgcccaugccccuggccgacacggcgcaacugguccccgaguccagcugcuccauggacaaccaucagucgcucaacaccaucacgaaguacacccagguguccuggcgggggaaggccgaccagagccaguccagccaaaacuccuucgagacggugagcaccgagguugaccugaaagggaccugcgugcugaagcacaagauggucgaggaguccuaccgcucacggaaguccauaaccugcuacgaccucagcugcaauuccacguacugcaagcccacccuguacaugaucgucccaauccacgccugcaacaugaugaaguccugccugaucgcccucggccccuaccgcguccaggugguguacgagcggacuuacugcaugaccggcgugcugaucgagggcaaaugcuucgugccugaccaguccgucguguccaucaucaagcacgggaucuucgacaucgccagcgugcacaucgucugcuuuuucguggcggugaagggcaacacguacaagaucuucgagcaagucaagaagucauucgagagcacgugcaacgacaccgagaacaagguccagggguacuacaucugcaucgucggcgggaacuccgcccccaucuacgugcccacccuggacgacuuccgcaguauggaggccuucaccgggaucuuccggagcccccauggagaggaccacgaccucgccggggaggagacugcgaccuacagcaucgucggcccagccaacgccaagguuccccacuccgccagcuccgacacccugagccuaaucgccuucuccgggaucccaucuuacuccagccucuccaucuuaacgagcuccaccgaggcgaagcacguguucagccccggccuguucccgaagcucaaccacaccaacugcgacaagggcgccaucccccuuauguggaccgggaucaucgaccuccccggcuacuacgaggccauccaccccugcacgguguucugcguccucuccgggccgggcgccagcugcgaggccuucagcgaagggggcaucuucaacaucacaucccccaugugccuggugagcaagcagaacagauuccggcugacugagcaacaggugaauuucgucugccagcgcguagacguagacaucguaguguacugcaacggccagcggaaggugauccucaccaagacgcuggucaucgggcagugcauauacacaaucaccucccuguucagccuccugcccggcguggcgcacuccaucgccguggagcugugcgucccaggguuccacggcugggccaccgccgcccuccuggugacguuuugcuucgggugggugcugaucccggcgaucacguucaucauccucaccauccugaaguucaucgccaacaucuuccacaccagcaaccaggaaaaccgccugaaguccguccuccguaaaaucaaggaggaguucgagaagacgaagggcagcauggugugcgacgugugcaaguaugagugcgagaccuacaaagagcugaaggcccacggcgucucuugcccccagagccagugucccuacugcuucacccacugcgagcccaccgaggccgccuuccaggcgcacuacaaggugugccaggugacccaccguuuccgggaugaccuuaagaagacggucacuccgcagaacuuuacccccgggugcuaccgcacgcucaaccuguuccgguacaagucccgcugcuacaucuucacgauguggaucuuccugcucgugcuggagagcauccugugggccgccagcgccagcgagacgccccucaccccgguguggaacgacaacgcgcacggcgucggguccgugcccaugcacaccgaccuggagcuggacuucagccugaccuccagcagcaaguacaccuaccggcgcaagcucaccaacccgcuggaggaggcacaguccaucgaucugcacaucgagaucgaggagcagaccaucggcgucgacguccacgcccucgggcauugguucgacggacggcugaaccugaagacgagcuuccacugcuacggcgcaugcacgaaguacgaguaccccuggcacaccgccaagugccacuacgagcgcgacuaucaguacgagaccaguugggggugcaauccgagcgacugccccgguguggggacgggcugcaccgcgugcggucucuaccuggaccgccugaagcccgugggguccgccuacaagaucaucaccauuagauacagccgccgugucugugugcaguucggcgaggagaaccucugcaagaucaucgacaugaacgacugcuucgugucccgccacgucaaggugugcaucaucggaaccgugagcaaauucucccaaggcgacacgcugcuguucuucgggccacucgagggcggcgggcugaucuuuaagcacuggugcaccagcacuugccaguucggcgacccgggggacaucauguccccucgggauaagggcuuccugugccccgaguuccccgggagcuuccgcaagaagugcaacuucgcaaccacgccgauaugcgaguacgacggcaacauggucuccggcuacaagaaggugauggcuaccaucgacagcuuccaguccuucaacaccagcaccaugcacuucaccgacgagcguaucgaguggaaggaccccgacgggaugcuccgcgaccacaucaacauccuuguaaccaaggacaucgacuucgacaaccugggcgagaacccgugcaagaucgggcuccagaccuccagcaucgagggcgccugggggucuggcgugggcuucacccugacgugccuggugagccugaccgagugccccaccuuccugaccaguaucaaggcgugcgacaaggcuaucugcuacggggccgagagugugacgcugacccggggccagaacaccgucaagguuucagggaagggcgggcacuccggcagcaccuucaaaugcugucacggcgaggacugcucccaaaucgggcuccacgccgccgcgccgcaccuggacaaagugaacggcaucagcgagauggagaacuccaaggucuacgacgacggggcgccccagugcgguaucaagugcugguucgucaagagcggcgaguggaucuccgggaucuucagcggcaacuggauugugcugaucgugcucugcguguuccugcuguucucccuaguccugcugagcauccucugccccgugcgcaagcacaagaaguccuga

SEQ ID NO: 14967 - RNA, 3408 nt, Artificial Sequence; identical to SEQ ID NO: 11681
  derived and/or modified CDS sequence (opt11) from HTNV(Aa05-190)__KT934993.1__GP

SEQ ID NO: 14968 - RNA, 3408 nt, Artificial Sequence; identical to SEQ ID NO: 11682
  derived and/or modified CDS sequence (opt11) from HTNV(Aa09-1000)__KT935001.1__GP

SEQ ID NO: 14969 - RNA, 3408 nt, Artificial Sequence
  derived and/or modified CDS sequence (opt11) from HTNV(Aa09-948)__KT935000.1__GP
augggcaucuggaagugguuagugauggccagccucgucuggccggugcugacccuccgcaacguguacgacaugaagaucgaguguccgcacaccgucaguuucggggagaacagcgugaucggcuacguggagcucccgcccaugcccuuagccgacacagcccagcugguccccgaguccuccugcuccauggacaaccaccagagccucaacacgaucaccaaguacacccagguguccuggcgggggaaggccgaccagagccaguccagccagaacuccuucgagacggugagcaccgaggucgaccugaaggggaccugcgugcucaagcacaagaugguagaggaguccuaccgcagccguaaguccauaaccugcuacgaccucuccugcaacuccacguacugcaagcccacccuguacaugaucguccccauccacgcuugcaacaugaugaaguccugccugaucgcccucgggccauaucgcguccaggugguguacgagcggacguacugcaugaccggcguacugaucgagggcaagugcuucgugccagaccaguccgucgugagcauaaucaagcacgggaucuucgacaucgccucgguacauaucgucugcuucuucguggcagugaagggcaacacguacaagaucuucgagcaggucaagaaguccuuugagagcaccuguaacgacaccgagaauaagguacaaggguacuacaucugcaucgucggcgggaacucggcccccaucuacgugcccacucucgacgacuuucgcagcauggaggccuucacgggcaucuuccggagcccccauggcgaggaccacgaccucgcuggagaggagaccgcgaccuacagcaucgugggcccagccaacgcaaaagucccccacuccgccagcuccgacacccucagccugaucgccuucuccgggauccccucuuacuccagccucuccaucuuaacgucauccacagaggcgaagcacguguucagccccggccuguuucccaaacucaaccacaccaacugugacaaaggcgccaucccccugauguggacugggaugaucgaccugcccggcuacuacgaggccauucacccuugcacuguguucugcguccucagugggccgggcgccagcugcgaggccuucagcgagggcggcaucuucaacaucaccucaccuaugugccugaucagcaagcagaaccgcuuucggcugacagagcagcagguaaacuucgugugccagcgcguugacguggauaucguggucuacugcaacggccagcggaaggugauccucaccaagacgcuggugaucgggcaaugcaucuacaccaucaccucccuguucucgcuccugcccggcguagcgcacuccaucgccguggagcugugcgugcccggguuccacggcugggccaccgccgcccuccuggucacguucugcuucggguggguccugaucccggcgaucacauuuaucauccucaccauccugaaguucaucgccaauaucuuccacaccagcaaccaggagaacagacugaagagugugcuccggaagaucaaggaggaguucgaaaagacgaagggcagcauggucugcgacguaugcaaguacgagugcgagacauacaaggagcugaaggcccacggcguguccugcccccagagccagugccccuacugcuucacccacugugagccgaccgaggccgccuuccaggcgcacuacaaggucugccagguaacccaucgcuuccgggaugaccugaagaagacggugacaccgcagaacuucacccccgggugcuaccgcacccucaaccuguuucgguacaaaucccgcugcuacaucuucacgauguggaucuuccugcucgugcuggagagcauccugugggccgccuccgcuagcgagacgccccucaccccaguguggaacgacaaugcgcacggcgugggguccguccccaugcacaccgaccuggagcuggacuucagccugaccuccagcagcaaguacaccuaccggcgcaagcugaccaacccgcuggaggaggcccaguccaucgaccugcauaucgaaaucgaggagcagaccaucggaguggacgugcacgcccucgggcacugguucgacggccggcuaaaccugaagacgagcuuccacugcuacggcgccugcacaaaguacgaguaccccuggcacaccgccaagugccacuaugagcgggacuaccaguacgagaccuccugggggugcaacccgucggacugcccuggcgucgggacgggcuguaccgcgugcgggcucuaccuggaccggcugaagccugugggguccgccuacaagauuaucacaauccgguacagccgccgggugugcguacaguucggcgaggagaaccucugcaaaauaaucgacaugaacgacugcuucgugagucgccacgugaaggucugcaucauagggaccguuucuaaguucucccagggcgacacgcugcuauucuucgggccccucgagggcggcggucugaucuucaagcacuggugcaccucuaccugccaguucggcgacccgggggacaucaugagcccccgggacaagggauuccugugccccgaguuccccggguccuuccgcaagaaaugcaacuucgccacuacaccgaucugcgaauacgacggcaacaugguguccggcuacaagaaggucauggccaccaucgacagcuuccagaguuucaacaccagcaccaugcauuucacggacgagcggaucgaguggaaggaccccgacgggaugcuccgcgaccacauuaacauccuggugaccaaggacaucgacuucgacaaucugggcgagaaccccugcaaaaucgggcuccagaccuccagcaucgagggcgccuggggguccggcguuggcuucacccugacgugccucgucagccucaccgagugccccaccuuccugaccagcaucaaggcuugcgacaaggcuaucugcuacggggcagaguccgugacgcugacccggggccagaacaccgugaaggucagcgggaagggcgggcacuccggcagcaccuucaagugcugccacggcgaggacugcucccagaucgggcuccacgccgccgcgccgcaccuggacaaagucaacggcaucagcgagauggagaacuccaagguguacgacgauggggcgccccagugcggcaucaagugcugguucguuaagagcggcgaauggaucuccgggauuuucucuggcaauuggaucgugcugaucguccucugcguguucuuacuguucucccucgugcugcugagcauccuuugccccguccgcaagcacaagaaguccuga

SEQ ID NO: 14970 - RNA, 3408 nt, Artificial Sequence; identical to SEQ ID NO: 11684
  derived and/or modified CDS sequence (opt11) from HTNV(Aa10-434)__KT935004.1__GP

SEQ ID NO: 14971 - RNA, 3408 nt, Artificial Sequence
  derived and/or modified CDS sequence (opt11) from HTNV(Aa10-518)__KT935005.1__GP
augggcaucuggaaguggcuggugauggccagccucgucuggcccgugcugacccuacgcaacguguacgacaugaagaucgagugcccgcacaccgucuccuuuggggagaacagcgugaucggcuacguggagcucccgcccaugccccuggccgauacggcgcagcugguccccgaguccagcugcuccauggauaaccaccagagccucaacaccaucaccaaguacacccagguguccuggcgggggaaggcugaccagagccaguccagccagaacuccuucgagacggugagcaccgaggucgaccugaaggggaccugcgugcuuaagcacaagaugguggaggaguccuaccgcagccggaaguccauaaccugcuacgaccucagcugcaacuccacguacugcaagcccacauuguacaugauaguccccauccacgccugcaacaugaugaagaguugccugaucgcacucggcccuuaccgcguccaggugguguacgagcggaccuacugcaugaccggcgugcugaucgagggcaagugcuucgugccggaccaguccgucgugagcaucaucaagcacggcaucuucgacaucgccagcgugcacauugucugcuuuuucguggcgguuaagggcaacacguacaagaucuucgagcaggucaagaaguccuucgagagcacaugcaacgacaccaagaacaaggugcaaggguacuacaucugcaucgucggagggaacuccgccccuaucuacguacccacccuggacgacuuccgaagcauggaggccuucacgggcaucuuccggagcccccauggcgaggaccacgaccucgccggggaggagaccgcgaccuauuccaucgugggcccggccaacgccaaggucccccacuccgccagcuccgacacgcugagccugaucgccuucuccgggauccccagcuacuccagccucuccauccugacguccuccaccgaagcgaagcacguguucagccccggccuguucccgaagcucaaccacaccaacugcgacaagggcgccaucccccugauguggaccgggaugaucgaccugcccggcuacuacgaggccauccaccccugcacgguguucugcguccucuccgggccgggcgccagcugcgaggccuucagcgaagggggcaucuucaacaucaccucccccaugugccuggugagcaagcagaaccgcuuccggcuaaccgagcaacaggugaacuucgucugccagcgcguggacgucgacaucgucguguacugcaacggccagcggaaggucauccucaccaagacgcuggucaucgggcagugcaucuacaccaucaccucccuguucagccucuugcccggcguggcgcacuccaucgccguggagcugugcguccccggguuccacggcugggccaccgccgcccuccuggugacguucugcuucgggugggugcugaucccggcgaucaccuucaucauccucaccauccugaaguucaucgccaacaucuuccacaccagcaaccaggagaaccgccugaaguccguccuccggaagauuaaggaggaguucgagaagacuaagggcagcauggugugcgacgugugcaaguacgagugcgagaccuacaaggagcugaaggcacacggcgucuccugcccccagagccagugucccuacugcuucacccacugcgagcccaccgaggccgccuuccaggcgcacuacaaggugugucaggugacccaccgcuuccgggacgaccugaagaagacggucaccccgcagaacuucacccccgggugcuaccgcacccucaaccuguuccgguacaagucccgcugcuacaucuucacgauguggaucuuccugcucgugcuggaaagcauccugugggccgccuccgccagcgagacgccccucaccccgguguggaacgacaacgcgcacggcgucggguccgugcccaugcacaccgaccuggagcuggacuucagccugacguccagcagcaaguacaccuaccggcgcaagcucaccaacccccuggaggaggcccaguccauagaccugcacaucgagaucgaggagcagaccaucggcguggacguccacgcccucgggcacugguucgacggccggcugaaccugaagaccagcuuccacugcuacggcgccugcaccaaguacgaguacccguggcacaccgccaagugccacuaugagcgcgacuaccaguacgagaccuccugggggugcaacccgucggacugccccggcguggggacgggcugcaccgcguguggccucuaccuggaccgccugaagcccgugggcuccgccuacaagaucaucaccauccgguacagccgccgggucugcgugcaguucggcgaggaaaaccucugcaagaucguggacaugaacgacugcuucgucagccgccacgugaaggugugcaucaucgggaccgucagcaaguucucccagggcgauacgcugcuguucuuugggccccucgagggcggcgggcugaucuucaagcacuggugcaccucuaccugccaguucggcgacccgggggacaucaugagcccccgggacaagggcuuccugugccccgaguuccccggguccuuccgcaagaagugcaacuucgccaccacgccgaucugcgaguacgauggcaacaugguguccggcuacaaaaaggugauggccaccaucgacagcuuccaguccuucaacaccagcaccaugcacuucacggacgagcggaucgaguggaaggaccccgacgggaugcuccgcgaccacaucaacauccuggucaccaaggacaucgacuucgacaaccugggcgagaaccccugcaagaucgggcuccagaccuccucaaucgagggcgccuggggguccggcgugggcuucacccugacgugccuggugagccucaccgagugucccaccuucuugaccagcaucaaggcgugcgacaaggccaucugcuacggggcagaguccgucacgcugacccggggccagaacacgguaaaggugagcgggaagggcgggcacuccggcagcaccuucaaguguugccacggcgaggacugcucccagaucgggcuccacgccgccgcgccgcacuuggacaaagucaacggcaucagcgagauggagaacuccaagguguacgacgacggggccccacaaugcggcaucaagugcugguucgucaagagcggcgaguggaucuccgggaucuucagcggcaacuggaucgugcugaucgugcucugcgucuuccugcuguucucccucgugcugcugagcauccucugccccgugcgcaagcacaagaaguccuga

SEQ ID NO: 14972 - RNA, 3408 nt, Artificial Sequence
  derived and/or modified CDS sequence (opt11) from HTNV(Aa10-561)__KT935006.1__GP
augggcaucuggaaauggcuggugauggccucgcucgucuggcccgugcugacccugcgcaacguguacgacaugaagaucgagugcccgcauaccgucuccuucggggagaacagcgugauaggcuacguggagcucccgcccaugccccuggccgacacggcccagcugguccccgaguccagcugcuccauggacaaccaccagagccucaacaccaucaccaaguacacccaggucuccuggcgggggaaggccgaccagagccagucgagccagaucuccuucgagacggugagcaccgaggucgaccugaaggggaccugcgugcugaagcacaagaugguggaggaguccuaccgcagccggaaguccauuaccugcuacgaccucagcugcaacuccacguacugcaagccuacgcuguacaugaucguccccauccacgccugcaacaugaugaaaagcugccugaucgcccucgggcccuaccgcguccaggugguguacgagcgaaccuacugcaugaccggcgugcugaucgagggcaagugcuucgugccagaccagucagucgugagcaucaucaagcacgggaucuucgacaucgccagcgugcacaucgucugcuucuucguggcggugaagggcaacacguacaagaucuucgaacaggucaagaaguccuuugagucgaccugcaacgacaccgagaacaaggugcagggguacuacaucugcaucgucggcgggaacuccgcacccaucuacgugcccacccuggacgacuuccgcagcauggaggccuucacgggcaucuuccggagcccccacggcgaggaccacgaccucgccggggaggaaaccgcgaccuacuccaucgugggcccggccaacgccaaggucccccauuccgccagcuccgauacccugagccugaucgccuuuuccgggauccccagcuacuccagccucuccauccugacgagcuccaccgaggcgaagcacgucuucagccccggccuguucccgaagcucaaccacaccaacugcgacaagggcgccauucccuuaauguggaccgguaugaucgaccugcccggcuacuacgaggccauccaccccugcacgguguucugcguccucuccgggccgggcgccagcugcgaggccuucagcgagggcggcaucuucaacaucaccucccccaugugucuggugagcaagcagaaccgcuuccggcugaccgagcagcaggucaacuucgugugccagcgcguggacguggacaucgucguguacugcaacggccagcggaaggugauccucaccaagacgcuggucaucgggcagugcaucuacaccaucaccucccuguucagccuccugcccggcguggcgcacuccaucgccguggagcugugcguccccgguuuccacggcugggccaccgcggcccuccuggugacguucugcuucgggugggugcugauuccggcgaucaccuucaucauccucaccauccugaaauucaucgccaacaucuuccacaccucuaaccaggagaaccgccucaaguccguccugcggaagaucaaggaagaauuugaaaagacgaagggcagcauggugugcgaugugugcaaguacgagugcgagaccuacaaggagcugaaggcccacggcgucuccugcccccagagccagugccccuacugcuucacccacugcgagccuaccgaggccgccuuccaggcgcacuacaaggugugccaggugacccaccgcuuccgggacgaccugaagaagacggucaccccgcagaacuucacccccggcugcuaccgcacccucaaccuguuccgguacaagucccgcugcuacaucuucacgauguggaucuuccugcucgugcuggagagcauccugugggccgccuccgccagcgagacaccccucaccccgguguggaacgacaacgcgcacggcgucggguccgugcccaugcacaccgaucuggagcuggacuucagccugacguccagcagcaaguacaccuaccggcgcaagcucaccaauccccuggaggaggcacaguccaucgaccugcacaucgagaucgaggagcagaccaucggcguggacguccacgcccucgggcacugguucgacggccggcugaaccugaagacgagcuuccacugcuacggcgccugcaccaaguacgaguaccccuggcacaccgccaagugccacuacgagcgcgacuaccaguacgagaccuccugggggugcaauccgagcgacugccccggcguggguacgggcugcaccgcgugcggccucuaccuggaccgccugaagcccguggguuccgccuacaaaaucaucaccauccgguacucccgccgggucugcgugcaguucggcgaggagaaccucugcaagaucaucgacaugaacgacugcuucgugucccgccacgucaaggugugcaucaucgggaccaucagcaaguucucccagggcgacacgcugcuguucuuuggcccccucgagggcggcgggcugaucuucaagcacuggugcaccagcacaugucaguucggugacccgggggacaucaugagcccccgggacaagggcuuccugugccccgaguuccccggguccuuucgcaagaagugcaacuucgccaccacgccgaucugcgaguacgacggcaacaugguguccggcuacaagaaggucauggccaccaucgacagcuuccaguccuucaacaccagcaccaugcacuucacggacgagcggaucgaguggaaggaccccgacgggaugcuccgcgaccacaucaacauccuggugaccaaggacaucgacuucgacaaccugggcgagaaccccuguaagaucgggcuccaggccuccagcaucgagggcgcguggggguccggcgugggcuucacccugaccugccugguuagccucacggagugccccaccuuccugaccagcaucaaggccugcgacaaggccaucugcuacggggccgaguccgugacccugacgcggggccagaacaccguaaaggucagcgggaagggcgggcacuccggcagcaccuucaagugcugccacggcgaggacugcucccagaucgggcuccacgccgcggccccgcaccuggacaaggugaacggcaucagcgagauggagaacuccaagguguacgacgacggggcgccccagugcggcauaaaaugcugguucgucaagagcggcgaguggaucuccgggaucuucagcggcaacuggaucgugcugaucguccucugcguguuccugcuauucucccucgugcugcugagcauccucugccccguccgcaagcacaagaaguccuga

SEQ ID NO: 14973 - RNA, 3408 nt, Artificial Sequence; identical to SEQ ID NO: 11687
  derived and/or modified CDS sequence (opt11) from HTNV(Aa14-172)__KT935008.1__GP

SEQ ID NO: 14974 - RNA, 3408 nt, Artificial Sequence; identical to SEQ ID NO: 11688
  derived and/or modified CDS sequence (opt11) from HTNV(Aa14-266)__KT935013.1__GP

SEQ ID NO: 14975 - RNA, 3408 nt, Artificial Sequence
  derived and/or modified CDS sequence (opt11) from HTNV(Aa14-272)__KT935014.1__GP
augggcaucuggaaguggcuggugauggccagccucgucuggcccgugcugacccugcgcaacguguacgacaugaagaucgagugcccgcacaccgucucuuucggggagaacagcgugaucggcuauguggagcucccucccaugccccucgccgacacggcccagaugguccccgaguccagcugcuccauggacaaccaccaaagccucaacaccaucaccaaguacacccagguguccuggcgggggaaagccgaccagagccaguccaaccagaauagcuucgagacuguguccaccgaagucgaccugaaggggaccugcgugcugaagcacaagaugguggaggaaucguaccgcucccgcaagagcaucacgugcuacgaccugaguugcaacucuaccuacugcaaacccacucuauacaugaucguccccauccacgccugcaacaugaugaaguccugucugaucgcccuggggccauaucgcguccaggugguguacgagcggacuuauugcaugaccggcguguugaucgagggcaaaugcuucgugccagaccagagcgucguguccaucaucaaacacgggaucuucgacaucgccagcgugcauauugucugcuucuucguggcggugaagggcaacacguacaagauuuucgaacaggucaagaaguccuucgaguccacgugcaacgacacagagaacaaggugcagggguauuacaucugcaucgucggcgggaacagcgcccccaucuacgugccuacccuggaugacuucaggucaauggaggccuucacaggcaucuuccggagcccccacggcgaagaccacgaccucgcuggggaggagaucgcgaccuacagcaucgugggcccggccaacgcuaagguuccccacagcgcaucgagcgacacccucucccugaucgccuacagcgggauccccuccuauagcucccugagcauccucaccuccagcacggaagcgaaacacguuuucuccccuggccuguucccgaagcugaaucacaccaacugcgacaaaagcgccauaccccucauguggaccggcaugaucgaccuccccggcuacuacgaagccguucaccccugcaccguauucugcgugcuguccggcccgggggccagcugcgaggccuuuagcgagggcgggaucuucaacaucacgucccccaugugccucgugagcaagcagaaccgcuuccggcugaccgagcagcaggucaacuucgugugccaacgcguggacgucgacaucgugguguacugcaacggccagcggaaggucauccugaccaagacccucgugauaggccagugcaucuauacgaucaccucccuguucagccugcuuccagggguggcgcacuccaucgcagucgagcugugcgugcccggcuuccacgggugggccaccgccgcccugcucgugaccuucugcuucggcuggguccuuaucccugcgaucacguucaucauccugaccauccuaaaguucaucgccaauaucuuccacaccagcaaccaggagaaccgccugaaauccgugcugcggaagaucaaggaggaguucgagaagaccaaggggagcauggugugcgacgucugcaaguacgagugcgagacauacaaggagcucaaggcccacggcguguccugcccccagagccagugccccuauugcuucacccacugcgagcccaccgaagccgccuuccaggcgcacuacaaggugugucaggucacgcaccgcuuccgagacgaucugaagaaaaccgugacgccccagaacuucacgccaggcuguuaccgcacccugaaccucuuccgguacaagucgcgcugcuacaucuucaccauguggauuuuccugcuggugcuagagagcauuuuaugggccgccuccgccagcgagacgccccugacgccggucuggaacgacaacgcgcauggggugggcuccgugccaaugcacaccgacuuggagcuagacuucagccuuaccuccagcagcaaguacacguaccggcgcaagcugaccaacccccucgaggaggcccaguccaucgaccugcacaucgagaucgaggagcagacuaucgggguagacgugcacgcccugggccacugguucgacgggcggcucaaccugaagacauccuuccacugcuacggcgcgugcacgaaguacgaguaccccuggcacaccgccaagugccacuacgagcgcgacuaccaguacgagaccuccuggggcugcaacccgucagacugccccggggugggcacggggugcacggcgugcggccuguaccuugaccagcugaagcccguaggcuccgccuacaagaucaucaccauccgcuacagucggcgcguuugcgugcaguucggggaggagaaccucugcaagaucaucgacaugaacgacugcuucgucucccggcaugugaaggugugcaucaucgggaccgucagcaaauucucccagggggacacccuccuguucuucggcccccuggagggcggcggccucaucuucaagcacuggugcacgagcacgugccaguucggggacccgggcgacaucaugagcccccgcgacaagggguuccugugccccgaguuccccggcuccuuccggaaaaagugcaacuucgcgaccaccccgaucugcgaauacgacggaaacaugguguccggcuacaagaaggugauggccaccaucgauagcuuccaguccuucaacaccagcaccaugcacuucaccgaugagagaaucgaguggaaggaccccgacggcaugcuccgggaccacaucaacauccucgucacgaaagacaucgacuucgacaaucugggggagaaccccugcaagaucggccugcagacauccaguaucgagggggccuggggcuccggagugggcuucacccugaccugccucgugagccucacggagugccccaccuuccucaccagcaucaaggcgugcgacaaggccaucugcuacggagccgaguccgucacccugacgagggggcagaauaccgugaaggugagcggcaagggcgggcacuccgggucaaccuucaagugcugccacggugaggacugcucccagaucggccugcacgccgccgcgccgcaccucgacaaaguuaacgggaucagcgagauggagaacaguaagguguacgacgacggcgcgccccaaugcgggaucaagugcugguucgucaagagcggcgaguggaucuccggcaucuucagcgggaacuggaucgugcugaucguauuaugcguuuuccuccuguucucccugguguugcugagcauacugugccccgugcggaagcacaaaaaguccuga

SEQ ID NO: 14976 - RNA, 3408 nt, Artificial Sequence
  derived and/or modified CDS sequence (opt11) from HTNV(Aa14-362)__KT935015.1__GP
augggcauauggaaguggcugguuauggccagccucgucuggcccguucugacccuacgcaacguguacgacaugaagauugagugcccgcacaccgucuccuucggggagaacagugugauaggcuacguggagcucccgcccaugcccuuagccgacacggcccagcuggucccagaguccagcugcuccauggauaaccaccagagccucaacacgauaaccaaauacacccagguguccuggcgggggaaggccgaccaaagccaauccagccagaacucuuuugaggcagugagcacggaggucgaccugaaggggaccugcgugcugaagcacaagaugguggaggaguccuaccgcagccggaaguccaucacgugcuacgaccugagcugcaacuccaccuacugcaagcccacccuguacaugaucguccccauccacgccugcaacaugaugaaaucuugucugaucgcccucgggcccuaccguguccaggugguguacgagaggacguacugcaugaccggcgugcugaucgaaggcaagugcuuugugcccgaccaguccgucgugagcauaauaaagcacgggauauucgacaucgcgagcgugcacaucgucugcuucuucguggccgugaagggcaacaccuacaaaaucuucgagcaggucaagaaguccuucgagagcacgugcaacgauaccgagaacaaggugcagggguauuacaucugcaucgucggcggaaacucagcccccaucuaugugcccacccuggacgacuuccgcagcauggaggccuucaccggcaucuuccggagcccccauggcgaggaccacgaucucgcgggggaggagacggccaccuauucaaucgugggcccggccaacgccaaggucccccacuccgccagcuccgacacccugucccugaucgcguucuccggcauccccagcuacucuagccucuccauccugaccagcaguacggaggccaagcacguguucagccccggccuguucccgaagcucaaccacaccaauugcgacaaaggagcaaucccucugauguggaccgggaugauugacuuaccuggcuacuacgaggccauccaccccugcaccguauucugcguccucuccgggccgggcgccagcugcgaggcguucucagaggguggcauauucaacaucacgucccccaugugccucgugagcaagcagaaccgcuuccggcuuaccgaacagcaggucaacuuugugugccaacgcguggacgucgauaucaucgucuauuguaacggccagcggaaggugaucuugaccaagacacugguaaucggacagugcaucuacaccaucaccuccuuauucagccuccugcccggcguagcccacuccaucgcuguggagcugugcgugcccggguuccauggcugggcaaccgccgcccuccugguaaccuucugcuucgggugggugcugauaccggcaaucacguucaucauucuuaccauccugaaauucaucgccaacauauuucacaccagcaaccaggagaaccgccucaaguccgugcucaggaaaaucaaggaggaguucgagaagacuaagggcagcaugguuugcgacgucugcaaguacgagugcgagacguacaaggagcuuaaggcccacggcguguccugcccccagagccaaugccccuacuguuucacucacugugagcccaccgaggccgcguuccaagcccauuacaaggugugccaggucacccaccgauuccgggacgaccugaagaagaccgugacgccgcagaacuucacccccgggugcuaccguacguugaacuuguuccgcuacaagucccgcugcuacaucuucaccauguggaucuuccuucuuguucuggagagcauccugugggcugccuccgcgagcgagacgccucuaaccccgguguggaaugacaacgcccacggcgugggguccguccccaugcacaccgaccucgagcuggacuucagccuaaccuccagcagcaaguauacguacaggcgcaagcucacuaacccccuggaggaggcccaauccaucgaccugcacaucgagaucgaggagcagaccauuggcguggacgugcacgccuugggacacugguucgauggccggcugaaccugaagaccagcuuccacugcuacggugccugcacgaaguaugaguaucccuggcacaccgcgaagugccacuacgagcgcgacuaccaguacgaaaccucgugggggugcaacccgagcgacugccccggcgucgggaccggcugcacggccugcggccucuaccuggaccgccugaagccugugggguccgccuacaagaucauuaccauccgguacagccgccgagugugcguccaguucggugaggaaaaccucuguaagauuauugauaugaacgauugcuucgugucccgccacgugaaggucugcaucauaggaaccguguccaaguucucgcagggagacacccuccuguucuucgggccccucgaaggcggcgggcugaucuucaaacauuggugcacgagcacuugccaguucggcgacccgggggacaucaugagcccucgggacaagggcuuccugugccccgaguuccccggguccuuccggaaaaagugcaacuucgccaccaccccgaucugcgaauacgacggcaacaugguguccgguuacaagaaggucauggcgaccaucgacagcuuucaguccuucaacacgagcaccaugcacuucaccgacgagcgaaucgaguggaaagaccccgacgguaugcuccgcgaccacaucaacauccuggugacgaaggacaucgacuucgacaaccugggcgaaaaccccugcaagaucgggcuccagaccuccagcaucgagggagcguggggguccggcgugggcuucacacugacaugccucgucagccuuacggagugcccuaccuuucuuaccagcaucaaggccugcgacaaagccaucugcuacggggccgaguccgucacucugacgcggggccagaacaccgugaaggucagcgggaaagggggccacuccggcaguaccuucaagugcugccacggcgaggacugcucccagaucgggcuccacgccgcggccccgcaccuggacaaggugaacggcaucagcgaaauggaaaacuccaagguuuacgacgacggggcgccccagugcggcaucaaguguugguucgucaagagcggggaguggaucuccgggaucuucucugguaauuggaucgugcugaucguccucugcguguuccugcuauucucccucgugcuacugagcauccucugccccguccgcaagcacaagaaguccuga

SEQ ID NO: 14977 - RNA, 3408 nt, Artificial Sequence; identical to SEQ ID NO: 11691
  derived and/or modified CDS sequence (opt11) from HTNV(Aa14-404)__KT935018.1__GP

SEQ ID NO: 14978 - RNA, 3408 nt, Artificial Sequence
  derived and/or modified CDS sequence (opt11) from HTNV(Aa14-423)__KT935022.1__GP
augggcaucuggaaguggcuggugauggccagccucgucuggccagugcugacccuccgcaacguguacgauaugaagaucgagugcccccacaccgucagcuucggcgagaacagcgugaucggcuacguggagcucccgcccaugccccuggcugacacggcgcagaugguccccgaguccagcugcaguauggacaaccaccagagcuuaaauaccaucaccaaguacacccaaguguccuggcgggggaaggccgaccagagccaguccucucagaacuccuucgagacggugagcaccgaggucgaccucaaagggaccugcgugcugaagcacaagaugguggaggaguccuaccgcucgcggaaguccaucacgugcuacgaccugaguuguaacagcaccuacugcaagcccacccucuacaugaucguucccauccacgccugcaacaugaugaaguccugccugaucgccuuagggcccuaccgcguccaggugguguaugagcggaccuauugcaugaccggcgugcucaucgagggcaagugcuucguaccggaccaguccgucgugaguaucauuaagcacgggaucuucgacaucgccagcguccacaucgucugcuucuucguggcggucaaaggcaacacguacaagaucuucgagcaggucaagaaguccuucgaauccacgugcaacgauaccgagaacaagguccagggguacuacauuugcaucgucggcgggaacuccgcccccaucuaugugcccacccuggacgauuuccgcagcauggaagccuucacaggcauauuccggagcccccacggcgaggaccacgaccuggccggggaggagaucgcgaccuacagcaucgugggcccggccaacgccaaggucccccacuccgccucguccgacacccucagccugaucgccuacagcgggaucccgagcuauuccagccuguccauccucaccagcuccacggaggcuaagcacguguucagccccggccuuuucccgaagcugaaccacaccaacugcgacaaguccgccaucccccucauguggacaggcaugaucgaccugcccggguacuacgaggccgugcaccccugcaccgucuucugugugcugagcggcccgggugccagcugcgaggcguuuuccgagggcggcaucuucaauaucacuagccccaugugccucguauccaagcagaaccgcuuccggcugaccgagcagcaggucaacuucgucugccagcgcguggacgucgacaucgugguguacugcaacggccagcggaaggucauccugaccaagacccucgugaucggccagugcaucuacaccaucacgagccuguucucccugcuccccgggguggcgcacagcaucgccgucgagcugugugugcccggcuuccacgggugggcuaccgccgcccugcucgugacuuuuugcuucggguggguccugaucccggcgaucacgcugaucauccucaccauccuaaaguucaucgccaauaucuuccacaccuccaaccaggagaacaggcucaagagcgugcuccggaaaauaaaggaggaguucgagaagaccaagggguccauggugugcgacgucugcaaauacgagugcgagacguacaaggagcugaaggcccacggcgugagcugcccccagucccagugccccuauugcuuuacccacugcgagcccaccgaggccaccuuccaggcccacuacaaggugugccaggucacccaccgcuuccgggaugaccugaagaagacggugaccccgcagaacuucacccccggaugcuaccgcacccucaaccuguuccgcuacaagagccgcugcuacaucuucacgauguggaucuuccugcucgugcuggaguccauccugugggcggccagcgccuccgagacgccccucaccccggucuggaacgacaacgcccacgggguggguagcgugcccaugcacaccgaccuggagcuggacuucucccugaccagcagcuccaaguacaccuaccgccgcaagcucaccaacccccuggaggaggcgcagagcaucgaccugcacaucgagaucgaggaacagaccaucggggucgacguucacgcccuaggccacugguucgacgggcggcugaacuuaaagacgucauuccacugcuacggcgccugcaccaaguacgaauaccccuggcacacugccaagugccacuacgagcgcgacuaccaguacgaaaccuccuggggcugcaacccgucagacugccccggggugggcacggggugcaccgccugcggucucuacuuagaccagcugaagcccgucggcagcgcguacaagaucaucaccauccguuacucccggcgcguaugcgugcaguucggggaggagaaccucugcaagaucaucgacaugaacgacuguuucgugagccgccacgucaaggugugcaucauaggcaccgucuccaaguucagccagggggacacgcugcuguucuucggaccucucgagggcggcggccuuaucuucaagcacugguguaccucuacgugucaguucggggacccgggggacaucaugagcccccgcgacaagggguuccugugccccgaguuccccggcuccuuucggaagaagugcaacuucgcaaccaccccgcucugcgaguacgacgggaacauggugagcggcuacaagaaagugauggccaccaucgacuccuuccagucauucaacaccucaaccaugcacuucacggacgagaggaucgaguggaaagaccccgacggcaugcugcgggaccacaucaacauccuggucaccaaggacaucgacuucgacaaccucggggagaaccccugcaagaucggccugcagaccagcuccaucgagggggccuggggcagcggggugggcuucaccuuaacgugcuuagugagccugaccgaaugccccacuuuccugaccagcaucaaggccugcgacaaggcgaucugcuacggcgccgagagcgucacacucacccgcgggcagaacacugugaagguguccggcaagggcgggcacaguggguccaccuuuaagugcugccacggggaggacugcagccagaucggccugcacgccgccgccccgcaccuggacaaggucaacgggaucucagagauggagaacagcaagguguacgaugacggcgcgccccagugcggaaucaaguguugguucgucaaguccggcgaguggaucagcggaaucuuuagcgggaacuggaucgugcucaucgugcugugcgucuuccugcuguucagccuggugcugcucaguauccugugcccagugcggaagcacaagaaguccuga

SEQ ID NO: 14979 - RNA, 3408 nt, Artificial Sequence
  derived and/or modified CDS sequence (opt11) from HTNV(Aa15-56)__KU207187.1__GP
augggcaucuggaaguggcuggucauggccagccucgucuggcccgugcuuacccugcgcaacguguacgacaugaagaucgaaugcccccacaccgucuccuuuggggagaacagcgugaucggcuacguggagcucccgcccaugccccuggccgacacggcacagcugguccccgagucaagcugcuccauggacaaucaccagagccucaacaccaucaccaaguacacccaggugucguggcggcgcaaggccgaccagagccagucuagccagaacuccuucgagacggucagcacagagguagaccugaagggaaccugcgugcugaagcacaagaugguggaggaguccuaccggagccgcaaguccauuaccugcuacgaccucagcugcaacuccacguacugcaagcccacccuguacaugaucguacccauccacgcgugcaacaugaugaaaagcugccugaucgcccucggccccuaccggguccaggugguguaugagcgcaccuacugcaugacaggggcccugaucgagggcaaaugcuucgugccggaccaguccguggucagcaucaucaagcauggcaucuucgauaucgcgagcgugcacauugugugcuucuucgucgcgguaaaggggaacacguacaagaucuucgagcagguaaagaaguccuuugaaagcacgugcaacgacaccgagaacaagguccagggcuacuacaucugcaucgucgggggcaacuccgcccccaucuacgugcccacccuggacgacuuccggagcauggaggccuucaccgguaucuuccgcagcccccacggcgaggaccacgaccucgcgggcgaggagaccgccaccuacuccaucguggggccggccaacgcuaaggugccccacuccgccagcuccgacacccugagccugaucgcguucuccggcauccccagcuacuccagccucuccauccugacgagcuccaccgaggccaagcacguuuucagccccggccuguucccgaagcucaaccacaccaacugcgacaagggcgccaucccccuaauguggaccggcaugaucgaccugccuggguacuacgaggccauucacccaugcacgguguucugcgugcucuccggcccgggcgccagcugcgaagcguucuccgaaggcgggaucuucaacauuaccucccccaugugccuagucagcaagcagaaccgguuccgccugaccgagcaacaggugaacuucgugugccaaagggucgacguggacaucguggucuacugcaacggccagcgcaaggugauccucaccaagacgcuggugaucggccagugcauauacaccaucacgagucuguucagccuccugccgggggucgcccacuccaucgccguggagcugugcgugcccggcuuccaugggugggcgaccgccgcgcuccuggugacguucugcuucggcugggugcugaucccggccaucaccuuuaucauccucaccaucuugaaguucaucgccaacaucuuucauaccagcaaccaggagaaccggcugaaguccguacuacggaagaucaaggaggaguucgagaaaacgaaggguagcauggucugcgacgugugcaaguacgaaugcgagaccuacaaggagcucaaggcccacggggugaguugcccccaaagccagugccccuauugcuucacccacugcgaacccaccgaggccgcguuccaggcccacuacaaggucugccaggugacccaccgguuccgcgacgacuuaaagaagacggugaccccucagaacuucacucccggcuguuaccggacccucaaccuguuccgcuacaagagucggugcuacaucuucacgauguggauauuccugcucguucuggagagcauccugugggccgccuccgcguccgagacaccccucaccccgguguggaacgacaacgcccacggggugggauccguccccaugcacaccgaccuggagcuggacuucagcuugacguccagcagcaaguacaccuaccgccggaagcucaccaacccccuggaggaggcccaguccaucgaccugcacaucgagaucgaggagcagacuaucgguguggacgugcacgcccucggccacugguucgaugggcgacugaaccugaagacgagcuuccacugcuacggcgccugcaccaaguacgaguaccccuggcacaccgcgaagugccacuacgagcgcgacuaccaguacgagaccuccuggggcugcaauccgagcgacugccccgggguaggcacgggaugcaccgccugcggucucuaccuggaccggcugaagcccgugggcuccgccuauaagaucaucaccaucagauacagccggcgcgugugcguccaauuuggggaagagaaccucugcaagaucaucgacaugaacgacugcuucgugucccgucacgucaaggugugcauuaucggcaccgugagcaaguucucucagggggacacgcuucuuuucuucggcccccucgaagggggcggccugaucuucaagcacuggugcaccagcaccugucaguucggggaccccggugacaucaugagcccccgcgauaagggguuccugugcccugaguuccccggcuccuuccggaagaaguguaacuucgccaccacgccgaucugcgaauacgacggaaacaugguguccggcuacaagaaaguuauggcaaccaucgacagcuuccagucguucaacaccagcaccaugcacuucacggaugagcgcaucgaguggaaggaccccgacggcaugcuccgggaccauaucaacauccuggugaccaaggacaucgacuucgacaacuugggggagaaucccugcaagaucggccuccagaccucaagcaucgagggagcguggggcuccggggucggcuucacccugacgugccuggucagccucaccgagugccccaccuuccugaccagcaucaaggccugugacaaggccaucugcuacggcgccgaguccgugacgcugacccgcgggcagaacaccgugaaggucagcggcaaagggggccacuccgggagcaccuuuaagugcugccacggcgaggacugcucccagaucggacuccacgccgcggccccgcaccuggacaaggugaauggcaucagcgagauggagaacaguaagguguacgacgacggcgcuccccagugcgggaucaaguguugguucgucaagagcggcgaguggaucuccggcaucuuuagcgggaacuggaucgugcugaucguccucugcguauuccugcuguuuucccucgugcugcugagcauccucugccccguccggaagcacaagaaguccuga

SEQ ID NO: 14980 - RNA, 3408 nt, Artificial Sequence; identical to SEQ ID NO: 11694
  derived and/or modified CDS sequence (opt11) from HTNV(CBAa11-106)__KC576787.1__GP

SEQ ID NO: 14981 - RNA, 3408 nt, Artificial Sequence
  derived and/or modified CDS sequence (opt11) from HTNV(CBAa11-26)__KC576786.1__GP
augggcauguggaaguggcuggugaucgccagcuuagucuggcccgcccuaacccuccguaacguguacgacaugaagaucgaguguccgcacaccguguccuuuggggagaacagcgucaucggcuauguggagcucccgcccaugccccuggccgauacggcccagauggugcccgaguccagcugcuccauggacaaccaccagagcaugaacaccaucaccaaauacacccaggucaucuggcggggaaaggccgaccccggccaguccagccagaacuccuucgagacgguuagcaccgagaucgaccugaaggggaccugcgugcucaagcacaagauggucgaggaguccuaccgcagccggaaguccauuaccugcuacgaccugagcugcaacuccacguacugcaaaccaacccuguauaugaucgugcccauccacgccugcaacaugaugaaaagcugccucaucgcucugggccccuaccgcgugcaggucguguacgagcggaccuacugcaugaccggcguacugaucgaaggaaagugcuucguccccgaccaguccguggugagcaucaucaagcauggcaucuucgacaucgcguccguacacaucgugugcuucuucguggcagucaaggggaacacguacaaacuuuucgaacaggugaaaaagagcuucgagagcacgugcaacgacaccgagaacaagguacagggcuacuauaucugcauagucgggggcaacuccgcccccaucuacgugcccacccuggaugauuuccggagcauggaggcauucaccggcaucuuccgguccccgcacggggaggaccacgaccuggcgggcgaggagaucgccagcuacuccaucgucgggcccgccaaugcgaaggugccccacagcgccagcagcgacacccucucucugaucgcguacagugguauccccuccuacagcagccugagcauccucaccuccagcaccgaggccaagcacguguucuccccgggccuguuccccaagcugaaucacacgaacugcgacaagagcgccaucccccucaccuggaccgguaugaucgaccugcccggcuacuacgaggccauccacccgugcaccgucuucugcgugcugaguggucccggcgccagcugcgaggcguucagcgagggaggcaucuucaacaucacgucccccaugugccucgugagcaagcagaaucgcuuccggcugaccgagcagcaggucaacuucgugugccagaggguggacauggacaucgucgucuacugcaacgggcagcggaaggugauccugaccaagacccucgucaucgggcaaugcaucuacacgaucaccucccuguucagccugcucccaggcguggcccacuccaucgccguggagcugugcgucccgggguuucacggcugggccaccgccgcgcugcucgugaccuucugcuucggguggguucugauccccgccaucacguucaucauccugacuguacucaaguucguggccaacaucuuccacaccagcaaccaggagaaccgccugaaguccgugcuacggaagaucaaggaggaguucgagaagaccaagggcagcauggucugcgaugugugcaaguacgagugcgagacguauaaggagcucaaggcccacggcguauccugcccccagagccagugccccuacugcuucacccacugcgagccgaccgaggccgcguuccaggcccacuacaaggucugccaggugacccauagauuucgggacgaccuuaagaagaccgugacuccccagaacuucacccccggaugcuaccgcacccugaaccucuuccgguacaagagucgaugcuacaucuucaccaugugggucuuucugcugaucuuggagagcgugcuuugggccgccuccgcgagcgagacgccgcugacccccguguggaaugacaacgcccacggcgucggguccgugcccaugcacaccgaccucgaacuggacuucagccugaccuccagcagcaaguacacguaccggcgcaagcugacuaacccgcucgaggaggcccaguccaucgaccugcacauagaaauugaggagcagaccaucggcguggacguccacgcccugggucacugguucgacggccggcuuaaccugaagaccagcuuccacugcuacggcgccugcacgaaguacgaguacccguggcacaccgccaagugccacuacgagcgcgacuaccaguaugagaccuccugggguugcaaccccagcgacugcccuggcguggggaccggcugcacggccugcggcuuauaccucgaccagcugaaacccgugggguccgccuacaagaucaucaccauccgcuacagccggcgcgucugcgugcaguucggcgaggagaaccugugcaagaucaucgacaugaacgacugcuucguaagucggcacgugaagguuugcaucaucgggaccgugagcaaguucucccagggugacacccuccuguucuucgggccgcuggaaggcggcggccuuaucuucaaacacuggugcacgagcacaugccaauucggcgaccccggggacaucauguccccacgcgacaagggcuuccugugccccgaguucccggggagcuuccggaagaagugcaacuucgccaccacccccaucugcgaguacgacggcaacauggucucuggcuacaagaaggugauggccacgauagacucuuuccaguccuucaacaccagcaccaugcacuucaccgacgagcgcauugaguggaaggaccccgacgguaugcugcgggaccacauuaacauccucgugaccaaggacaucgacuucgacaaccugggagagaaccccugcaagaucgggcugcagaccuccagcaucgagggcgcguggggguccggugugggcuucaccuugaccugccugguuucucugacggagugcccgaccuuccucaccagcaucaaggccugcgacaaggcgauuuguuacggggccgaguccgugacccugacgcgcggccaaaacaccgucaaggugucagggaagggcgggcacuccggcagcaccuucaagugcugccacggcgaggacugcucccagaucgggcugcacgccgcggcuccccaucucgacaaggugaacggcaucagcgaaaucgagaacuccaaggucuacgacgacggggcuccccagugcggcaucaaguguugguucguaaagagcggcgaguggaucuccgggaucuucagcgggaacuggaucgugcugaucgugcugugcgucuuucuccucuucucccuggucuugcugagcauccugugccccgugagaaagcacaagaaguccuga

SEQ ID NO: 14982 - RNA, 3408 nt, Artificial Sequence
  derived and/or modified CDS sequence (opt11) from HTNV(Fuyuan-Aa-145)__KJ857336.1__GP
augggcauguggaaguggcuggugaucgccagccucgucuggcccgcccugucccugcgcaacguguacgauaugaagaucgagugcccgcacaccgugucauucggggagaacuccgucaucgguuacguggagcucccgcccaugccccuggccgacacugcccagauggugcccgaaagcuccugcagcauggacaaccaccaguccaucaacacgaucaccaaguacacccaggucaucuggcgggggaaggccgaccccggccagagcucccaaaacagcuucgagaccguguccacggagguggaccugaaggggaccugcguccucaagcacaagaugguggaggagagcuaccgcucccgcaagagcauaaccugcuacgaccuguccugcaacagcacauucugcaagcccacgcuguacaugaucgugcccauccacgccugcaacaugaugaaguccugccucaucgcccugggcccguaccggguacagguggucuacgagcggaccuacugcaugaccgggguccugaucgaggggaagugcuucgugcccgaccagagcguggucuccauaaucaagcacggcaucuucgacaucgccagcgugcacguggucugcuucuucgucgccgugaaggggaacaccuacaaacucuucgagcaggucaaaaagagcuucgaguccacgugcaacgacaccgagaacaaggugcagggcuacuacaucugcaucguagggggcaacagugcccccaucuacgugccuacccuggacgacuuccgcuccauggaggccuucaccggcaucuucaagaguccgcacggggaggaccaugaccuggcgggcgaggagaucgccuccuacagcaucgugggacccgccaacgccaaggucccccacuccgccagcucugacacgcucagccugaucgcguacuccggcauccccuccuacuccagccuauccauccugaccagcuccaccgacgccaagcacguguucagcccaggccuguuccccaagcugaaccauaccaauugcgacaaguccgccaucccccucacauggacagggaugaucgaccugccgggcuacuacgaggcaauccacccgugcaccguguucugcguccugagcgggcccggcgcgagcugcgaggcguucuccgaagggggcaucuucaacaucaccagcccuaugugccucguguccaagcagaaccgguuccgccugacggagcagcagguaaacuucgucugccagcggguggacauggacaucguggucuacugcaacggccagcgcaaggugauccugaccaagacccucgugaucggucagugcaucuacaccaucacgagccuguuuucccugcuccccggcgucgcccacagcaucgccguggagcugugcgugccuggguuccacggcugggccaccgccgcgcugcucgucaccuucugcuucgggugggugcugauccccgccgugaccuucaucauccugacgguccucaaguucaucgccaacaucuuccacaccuccaaccaggaaaaccggcucaagagcgugcugcgcaagaucaaggaggaguucgaaaagaccaaggggucgauggugugcgacgucugcaaguacgagugcgagaccuacaaggagcuaaaggcccacggcgugagcugcccccagucccagugccccuacugcuucacgcacugcgagccgaccgaggccgcguuccaggcccauuacaaggugugccaggucacccaccgguuccgcgacgaccugaagaagaccgugacgccccagaacuucaccccuggguguuaccggaccuugaaccucuuccgcuacaagagccggugcuacaucuucaccauguggguguuccugcugauccucgaguccguccugugggccgcuagcgcguccgagaccccgcugacgcccguguggaacgacaacgcccacggcgugggcagcguccccaugcacaccgaccucgagcuggacuucucccugaccagcagcuccaaguacaccuaccgccggaagcugacgaacccccucgaagaggcgcagagcaucgaccugcacaucgagaucgaggagcagaccaucggcguggacgugcacgcccuggggcacugguucgauggccgccucaaccugaagaccucguuccacugcuacggcgccugcaccaaguacgaguacccguggcacacggcgaagugccacuacgagcgggacuaccaguacgagaccagcugggggugcaaccccuccgacugccccggcgucgggaccggcugcaccgccugcggccuuuacuuggaccagcugaagccaguggggagcgccuacaagaucaucacgauccgcuacucccgccgggugugcguccaguucggcgaggaaaaccuguguaagaucaucgacaugaacgacugcuucgugagccgccacgugaaggucugcaucaucgggaccguguccaaguucagccagggcgacacccuccuguucuucgggccguuagagggcggcgggcucaucuucaagcauuggugcaccuccacgugccaguucggcgaccccggggacaucaugagcccccgggacaagggcuucuuaugccccgaguucccaggguccuuccgcaagaagugcaacuucgccaccacccccaucugcgaguacgacggcaacauggugagcggcuacaagaaggucauggccacaaucgacuccuuccagagcuucaacacguccaccaugcacuucacggacgagcggaucgaguggaaggaccccgacgggaugcugcgcgaccacaucaacauccucgugaccaaggacaucgacuucgacaaccugggcgagaaccccugcaagaucgggcugcagacgagcuccaucgagggcgcgugggggagcggggugggcuucacccugaccugccuggucagccugaccgagugcccgacguuccucaccuccaucaaggccugcgacaaggccaucugcuacggggccgagagcgugacccugacccggggucagaacacggugaaggucuccgggaagggcgggcacagcggcuccaccuucaagugcugccacggcgaggacugcagcaagaucgggcugcaugccgcggcgccccaccucgacaaggugaacggcaucuccgagaucgaaaacagcaaggucuacgacgacggggcuccccagugcggcaucaagugcugguucgugaaguccggcgaguggaucagcgggaucuucuccggcaacuggaucgugcugaucguccugugcguguuccuccuguucagccuggugcuucuguccauccugugccccguacgcaagcacaaaaagagcuga

SEQ ID NO: 14983 - RNA, 3408 nt, Artificial Sequence
  derived and/or modified CDS sequence (opt11) from HTNV(Fuyuan-Aa-26)__KJ857334.1__GP
augggcauguggaaguggcuugugaucgccagccucgucuggcccgcccugucccugcgcaacguguacgacaugaagaucgagugcccgcacaccgugagcuucggggagaacuccgucaucggcuacguggagcugcccccaaugccccuggccgacaccgcccagauggugccggagagcuccugcagcauggacaaccaccaguccaucaacacgaucaccaaguacacccaggucaucuggcgggggaaggccgaccccggccagagcucccagaacagcuucgagaccguguccacggagguggaccugaaggggaccugcguccucaagcacaagaugguggaggagagcuaccgcucccgcaagagcauuaccugcuacgaccuguccugcaacagcaccuacugcaagcccacgcuauacaugaucgugcccauccacgccugcaauaugaugaaguccugucucaucgcccugggcccguaccggguccaggugguguacgagcggaccuacugcaugaccggcguccugaucgaggggaagugcuucgugcccgaucagagcgugguuuccaucaucaagcacggcaucuucgacaucgcgagcgugcacaucgugugcuucuucgucgccgucaaggggaacaccuacaaacucuucgaacaggugaaaaagagcuucgaguccacgugcaaugauacugagaacaagguccagggcuacuacaucugcaucgucgggggcaacagcgcccccaucuacgugcccacccuggacgacuuccgcuccauggaggccuucaccggcaucuucaagagcccgcacggggaggaccacgaccuggcgggcgaggagaucgccuccuauagcaucgugggacccgccaacgccaaggugccccacuccgccagcuccgauacgcucagccugaucgcuuacuccggcauccccagcuacuccagccuguccaucuuaaccagcuccaccgacgccaagcacgucuucagcccgggccuguuccccaagcugaaccacaccaacugcgacaaguccgccaucccccucacguggaccgggaugaucgaccugcccggcuacuacgaggccauccacccgugcaccguguucugcgugcugagcgggcccggcgccuccugcgaggcguucuccgaagggggcaucuucaacaucaccagccccaugugccucgucuccaagcagaaccgguuccgccugacggagcaacaggugaacuucgugugccagcgggucgacauggacaucgugguguacugcaacggacagcgcaaggugauccugaccaagacccucgugaucgggcagugcaucuacaccaucacgagccuguucucccugcuccccggcguggcccacagcaucgccgucgagcugugcgucccgggguuccacggcugggccaccgccgcgcugcucgugaccuucugcuuuggcuggguccugauccccgcagugaccuucaucauccugacggugcucaaguucaucgccaauaucuuccacaccuccaaccaggagaaccggcucaagagcguccugcgcaagaucaaggaggaguucgagaagaccaagggcuccauggugugcgacgugugcaaguacgagugcgagaccuacaaggagcucaaggcccacggcgucagcugcccccagucccagugucccuacugcuucacgcacugcgagccgacagaggccgcguuccaggcccacuacaagguaugccaggugacccaccgguuccgcgacgaccugaagaagaccgucacgccccagaacuucacccccggcugcuaccggacccugaaccucuuccgcuacaagagccggugcuacaucuucaccauguggguguuccugcugauccucgaguccgugcugugggccgccagcgcguccgagaccccgcuaacgcccgucuggaacgacaacgcccauggcguggggucugugcccaugcacaccgaccucgagcuggacuucucccugaccagcagcuccaaguacaccuaccgccggaagcugacgaacccccucgaggaggcccagagcaucgaucugcacaucgagaucgaggagcagaccaucggcgucgacgugcacgcccuggggcacugguucgauggccgccucaaccugaagaccuccuuccacugcuacggcgccugcaccaaguacgaguacccguggcacacggcgaagugccacuacgagagagacuaccaguacgagaccagcugggggugcaaccccuccgacugccccggcguggggaccggcugcaccgccugcggccuguaccucgaccagcugaagcccgucgggagcgcuuacaagaucaucacgauccgcuacucccgccgggugugcgugcaguucggcgaggagaaccugugcaagaucauugacaugaacgacugcuucgucucacgccaugugaaggugugcaucaucgggaccgucuccaaguucagucagggcgacacccuccuguucuucgggccgcuggagggcggcgggcucaucuucaagcacuggugcaccuccacgugccaguucggcgaccccggggacaucaugagcccccgggacaaaggcuuccugugccccgaguucccgggguccuuccgcaagaagugcaacuucgccaccacucccaucugcgaguacgacggcaacauggugagcggguacaagaaagugauggccaccaucgacuccuuccagagcuucaacacguccaccaugcacuucaccgacgagcggaucgaguggaaggaccccgacgggaugcugcgcgaccacaucaacauccucgucaccaaagacaucgacuuugacaaccugggcgagaaccccugcaagauagggcugcagacgagcuccaucgagggcgcgugggggagcggcgugggcuucacccugaccugccucgugagccugaccgagugucccacguuccucaccuccaucaaggccugcgacaaggccaucugcuacggggccgagagcgucacccugacccggggccagaacacggugaagguguccgggaagggcgggcacagcggcuccaccuucaaguguugccacggugaggacugcagcaagaucgggcugcacgccgcggcgccccaccucgacaaagucaacggcaucagugagaucgagaacagcaagguguacgacgacggggcuccccagugcggaaucaagugcugguucgucaaguccggcgaguggaucagcgggauauucuccggcaacuggaucgugcugaucguacugugcgucuuccuccuguucagccuggugcuccuguccauccugugccccgugcgcaagcacaaaaagagcuag

SEQ ID NO: 14984 - RNA, 3408 nt, Artificial Sequence
  derived and/or modified CDS sequence (opt11) from HTNV(JS1)__KP970560.1__GP
auggguaucuggaaguggcuggugauggccucucucgucuggcccguccugacccugcgcaacguguacgacaugaagaucgaguguccgcauaccgucuccuucggaggcaacagcguuaucggguacguggagcucccgcccgucccccuggccgacacggcccagauggugcccgaguccagcugcuccauggacaaccaccagagccugaacaccaucgcuaaguacacccagguguccuggcggggcaaggccgaccagagccaguccagccagaacuccuucgagaccgucagcacggagguggaccucaaggggaccugcgugcugaagcacaagaugguugaggaguccuaccgcagccguaaguccgugaccugcuacgaccugagcugcaauuccaccuacugcaagcccacgcucuacaugaucgugcccauacacgccugcaacaugaugaagucaugccugaucgcccugggccccuaccgcguccaggugguguacgagcggaccuacugcaugaccggcguccucaucgaggggaaaugcuucgugcccgaccaguccguggucagcaucaucaagcacggcaucuucgacaucgcgagcgugcacaucgugugcuucuucgucgcagugaaggggaacaccuacaagaucuucgagcaggucaagaaguccuucgagagcacguguaacgacaccgagaacaaggugcagggcuauuacaucugcaucgucgggggcaacuccgcccccaucuacgugccuacccuggacgacuuccgcagcauggaggccuucaccggcauauuccggagcccgcacggagaggaccacgaccuggcgggcgaggagaucgccuccuacuccaucguggggccggccaacgccaaggugccccacagcgccuccagcgacacgcucucccugaucgcguacagcggcauccccuccuacagcuccuuaagcauccucaccuccagcaccgaggcgaagcacguuuucucccccggccuguucccuaagcugaaccacaccaacugcgacaagagcgccaucccccucaucuggacggggaugaucgaccugcccggcuacuacgaggccgugcaccccugcaccguguucugcguccugagcgggccgggcgccagcugcgaggcguucagcgagggcgggauuuucaacaucaccucccccaugugccucgugagcaagcagaaccgcuuucggcugaccgagcagcagguaaacuucgugugccagcgcguggacauggacaucgugguuuacugcaacggccagcgcaaggugauccugacgaagacccucgucaucgggcagugcaucuacaccaucaccucccuguucagucugcuccccggcgucgcccacuccaucgcgguggagcugugcgugcccggguuccacggcugggccacggccgcacuccucgucaccuucugcuucgggugggugcugaucccggccaucaccuucaucauccugaccgugcucaaguucaucgccaacaucuuccacacgagcaaucaagagaaccgccugaaguccguccuccggaagaucaaggaggaguucgagaagaccaaaggcagcauggugugcgacguuugcaaguacgagugcgagaccuacaaggagcucaaggcccacggcgucuccugcccccaaagccagugccccuacugcuucacccacugcgagcccacggaggccgcguuccaggcccacuacaaggugugccaggugacccaccgcuuccgggacgaccugaagaagaccgucaccccgcagaacuucacccccgggugcuaccgcacgcugaaccucuuccgguacaagucccgcugcuacaucuucaccauguggauuuuccugcugguucucgagagcauccugugggccgccuccgcgagcgaaacgccccugaccccgguguggaacgacaacgcccacggcgucggguccgugcccaugcacaccgaccucgagcuggacuucagccugaccagcuccagcaaguacaccuaccggcgcaagcugaccaacccccucgaggaggcccaguccauugaccuccacaucgagaucgaggagcagacgaucggcguggacguccacgcccuggggcacugguucgacggccggcucaaucugaagaccagcuuccacugcuacggcgccugcaccaaguacgaauaucccuggcacaccgcgaagugccacuacgagcgcgacuaccaguacgagacguccugggggugcaacccgucggacugccccggcguggggaccggcugcaccgccugcggccuguaccucgaccagcugaagcccgugggguccgccuacaagaucauuaccaucagguacagccggcgcgucugugugcaguucggagaggggaaccugugcaagaucaucgacaugaacgacugcuucgugucccggcaugucaaagugugcaucaucggcacggugucgaaguucucccagggggacacccuccuguucuucggccccuuggagggcgggggccucaucuucaagcacuggugcaccuccacgugccaguucggggacccgggcgacaucaugagcccccgcgacaagggguuccugugucccgaguuccccggcagcuuccguaagaagugcaauuucgccaccaccccgaucugcgaguacgacggcaacauggucuccggguacaagaaggugauggccaccaucgacagcuuccaguccuucaacaccagcaccaugcacuucaccgacgagcgcaucgaguggaaggaccccgacggcaugcugcgagaccacaucaacauccucgugaccaaggacaucgacuucgacaaccugggggagaaccccugcaagaucggccuccagaccuccagcaucgagggggcguggggcagcggcgucggguucacgcugaccugccucgugucccugaccgagugccccaccuuccucacgagcaucaaggccugcgacaaggccaucugcuauggcgccgaguccgugacccugacccgcgggcagaacaccgucaaggugagcggcaagggcgggcacuccggcagcacguucaagugcugccacggggaggacugcucacagaucggccugcacgccgcggccccgcaccucgacaaggucaacgggaucagcgagaucgagaacuccaagguguacgacgacggcgcgccacagugcggcaucaagugcugguucgucaagagcggggaguggaucuccggcaucuucagcgggaacuggaucgugcugaucgugcugugcguguuccuccuguucuccuuggugcuccugagcauccugugccccgugcggaagcauaagaagucauga

SEQ ID NO: 14985 - RNA, 3408 nt, Artificial Sequence
  derived and/or modified CDS sequence (opt11) from HTNV(LongquanAa-08-150)__JQ912803.1__GP
augggcaucuggaaguggcuggucauggccagccucgucuggcccgccuucacccugcgcaacguguacgacaugaagaucgagugcccgcacaccguguccuucggggagaacagcguaaucggcuacguggagcugccgcccaugccccucgccgacacggcccagauggugcccgaguccagcugcaacauggacaaccaccaguccaugaacacgaucaccaaguacacucaggucagcuggcgggggaaggccgaccaggcccaggccucccagaacagcuucgaggcgguguccgccgagguggaccugaagggcaucugcguccugaagcacaagaugcucgaggagagcuaccgcucccggaaguccaucacgugcuaugaccuguccugcaacagcacuuacugcaaacccacccuguacaugaucgugccaauccacgccugcaacaugaugaaguccugccucaucgcccuggggcccuaccgcgugcaggucguguacgagcggaccuacugcaugacgggcgugcugcucgagggcaagugcuucgucccggaucagagcgugguguccaucaucaagcacgggaucuucgacaucgcgagcguccacaucgugugcuucuucguggcugucaagggcaacaccuacaagcugcuggagcaggucaagaaguccuuccagagcacgugcaacgacaccgagaacaaggugcagggguacuacaucugcaucgugggcgggaacagcgcccccauuuacgugcccacccuagacgacuuccgcuccauggaggccuucagcggcaucuuccggucaccccacggcgaggaccacgaccuggccggggaggagaucgcgagcuacuccaucgucggcccggcaaacgccaaggugccccacagcgccucgagcgacacccugucccucaucgccuacagcgggauccccuccuacagcucccugagcauccuggcguccagcaccgaggccaagcacguguucucccccggcuucuucccgcagcucaaccacaccaagugcgacaaaacggccaucccccugaucuggaccggcaugaucgaccugcccgguuacuacgaggccauccaccccugcaccgucuucugcgugcucaguggcccgggggccuccugcgaggcguucagcgagggcgggaucuucaacaucaccagccccaugugccugguguccaagcagaaccgcuuccggcugacggagcagcaggucaacuucgugugccagcgcguggacgucgacauuaucguguacugcaacggucagcggaaggugaucuugaccaagacccuggucaucggccagugcaucuacaccaucacgagccuguucucccuccugcccgggguggcccauagcaucgccguggagcugugcguccccggcuuccacgggugggccaccgccgcguuacuggugaccuucugcuucggcugggugcugaucccggcccucacccugaucauccugacgauccucaaguucaucgccaacaucuuccacacgugcaaccaggagaaucgccugaaguccguccugcggaagaucaaggaggaguucgagaaaaccaaggggagcauggugugcgacgugugcaaguacgaaugcgagaccuauaaggagcucaaggcccacggcgucuccugcccccagagccagugccccuacugcuucacccacugcgagccaaccgaggcggccuuccaggcccacuaccgcgugugccaggugacccaccgguuccgcgacgaccugaaaaagaccgucacgccgcagaacuucacccccggcugcuaccggacccugaaccucuuucgcuacaagucccggugcuacaucuucaccaugugggugugccugcuggugcucgagagcauccugugggccgccuccgcgagcgaggucccccugaacccgguguggaacgacaacgcccacggggugggcuccgucccgaugcacaccgaccuggaacucgacuucagccugaccuccagcuccaaguacaccuaccgccggcgccugaccaacccccucgaggagacccagagcaucaaccugcauaucgaaauagaggagcagacgaucgggguggacgugcacgcccugggccacugguucgacgggcgccucaaccugaagaccagcuuucacugcuacggcgcaugcaccaaguacgaguaucccuggcacaccgccaagugccacuacgagcgggacuaccaguacgagacgucauggggcugcaacccggcggacugcccaggcgugggcaccggguguaccgccugcggccuguaccucgaccagcugaagcccgugggcagcgccuacaagaucaucaccauccgcuacucccguaaggugugcguacaguucggggaggagaaccugugcaaggugaucgacaugaacgacugcuucguaacgcgccacgucaaggugugcaucaucggcacugugagcaaguucucccagggggacacccuccuguucuucgggccccuggagggcgggggccucaucuucaagcacuggugcaccagcacgugccaguucggggauccgggcgacaucaugagcccccgggacaaggguuuccugugccccgaguuccccggcagcuuccgcaagaagugcaacuucgccaccaccccucugugcgaguacgacgggaacauggucuccggcuacaagaaggugauggccaccaucgacagcuuccaguccuuuaacacgagcaccaugcacuucaccgacgagcguauugaguggaaggaccccgacggcaugcuccgcgaccauaucaacauccuugugaccaaggacaucgacuucgacaaccugggggaaaaucccugcaagaucggccuccaaacaaguuccauugagggggcguggggcuccggggucggcuucacccugaccugccugaucagccucaccgagugccccacguuccugaccuccaucaaggccugcgacaaagccaucugcuacggcgccgagaguguaacccugacccggggccagaacacggugaaggucuccggcaagggcgggcacagcgggagcaccuucaagugcugccacggcgaggaaugcucccagaucggccuccacgcggccgccccgcaccuggacaaggugaacgggaucagcgagaucgagaacaacaagguguacgacgacggugcgccccagugcggcgucaagugcugguucgugaaguccggugaguggaucagcggcaucuucuccgggaacuggaucguccugauugugcucugcguguuccugcuguucagccucguccugcuguccgugcucugccccgugcgcaagcacaagaaguccuga

SEQ ID NO: 14986 - RNA, 3408 nt, Artificial Sequence
  derived and/or modified CDS sequence (opt11) from HTNV(LongquanAa-08-157)__JQ912804.1__GP
auggagaucuggaaguggcuuguuauggccagccucgucuggcccgccuuuacccuccgcaauguguacgacaugaagaucgaaugcccgcacaccguguccuucggugagaacagugucaucggguacguugagcugucucccaugcccuuagcggacacggcucagauggugcccgagagcuccugcaacauggacaaccaucagagcaugaacacaaucaccaaguacacccaggucuccuggcggggcaaggccgaucaggcccaggccucgcagaauagcuucgaggcugugagugccgagguggacuuaaaggggacgugcguccugaagcauaagaugcucgaggagagcuaccgcucucggaaguccauuaccugcuacgaccugagcugcaacuccaccuacugcaagccgacccuguauaugaucgugcccauccacgccugcaacaugaugaaaagcugccucaucgcccugggccccuaccgcgugcagguagucuacgagcggacguacugcaugaccggagugcugaucgagggcaagugcuuuguccccgaccaauccguggucagcaucaucaagcacggcaucuuugacaucgcuuccguacacauugugugcuucuucguagccgucaagggcaacaccuacaaguuguucgagcagguaaagaaguccuuccagucgaccuguaacggcacggaaaacaaggugcagggguacuacaucugcaucgucgggggcaauuccgccccgaucuacgugcccaccuuggacgacuuccgcagcauggaggcuuucuccgggauuuuccggagcccccauggggaagaccacgaucuggccggggaggaaauugcguccuauagcaucgucggccccgccaacgccaaggugccgcacuccgccagcucugacacccucucauuaauagccuacuccggaauccccucauacuccagccuguccauccuugcuagcuccaccgaggccaagcacguguucagucccggcuucuucccccaacugaaccacacgaagugugacaagacugccaucccgcuuacauggacgggcaugaucgaucuccccggguacuaugaggccauucaccccugcacggucuuuugcguacugucuggccccggggcuagcugcgaggcguucagcgagggcgggaucuucaacaucaccuccccgaugugccucguaagcaagcagaaccgcuuccggcucaccgagcagcaggucaacuuugugugccagcgcguagacauggacaucaucgucuacugcaauggccagcgcaaggugauccuuaccaagacgcuggugaucgggcaaugcaucuauaccauaacgucccucuucagccuucugcccggagucgcccacaguaucgccguggaacucugcgugcccggcuuccacgggugggccaccgccgcgcugcugguuacguuuugcuuuggcugggugcucauccccgcccugacucugaucauucugaccauccuaaaguucaucgccaaccuguuccacaccagcaaccaagagaaccgccucaaguccgugcugcguaagaucaaggaggaguucgagaagacgaaggggagcaugguuugcgacgugugcaaguacgagugcgagaccuacaaggagcugaaggcccacggcguguccuguccgcagagccagugccccuacugcuucacccauugcgagcccaccgaagcggccuuccaagcgcacuaccgcgucugccagguaacgcaccgguuccgcgacgaccucaaaaagaccgugacaccccagaacuucaccccuggauguuaccggaccuuaaaccuauuccgcuacaagucccggugcuacaucuucacgauguggguuugccuccuagugcuggaaagcauccucugggccgccuccgcgagcgaggugccccugaaccccgucuggaacgauaacgcccacggggucggcuccgugccuaugcacacugaccuggagcuggacuucagccucaccuccagcagcaaauacacuuaccgccggcgccugacgaauccccuggaggagacccaguccaucaaccuccacaucgagaucgaggagcagaccaucgguguagacguucacgcccugggccacugguucgacggucgccuuaacuuaaaaaccagcuuccacugcuacggcgcuugcacgaaguacgaguaccccuggcacacggccaagugccacuacgagcgugacuaccaguaugagaccuccuggggcugcaaccccgcggacugcccgggugucggcaccggcugcacggccugcggucuguaccuggaccagcucaagcccgucgggagcgccuauaagaucaucaccauccgcuacucccggaaagugugcguucaguucggggaggagaaccugugcaaggucauugacaugaacgacugcuucgugacccgccacguuaaagucugcaucauaggaacugugagcaaguucucccagggggacacgcuccuguucuucggcccccuggaagggggcggccuuaucuucaagcacuggugcaccagcaccugucaguucggggaccccggcgacaucauguccccacgggacaagggguuccucugccccgaguuccccggcagcuuccgcaaaaagugcaacuucgccaccacgccccuuugcgaguaugacgguaacauggugaguggcuacaagaaagucauggcuacuaucgacagcuuccaauccuucaacaccagcaccaugcacuucacggacgagcggauagaguggaaggacccggacggcauguuaagagaccacauaaacauccucgugaccaaggacaucgacuucgacaaccugggggagaaccccugcaagaucggccugcagaccuccucgaucgagggggcguggggcuccggggugggcuucacccucacgugccugaucagccugaccgagugccccaccuuccucaccuccaucaaggccugcgacaaagccaucugcuauggcgccgagagcgucacgcugacccgggggcagaacaccguaaaggugagcggcaagggcgggcacuccgggagcaccuuuaagugcugccacggcgaggagugcucccagaucggguugcacgcagcugcaccccaccucgacaaggucaacgggaucuccgagaucgagaacaacaagguguacgacgacggcgccccacaaugcggggugaagugcugguucgucaaguccggcgaguggauaagcggcauauuuuccggcaacuggaucguguuaaucgucuuaugcguguuccuccuguucagccucguccuccuguccguccugugccccgugcgcaagcacaaaaagagcuga

SEQ ID NO: 14987 - RNA, 3408 nt, Artificial Sequence; identical to SEQ ID NO: 11701
  derived and/or modified CDS sequence (opt11) from HTNV(LongquanAa-08-196)__JQ912805.1__GP

SEQ ID NO: 14988 - RNA, 3408 nt, Artificial Sequence
  derived and/or modified CDS sequence (opt11) from HTNV(LongquanAa-08-235)__JQ912810.1__GP
auggagaucuggaaguggcuggugauggccagucucgucuggccagccuucacccugcgcaacguguacgacaugaagaucgagugcccgcacaccguguccuucggcgagaacagcgucaucggguacguggagcucccgcccaugccccucgccgacaccgcccagauggugcccgaguccagcuguaacauggacaaccaccaguccaugaacaccaucaccaaguacacccaagucagcuggcggggcaaggcagaccaagcccaggccucccagaacagcuucgaggcggucuccgccgagguggaccugaaggggacgugcguccugaagcacaagaugcucgaggagucguaccgcucccggaaguccaucacgugcuacgaccuguccugcaacagcaccuacugcaagcccacccuguacaugaucgugcccauccacgccugcaacaugaugaaguccugccucaucgcucugggacccuaccgcgugcaggucguguaugagcggaccuauugcaugacgggggugcugaucgagggcaagugcuucgucccggaccaaagcgugguguccaucaucaagcauggcaucuucgacaucgcaagcguccacaucgugugcuucuucguggccguuaaggggaacaccuacaagcuguucgagcaggucaagaaguccuuccagagcacgugcaacggcaccgagaacaaggugcagggguacuauaucugcaucguuggcgggaacagugcccccaucuacgugcccacccuggacgacuuccgcuccauggaggccuucagcggcaucuuccggagcccccacggcgaagaccacgaccuggccggggaggagaucgcguccuacuccaucgucggcccggcaaacgccaaggugccccacagcgccaguagcgacacccucuccuuaaucgcauacagcggcaucccguccuacagcucccugagcauccucgcguccagcaccgaggccaagcacguguucucucccggcuucuucccgcagcugaaccacacgaagugcgacaagaccgccaucccccugaccuggaccggcaugaucgaccuccccggguacuacgaggcaauccaccccugcacggucuucugcgugcugagcggcccgggagccuccugcgaggcguucagcgagggcgggaucuucaacaucaccagccccaugugccugguguccaagcagaacagguuccggcucaccgagcagcaggucaacuucgugugccagcgcguggacauggacaucaucgucuacugcaacggccagcggaaggugauccugaccaagacgcuggugaucggccagugcaucuauaccaucaccagccucuucucccugcugcccggggucgcccacagcaucgccguggagcucugcgugcccggcuuccacgggugggccaccgccgcgcugcuggucacguucugcuucggaugggugcucaucccggcccugacccugaucauccucaccauccugaaguucaucgccaacauauuccacaccaguaaccaggagaaccggcucaagagcgugcuccggaagaucaaggaggaguucgagaagacgaagggguccauggucugcgacgugugcaaguacgagugcgagaccuacaaggaguugaaggcccacggcgugagcugcccccagucccagugccccuacugcuucacccacugcgagcccaccgaggcggccuuccaggcccacuaccgcgucugccaggugacgcaccgguuccgcgacgaccugaagaagaccgugaccccgcaaaacuucaccccuggcugcuacaggacccucaacuuguuccgcuacaagagccggugcuacaucuucacgaugugggucugccugcucguguucgaguccauccugugggccgccagcgcguccgaggugccucugaacccggucuggaacgacaacgcccacggggugggcagcgugcccaugcacaccgacuuggagcuggacuucucccugaccagcuccagcaaguacaccuaccgccggcgccugacgaacccccucgaggagacccagagcaucaaccugcacaucgagaucgaggaacagaccaucgggguagacgugcacgcccugggccacugguucgacgggcgccucaaccugaagaccuccuuccacugcuacggcgccugcacgaaguacgaguaccccuggcacaccgccaagugccacuacgagcgggacuaccaguacgagaccucguggggcugcaacccggcggacugccccggggugggcaccggaugcacggccugcggccuguaccucgaccagcugaagcccgucggcuccgccuacaagaucaucaccauccgcuacagccggaaggugugcgugcaguucggggaggagaaccugugcaaggucaucgacaugaaugacugcuucgugacccgccacgugaaggucugcaucaucggcaccguguccaaauuuagccagggggacacgcuccuguucuucggcccccuggagggcggaggccucaucuucaagcacuggugcaccuccacgugccaauucggggacccgggcgacaucaugagcccccgggacaagggguuccugugccccgaguuccccggcuccuuccgcaagaagugcaacuucgccaccaccccgcugugcgaguacgacgggaacauggugagcggcuacaaaaaggucauggccaccaucgacuccuuccagagcuucaacaccuccaccaugcacuucacggacgagcggaucgaguggaaggaccccgacggcaugcuacgcgaccacaucaacauccuggugaccaaggacauagacuuugacaaccugggggagaaccccugcaagaucggccuccagacuagcuccaucgagggggcguggggcagcggggucggcuucacccugacgugccugaucucccucaccgagugccccaccuuccugaccagcaucaaggccugcgacaaggccaucugcuacggcgccgaguccgucacgcugacccgugggcagaacaccgugaaggugagcggcaagggcgggcacagcggauccaccuucaagugcugccauggcgaggagugcagccagaucggccuccacgcggccgcaccgcaccuggauaaggucaacgggaucuccgagauugagaacaacaagguauacgacgacggcgcgccccagugcggggugaagugcugguucgucaagagcggcgaguggaucuccggcaucuucagcgugaacuggaucguccugaucgugcucugcguguuucugcuguucucgcucguccugcugagcguucucugccccgugcgcaagcacaagaagucauga

SEQ ID NO: 14989 - RNA, 3408 nt, Artificial Sequence; identical to SEQ ID NO: 11703
  derived and/or modified CDS sequence (opt11) from HTNV(LongquanAa-09-171)__JQ912824.1__GP

SEQ ID NO: 14990 - RNA, 3408 nt, Artificial Sequence
  derived and/or modified CDS sequence (opt11) from HTNV(LongquanAa-09-191)__JQ912825.1__GP
auggagaucuggaaguggcuggugauggccagccucgucuggcccgccuucacccugcgcaacguguacgacaugaagauugagugcccgcacaccguguccuucggcgagaacagcgucaucggguacguggagcucccccggaugccccuagccgacaccgcccagauggugccggaguccagcugcaacauggacaaccaccaguccaugaacacgaucacuaaguacacucaaguuucauggcgcggcaaggccgaccaggcccaggccucccagaacagcuucgaggcgguuagugccgagguggaccugaaggguacgugcguccuuaaacacaagaugcucgaggagagcuacaggucccgcaagagcauuaccugcuacgaccuguccugcaacagcaccuacugcaagccgacacuguacaugaucguccccauccaugcgugcaacaugaugaaguccugucuaauugcccugggccccuaccgggugcaggucguguacgagcgcacguacugcaugaccggggugcugaucgagggcaagugcuucguucccgaucagagcgugguguccaucaucaagcacggcaucuucgauaucgcgagcguccacaucguguguuucuucguggccgucaaggggaacaccuacaagcuguucgagcagguuaagaaauccuuccagucuacaugcaauggcacggagaacaaggugcagggguacuacaucugcaucgucggugguaacagcgcaccuauauacgugcccacccuggacgacuuccggagcauggaggccuucagcggcaucuuucgcuccccucacggcgaagaccacgaccuggccggcgaggagaucgcgagcuacuccaucguuggccccgccaacgccaagguuccgcacagcgccuccagcgacacccucucgcugaucgccuacagcgggauccccuccuacagcucccugagcauccucgcguccagcacagaggccaagcacguguucucccccggcuucuucccccaacuaaaccacacaaagugcgacaagaccgccauuccgcugaccuggaccggcaugaucgaccucccuggguauuacgaagccauccaccccugcacggucuucuguguguuaucaggccccggcgccuccugcgaggcguucagcgagggcgggaucuucaacaucaccagcccgaugugccuuguguccaagcaaaaccgguuccggcucaccgagcagcaggucaacuuugugugccagcgaguggacauggacaucaucgucuacugcaacgggcagcgcaaggugauccucaccaagacguuagugaucggccagugcaucuacaccaucaccagccucuucucccugcugcccgggguagcccacagcaucgccguggagcucugcgugcccggcuuucaugggugggccaccgccgcccugcuggucacguucugcuucggcuggguucuuauaccagcccuuacccugauuauccucacaauccugaaguuuauagcgaacaucuuccacaccuccaaccaggaaaaccgucucaagagcgugcucaggaagauuaaggaggaguucgagaagacgaaggggucgauggucugcgacgugugcaaguaugagugcgagaccuacaaggagcugaaggcacacggcguuuccuguccgcaaucccagugucccuauugcuucacgcacugcgaaccaaccgaagcggccuuucaagcccacuaccgggucugucaggugacacaccgcuuccgggacgaccuuaagaagacugugacgccccagaacuucaccccgggcugcuaccgcacccucaaccuguuccgguacaagagccgcugcuacaucuucaccauguggguuugccuguugguccuugagucuauacugugggccgcuagcgcguccgaggugccccucaaccccgucuggaacgacaacgcccacggggugggcagcgugccgaugcacaccgaccuggaguuagauuucuccuugaccagcuccagcaaguacaccuaccggcgccgccucacgaacccccuggaggagacccagagcaucaacuuacacaucgagaucgaggagcaaacaaucggggucgacgugcacgcccucggccacugguucgacgggcggcugaauuugaagaccucguuccacuguuacggcgccugcacuaaauacgaguacccauggcacaccgccaagugucacuacgagagggacuaccaguacgaaaccagcuggggcuguaaccccgcggacugcccggggguggguaccgggugcacggccugcggccucuaccuggaccaacugaagcccgucggcuccgccuacaagaucaucaccauccgguacagccgcaaaguaugcgugcaguucggggaggagaaccucuguaaggucauagacaugaaugacugcuuugugacccggcacgugaaggucugcauuaucggaaccguguccaaguucagccaaggugacacgcugcuguuuuucggcccccucgagggcggcgggcugaucuucaagcacuggugcaccaguaccugccaguucggggaccccggagacaucauguccccgcgcgacaagggguucuuaugccccgaguuccccggcagcuuucggaaaaagugcaauuucgccacgacaccccucugugaauacgacgggaacauggugucaggcuacaagaaggugauggccaccaucgacuccuuccagaguuuuaacaccuccaccaugcacuucacggacgagcgcaucgaauggaaagacccggacggcaugcugcgggaccacaucaacauccuggugaccaaggacaucgacuucgacaaccucggggagaauccuugcaagaucggccugcagaccagcuccaucgagggggcaugggguagcggggugggcuucacccugacgugccucaucucccugaccgagugccccacauuccugaccagcaucaaggccugcgacaaggccaucugcuacggcgccgaauccgucacgcucacgcgagggcagaacaccgugaagguuagcggcaaagggggccacagcggauccaccuucaaguguugccauggcgaggagugcagccaaaucggccugcacgcggccgcgccccauuuagacaaggucaauggcauuuccgaaaucgagaacaacaagguguacgacgacggagccccgcagugcggggugaagugcugguucguaaagagcggcgaguggauuuccggcaucuucagcgggaacuggauugugcucaucguccuguguguguuccuccuguucucccuggugcugcucagcguccugugccccgugcggaagcacaagaaguccuga

SEQ ID NO: 14991 - RNA, 3408 nt, Artificial Sequence
  derived and/or modified CDS sequence (opt11) from HTNV(LongquanAa-09-350)__JQ912835.1__GP
auggagaucuggaaguggcuggugauggccucacucgucuggcccgccuuuacucgccggaacguauacgauaugaagaucgagugcccgcacacgguguccuucggcgagaacagcgucaucggguacguggagcugccgcccaugccccuggcugacacggcccaaauggugcccgaguccagcugcaacauggacaaccaccaguccaugaacaccaucaccaaguacacccaaguaagcuggcgcggcaaggccgaccaggcacaggcgucccagaacagcuucgaagcgguguccgccgagguggaucucaagggaacgugcguccugaagcacaagaugcuggaggagagcuaccggagucgcaagucuaucacgugcuaugaccucuccugcaacagcacuuacugcaagcccacccuguacaugaucgugcccauacacgccuguaacaugaugaaguccugccugaucgcccucggcccauaccgggugcaggucguuuaugagcgcacguacugcaugacgggggugcugaucgaggguaagugcuucgugccggaccagagcgugguguccaucaucaagcacggcauuuucgacaucgcgagcguucacauaguaugcuucuucguggccgucaaggggaauaccuacaagcuguucgagcaggucaagaaguccuuccagagcacgugcaacggcaccgagaauaaggugcagggguacuacaucugcaucgugggcgggaacagcgccccgaucuacgugcccacccucgacgauuuccgguccauggaggccuucagcggcaucuuccgcagcccccacggcgaggaccacgaccuggccggggaggagaucgcgagcuacuccaucgucggcccggccaacgcuaaggugccccacucagccuccagcgacacccuuucccucauagccuacucagggauccccucauacagcucccugagcauccuggcauccagcaccgaggccaaacacguguucucccccggcuucuuuccgcagcucaaccacacgaagugcgacaagaccgccaucccccugacuuggaccggcaugaucgaucugcccggguacuacgaggccauccaccccugcacggucuucugcgugcucagcggcccuggggccuccugcgaggcguucagcgagggcgggaucuucaacaucaccagcccgaugugccugguguccaagcagaaccgguucaggcugaccgagcaacaggucaacuucgugugccagcggguggacauggacaucauagucuacugcaacggccagcgcaagguuauccucaccaagacgcuggugaucggccagugcaucuacaccaucaccagccuguuuucccuccugcccggggucgcccacagcauugccguggagcugugcgugcccggcuuccacggcugggccaccgcugcgcugcuggucacauucugcuucggcuggguguugaucccggcccucacccugaucauccugaccauccucaaguucaucgccaacauauuccacaccuccaaccaggagaaccgguuaaaguccgugcugcgcaagaucaaagaggaguucgagaagacgaagggguccauggucugcgacgugugcaaguacgagugcgagaccuacaaagagcucaaggcccacggcgugagcugcccccaaucccagugccccuacugcuucacccacugcgagcccaccgaggcggccuuccaggcccacuaccgggucugccaagugacgcaccgcuuucgggacgaccugaagaagacggugaccccgcagaacuucacccccggcugcuaccgaacccugaaccucuuucgguacaagagccgaugcuacaucuucacgauguggguaugccugcugguucucgagucgauccugugggccgccagcgcguccgagguuccccugaacccggucuggaacgacaacgcacacggggugggcagcguucccaugcacaccgaccucgaacuggacuucucccugaccagcuccagcaaguacaccuaccggcgccgccugacgaacccccucgaggagacccagagcaucaaccugcacaucgagaucgaggagcagaccaucggugucgacgugcacgcccugggccacugguuugacgggcggcucaacuugaagaccuccuuccacugcuacggcgccugcacgaaguacgaguaccccuggcacaccgccaagugccauuacgaacgcgacuaccaguacgaaaccagcuggggcugcaacccggcagacugccccggggugggcaccgggugcacggccugcggccuguaccucgaccaacugaagcccgucggcuccgccuacaagaucaucacaauccgguacagccguaaggugugcgugcaguucggggaggagaaccugugcaaggucauugacaugaacgauugcuucgucacccggcacguuaaagucugcauaaucggcaccguguccaaguucagccagggggacacgcuccuguucuucggcccccuggagggagggggccucaucuucaagcacuggugcaccucgacgugccaauuuggggacccgggagauaucaugagcccccgcgacaagggguuccugugcccggaguuccccggcuccuuccggaagaagugcaacuucgccaccaccccgcugugcgaguacgacgggaacaugguaagcgguuacaagaaggucauggccaccaucgauuccuuccagagcuucaacaccuccaccaugcacuucacggacgagcgcauagaguggaaggaccccgacggcaugcuccgggaccacaucaacauccuggugaccaaggacaucgauuucgacaaccugggggagaaccccugcaagaucggccuccagacuagcuccaucgagggagcguggggcagcggggugggcuucacccugacgugccugaucagccucaccgagugccccaccuuccugaccagcaucaaggccugcgauaaggccaucuguuacggcgccgaguccgucacgcugacccgcggccagaacacggugaaggugaguggcaagggcgggcacagcggguccaccuucaagugcugccauggcgagaagugcagccagaucggccuccacgcggccgccccgcaccuggacaaggucaacgggauuuccgagaucgagaacaacaaaguguacgacgacggggcgccccagugcgggguaaagugcugguucgucaagaguggcgaguggaucuccggcaucuucagcgggaacuggaucgugcugaucguccucugcguguuccugcuguucagucucguccugcugagcguacucugccccgugcgaaagcauaagaaguccuga

SEQ ID NO: 14992 - RNA, 3408 nt, Artificial Sequence
  derived and/or modified CDS sequence (opt11) from HTNV(LongquanAa-09-489)__JQ912844.1__GP
auggagaucuggaaguggcuggugauggcuagccucgucuggcccgccuucacccugcgcaacguguacgacaugaagaucgagugcccgcacaccguguccuuuggcgagaacagcgucaucggguacguggagcugccccggaugccccucgcggacacggcccagauggugcccgaguccagcugcaacauggacaaccaccaguccaugaacaccaucaccaaguacacccaggucagcuggcgcggcaaggccgaccaggcccaggccucacagaacagcuucgaggcgguguccgccgagguggaucugaaggggaccugcguccugaagcacaagaugcucgaggaauccuaccgaagccgcaagagcauuaccugcuacgaccuguccugcaacagcaccuacugcaagccgacccuguacaugaucgugcccauccacgccugcaacaugaugaaguccugccucaucgcccugggccccuaccgggugcaggucguguacgagcgcacguacugcaugaccggggugcugaucgagggcaagugcuucguccccgaccagucggugguguccaucaucaagcacggcaucuucgacaucgcgagcguccacaucgugugcuucuucguggccgucaaggggaacaccuacaagcuguucgaacaggugaagaaguccuuccagagcacgugcaacgguaccgagaacaaggugcagggguacuacaucugcaucgucggcgggaacagcgccccgauauacgugcccacccuggacgacuuccgguccauggaggccuucagcggcauuuuccgcagcccccacggcgaggaccacgaccuggccggggaggagaucgcguccuacuccaucgucggccccgccaacgccaaggugccgcacagcgccuccagcgacacccucucccugaucgccuacagugggauccccuccuacucgucccugagcauccucgcguccagcaccgaggccaagcacguguucuccccuggcuucuucccccagcugaaccacacgaagugcgauaagacugccaucccgcugaccuggaccggcaugaucgaccuccccgguuacuacgaggccauccaccccugcacgguguucugcgugcugagcggccccggggccuccugcgaggcguuuagcgagggcgggaucuucaacaucaccagcccgaugugccugguguccaagcagaaccgguuccgccucaccgagcaacaggucaacuucgugugccagcgggucgacauggacaucaucgucuacuguaacggccagcgcaaggugauccugaccaagacgcuggugaucggccagugcaucuacaccauaaccagccucuucucccugcugcccggggucgcccacagcaucgcgguggaguuaugcgugcccgguuuccacgggugggccaccgccgcccugcuggucacguucugcuucggcugggugcucauccccgcccugacccugaucauccucaccauccugaaguucaucgccaacaucuuccacaccucuaaccaggagaaccggcucaagagcgugcuccgcaagaucaaggaggaguucgagaagacuaagggguccauggucugcgacgugugcaaguacgagugcgagaccuauaaggagcugaaggcccacggcgugagcugcccccagucccagugccccuacugcuucacccacugcgagcccaccgaggcggccuuccaggcccacuaccgggucugccaggugacgcaccgcuuccgggacgaccugaagaagaccguaacgccccagaacuucaccccgggcugcuaccgcacccucaaccuguuccgguacaagagccgcugcuacaucuucaccaugugggucugccugcucgugcuggaguccauucugugggccgccagcgcguccgaggugccccucaaccccgucuggaacgacaacgcccacggggugggcagcgugccgaugcacaccgaccugcagcuggacuucucccugaccagcuccagcaaguacaccuaccggcgccgccucacaaacccccuggaggagacucagucuaucaaccugcacaucgagaucgaggagcagaccaucggggucgacgugcacgcccucggccacugguucgacgggaggcugaaccugaagaccuccuuccacugcuacggcgccugcacgaaguacgaguaccccuggcacaccgccaagugccacuacgagcgcgacuaccaguacgagaccagcuggggcugcaaccccgcggacugcccugggguaggcaccgggugcacggccugcggccucuaccuggaccagcugaagcccgucggcuccgccuacaagaucaucaccauccgguacagccgcaaggugugcgugcaguucggggaggagaaccucugcaaggucaucgacaugaacgacugcuucgugacccggcacgugaaggucugcaucaucggcaccguguccaaguucagccagggggacacgcugcuguucuucggcccccucgaagggggcggccugaucuucaagcacuggugcaccuccaccugucaguucggggaccccggcgacaucaugagcccgagggacaagggguuccugugcccagaguuccccggcuccuuccggaagaagugcaacuucgccaccacgccccucugcgaguaugacgggaacauggugagcggcuacaagaaggucauggccaccaucgacuccuuccagagcuucaacaccaguaccaugcacuucacggacgagcgcaucgaguggaaggacccggacggcaugcugcgggaccacaucaacaucuuagugacgaaggacaucgacuucgacaacuuaggggagaaccccugcaagaucgggcugcagaccagcuccaucgagggggcuuggggcagcggggugggcuucacccugacgugccucaucucccugaccgagugcccuaccuuccugaccagcaucaaggccugcgacaaggcgaucugcuacggcgccgaguccgucacucucacccgcgggcaaaacaccgugaaggugagcggaaaagggggccauagcggguccaccuucaagugcugccacggagaggagugcagccagaucggccugcacgcggccgcuccccaccuggacaaggucaacgggauauccgagaucgagaacaacaagguguacgacgacggcgccccgcagugcggagugaagugcugguucgucaagagcggcgaguggaucuccggcaucuucagcgggaacuggaucgugcucaucguccugugcguguuccuccuguucucccuggugcugcugagcguccugugccccgugagaaagcacaagaaguccuga

SEQ ID NO: 14993 - RNA, 3408 nt, Artificial Sequence
  derived and/or modified CDS sequence (opt11) from HTNV(LongquanAa-09-541)__JQ912850.1__GP
augggcaucuggaaguggcuggugauggccagccucgucuggcccgccuucacccugcgcaacguguacgacaugaagaucgaguguccgcacaccguguccuucggcgagaacagcguaaucggcuacguggagcugccgcccaugccccucgccgacaccgcccaaauggugcccgaguccagcugcaacauggacaaccaccaguccaugaacacgaucaccaaguacacccaggucagcuggcgggggaaggccgaccaagcccaggccucccagaacagcuucgaggcgguguccgccgagguggaccugaagggcaucugcguccugaagcacaagaugcucgaggagagcuaccgcucccgcaagagcaucacgugcuacgaccuguccugcaacagcaccuacugcaagcccacccuguacaugaucgugcccauccacgccugcaacaugaugaaguccugccucaucgcccuugggcccuaccgggugcaggucguguacgagcggaccuacuguaugacgggcgugcugcucgagggcaagugcuucgucccggaccagagcgugguguccauuaucaaacacggcaucuucgacaucgcgagcguccacaucgucugcuucuucguagccgucaagggcaacaccuacaagcuguucgagcaggucaagaagucauuccagagcacaugcaacgggaccgagaacaagguccagggcuacuacaucugcaucgucgggggcaacagcgcccccaucuacgugcccacccuggacgacuuccgguccauggaggccuucagcggcaucuuccggagcccccacggggaggaccacgaccucgccggcgaggagaucgcguccuacuccaucguggggccggccaacgccaaggugccccacuccgccuccagcgacacccugucccugaucgccuacagcgggauccccuccuacagcucccucucgauccuggcguccagcaccgaggccaagcauguguucucccccggcuucuucccgcagcugaaccacaccaagugcgacaagacggccaucccccucaccuggaccgggaugaucgaccugcccggcuacuacgaggccauccaccccugcaccgucuucugcgugcugagcgggccgggcgccuccugcgaggcguucagcgagggcgggaucuucaacaucacgagccccaugugccucguguccaagcagaaccgcuuccggcugaccgaacaacaggucaacuucgugugccagcgcguggacauggacaucaucgucuacugcaacggccagcguaaggugauccuaaccaagacccucgugaucgggcaguguaucuacacgaucacaagccuguucucccugcuccccggcgucgcccacagcaucgcgguggagcugugugugcccggguuccacggcugggccaccgccgcgcuguuagucaccuucugcuucgggugggugcugaucccggcccugacgcucaucauccugaccauccugaaguucaucgccaacaucuuccacaccuccaaucaggagaaccgccucaagagcgugcugcggaagaucaaggaggaguucgaaaagaccaagggcuccauggucugcgacguguguaaguacgagugcgagacguacaaggagcugaaggcccacggcgugagcugcccccagucccagugccccuacugcuucacccacugcgagcccacagaggcggccuuccaggcccacuaccgcgucugucaggugacccaccgguuccgcgacgaccucaagaagacggugacgccccagaacuucacccccggguguuaccggaccuuaaaccuguuccgcuacaagagccggugcuauaucuucaccaugugggucugccuccuggugcuggaguccauccucugggccgccagcgcguccgaggugccccugaacccggucuggaacgacaacgcgcacggcguggggagcgugcccaugcauaccgaccuggagcuggacuucucccucaccagcuccagcaaguacaccuaccgccggcgccugaccaacccccuggaggagacgcagagcaucaaccuccacaucgagaucgaggagcagaccaucggcgucgacgugcacgcccuggggcacugguucgacggccgccugaaccucaagaccuccuuccacugcuacggcgcuugcaccaaguaugaguaccccuggcacacggccaagugccacuacgaacgggacuaccaguacgagaccagcugggggugcaacccggcggacugccccggcguggggaccggcugcaccgccugcggccuguaccucgaccaguugaagcccgucggguccgccuauaagaucaucacgauccgcuacagccggaaggugugcgugcaguucggcgaggagaaccugugcaaggucaucgacaugaacgacugcuucgugacccgccacgugaaggucugcaucaucgggaccguguccaaguucagccagggcgacacccuccucuucuucgggccccuggaggguggcgggcugaucuucaagcacuggugcacguccacgugccaguucggcgacccgggggacaucaugagcccccgggacaagggcuuccucugccccgaguucccuggguccuuccgcaagaagugcaacuucgccaccaccccgcugugcgaguacgacggcaacauggugagcggcuacaagaaggucauggccaccauagacuccuuccagagcuucaacacauccaccaugcacuucaccgacgagcggauugaguggaaggaccccgacgggaugcugcgcgaccacaucaacauccucgugacgaaggacaucgacuucgacaaccugggcgagaaccccuguaagaucgggcugcagaccagcuccaucgagggcgcgugggggagcggcgugggcuuuacccugaccugccugaucucccugacggagugccccaccuuccucaccagcaucaaggccugcgacaaggccaucugcuacggggccgagagugucacccugacucggggccagaacaccgugaaggugagcgggaagggcgggcacagcggcuccaccuucaagugcugccacggcgaggaaugcagccagaucgggcugcaugcugccgccccgcaccucgacaaggucaacggcaucuccgagaucgagaacaacaagguguacgacgacggugcgccccagugcggcgugaagugcugguucgucaagagcggcgaguggaucuccgggaucuucagcggcaacuggaucgugcugaucguccuguguguuuuccuccuguucucccuggugcuccugagcguccucugccccgugcgcaagcacaagaaguccuag

SEQ ID NO: 14994 - RNA, 3408 nt, Artificial Sequence; identical to SEQ ID NO: 11708
  derived and/or modified CDS sequence (opt11) from HTNV(LongquanAa-09-698)__JQ912854.1__GP

SEQ ID NO: 14995 - RNA, 3408 nt, Artificial Sequence
  derived and/or modified CDS sequence (opt11) from HTNV(LongquanAa-10-393)__JQ912859.1__GP
auggagaucuggaaguggcuggugauggcuucccuugucuggccagccuuuacccugcgcaacguguacgacaugaaaaucgagugcccccacaccgugucuuucggcgaaaacagcgucaucggauacguagaacugccgcccaugccccucgccgacacggcccagauggugcccgaguccagcuguaacauggacaaccaccaguccaugaacaccaucaccaaguacacccaggugagcuggcggggcaaggccgaccaagcucaggccucccagaacagcuucgaggcaguguccgccgagguggaucugaaggggacgugcguccugaagcacaagaugcucgaggagucuuaccgcucccggaaguccaucacgugcuacgaucuguccugcaacaguaccuacugcaagccgacgcuguacaugaucgugcccauccacgcuugcaauaugaugaaguccugccucauugcucugggccccuaccgcgugcaggucguguaugagaggaccuacugcaugaccggggugcugaucgagggcaaauguuucgucccugaccagagcgugguguccaucaucaagcauggaaucuuugacaucgccucaguacauaucgugugcuucuucgucgccgucaaggggaauaccuacaagcuguucgagcaggucaagaaaaguuuccagagcacuugcaacgggaccgagaacaaggugcagggguacuacaucugcaucguaggcgggaacucggcccccauuuacguccccacccuggacgacuuccgcuccauggaggccuucucaggcaucuuccguagcccccacggcgaagaucacgaccuggcaggcgaggagaucgccaguuacuccauagucggcccggcaaacgccaagguaccccacagcgccuccucagacacucucucccugauagccuacuccgggauccccuccuacucuucccugagcauccucgcguccagcaccgaggccaagcacguguucagccccggcuucuucccgcaacucaaucacacgaagugcgacaagaccgcuaucccccugaccuggaccggcaugaucgaccucccaggauacuacgaggccauccaccccugcacggucuucugcguccucagcggcccgggggccuccugcgaggcguucagcgagggcggaaucuucaacaucaccucacccaugugccugguuuccaagcagaacagguuucggcuaaccgagcagcagguaaacuucgugugccagcgaguggacauggacaucaucguuuauugcaacggccagagaaaggugauccugaccaagacacugguaaucggccagugcaucuacacaaucaccagucucuucucccugcugcccggggucgcucacagcaucgcgguggaguugugcguacccggcuuccacgggugggcuaccgccgcgcugcugguaacguucugcuucggccgcgugcucaucccggcccugacgcugaucauccucaccauccugaaguucaucgccaacaucuuccacacaucuaaccaagagaaccggcuuaaauccguacuacgcaagaucaaagaggaguucgagaagacgaaggggucuauggucugcgacgugugcaaauacgagugcgagaccuacaaggagcugaaggcccacggcgucagcugcccccagucccagugucccuacugcuucacccacugcgagcccaccgaggcggcauuccaggcucacuacagggugugucaaguuacgcaccgcuuccgggaugacuuaaagaagaccgugacgccgcagaacuucacccccggcuguuaccgcacccucaaccuguuccgguacaagagccgcugcuacaucuucacgaugugggucugucuacucgugcuggaauccauccugugggccgccagcgcguccgaggugccccucaauccggucuggaaugacaacgcccacgggguaggcagcgugcccaugcacaccgaccuggagcuggacuucucccugaccagcuccagcaaguacaccuaccgacggcggcucacgaauccccuggaggagacccagagcaucaaccugcacaucgagaucgaggaacagaccaucggggucgacgugcacgcacucggccacugguucgacgggcggcugaaccugaagacguccuuccacuguuacggcgcaugcacgaaauacgaguacccuuggcacaccgccaaaugccacuacgagcgagacuaccaguacgaaaccaguuggggcugcaacccugccgacugucccggggugggcaccgggugcacggccugcggccuauaccuggaucagcugaagcccgucggcuccgccuacaagaucaucaccauccgguauagccgcaaggugugcgugcaguucggggaggagaaccuaugcaaggucaucgacaugaacgacugcuucgugacccggcacgugaaggucugcaucaucggcaccguguccaaguuuagccagggugacacgcugcuguucuucggcccccucgaaggcggaggcuuaaucuucaagcacuggugcacguccacgugucaguucggggacccgggagacaucaugucgcccagagacaagggguuucugugccccgaguuccccggcuccuuccggaagaaaugcaacuucgccaccaccccgcuuugcgaguacgacgggaacauggugagcggcuacaagaaggucauggcgacaaucgacuccuuccagaguuucaauaccuccacuaugcauuucacggacgagcgaaucgaguggaaggaccccgacggcaugcugcgagaccacaucaacauccuggugacgaaggacaucgacuucgacaaccucggggagaaccccugcaagaucggccuccagaccucguccaucgagggggcguggggcuccggggucggcuucacacugacgugccucauaucccugaccgagugccccaccuuccugaccuccaucaaagcaugugacaaggccaucugcuacggcgcagaguccgucacgcucacacgaggacaaaacaccgugaaggugaguggcaagggcgggcacagcggguccaccuucaaaugcugucacggcgaggagugcagccaaauaggcuuacacgcggcggcgccgcacuuagacaaggucaacggcauuagcgagaucgagaacaacaaggucuacgacgacggugcgccccagugcggggugaagugcugguuugucaagagcggcgaguggauuuccggcaucuucagcggcaacuggaucgugcucaucguccugugcguguuccuccuguucucucuugugcugcucagcguauugugcccggugcggaagcauaagaaguccuaa

SEQ ID NO: 14996 - RNA, 3408 nt, Artificial Sequence
  derived and/or modified CDS sequence (opt11) from HTNV(LongquanAa-10-58)__JQ912861.1__GP
auggagaucuggaaguggcuggucauggccagccucgucuggccagccuucacccugcgcaacguguacgacaugaagaucgagugcccgcacaccguguccuucggcgaaaacagcgucaucggguacguggaguugccgcccaugccccucgccgacacggcccaaauggugcccgaguccagcugcaacauggacaaccaccaguccaugaacaccaucacgaaguacacucaggucagcuggcggggcaaagccgaccaggcccaggcaucccagaacagcuucgaggcgguguccgccgagguggaccugaaggggacgugcguucugaagcacaagaugcucgaggagagcuaccgcucccggaagucuaucacgugcuacgaccuguccuguaacagcaccuacugcaagcccacccuguauaugaucgugcccauccacgccugcaacaugaugaagaguugccucaucgcccugggccccuaccgcgugcaggucguguacgagcggaccuacugcaugaccggggugcugauagagggcaagugcuucgucccggaccagagcgugguguccaucaucaagcacggcaucuucgacaucgcaagcguccacaucgugugcuucuucguggccgucaaggggaacaccuacaaguuguucgagcagguuaagaaguccuuccagagcacgugcaacggcaccgagaacaaggugcagggguacuacaucugcaucgugggcgggaacagcgcccccaucuacgugcccacccuggacgacuuccgcuccauggaggccuucagcggcaucuuccggagcccccacggcgaggaccacgaccuggcaggggaggagaucgcgagcuacuccaucgucggcccggcuaacgcaaaggugccccacagcgccuccagcgacacccucucccugaucgccuacagcgggauccccuccuacucaucccugagcauccucgcguccagcacagaggccaagcacgucuucucccccggcuucuucccgcagcugaaccacacaaaaugcgacaagaccgccaucccccugaccuggaccggcaugaucgaccuccccggguacuacgaggccauccaccccugcacggucuucugcgugcugagcggcccgggggccuccugcgaggcguucagcgagggcgggaucuucaacaucaccagccccaugugccugguguccaagcagaaccgcuuccggcucaccgagcaacaggucaacuucgugugccagcgcguggacauggacaucauagucuacugcaacggccagcggaaggugauccugaccaagacgcuugugaucggccaguguaucuacaccaucacuagccucuucucccugcugcccggggucgcccacagcaucgccguggagcucugcgugcccggcuuccacgggugggccaccgccgcgcugcuggucacguucugcuuuggcuggguccucaucccggcccugacccuuaucauccuaaccauccugaaguucaucgccaacaucuuccacaccuccaaccaggagaaucgccuaaagagcgugcuccggaagaucaaggaggaguucgagaagacgaagggguccauggucugcgacgugugcaaguacgagugcgagaccuacaaggagcugaaggcccacggcgugagcugcccccagucccagugccccuacugcuucacccacugcgagcccaccgaggcagccuuccaggcccacuaccgcgucugccaggugacgcaccgguuccgcgacgaccugaagaagaccgugacgccccagaacuucacccccggcugcuaccggacccucaaccuguuccgcuacaagagccggugcuauaucuucaccaugugggucugccugcucgugcuggaguccauccugugggccgccagcgcguccgaggugccccucaacccggucuggaacgacaacgcccacggggugggcagcgugcccaugcacaccgacuuagagcuggacuucucccugaccagcaguagcaaguacaccuaccgccggcgccucacgaacccccuggaggagacccagagcaucaaccugcacaucgagaucgaggagcagaccaucggggucgacgugcacgcccucggccacugguucgacggccgccugaaccugaagaccuccuuccacugcuacggcgccugcacgaaguacgaguacccauggcacaccgccaagugccacuacgagcgggacuaccaguacgagaccagcuggggcugcaacccggcggacugccccggggugggcaccgggugcacggccugcggccucuaccuggaccagcugaaacccgucggcuccgccuacaagaucaucaccauccgcuacagccggaaggugugcgugcaguucggggaggagaaccucugcaaggucaucgacaugaacgacugcuucgugacccgccacgugaaggucugcaucaucggcaccguguccaaguucagccagggggacacgcugcuguucuucggcccccucgagggcgggggccugaucuucaagcacuggugcaccuccacgugucaguucggggacccgggcgacaucaugagcccccgggacaagggguuccugugccccgaguuccccggcuccuuccgcaagaagugcaacuuugccaccaccccgcucugcgaguacgacgggaacauggugagcggcuacaagaaggucauggcuaccaucgacuccuuccagagcuucaacaccuccaccaugcacuucacggacgagcggaucgaguggaaggaccccgauggaaugcugcgcgaccacaucaacauccuggugacuaaggacauugacuucgacaaccucggggagaaccccugcaagaucggccuucagaccagcuccaucgagggggccuggggcagcggggugggcuuuacccugacgugcuuaaucagucugaccgagugccccaccuuccugaccagcaucaaggccugcgacaaggccaucugcuacggcgccgaguccgucacgcucacccgggggcagaacaccgugaaggugucaggcaagggcgggcacagcgggagcaccuucaagugcugccacggagaggagugcagccagaucggccugcacgcggcggccccgcaccuggacaaggucaacggcaucuccgagaucgagaacaacaagguguacgacgacggcgcgccccagugcgggguuaagugcugguuugucaagagcggcgaguggaucuccggcaucuucagcgggaacuggauugugcucaucguccugugccuguuccucuuauucucccuggugcuccugagugugcugugccccguccgcaaacacaagaaauccuga

SEQ ID NO: 14997 - RNA, 3408 nt, Artificial Sequence; identical to SEQ ID NO: 11711
  derived and/or modified CDS sequence (opt11) from HTNV(LongquanAa-10-74)__JQ912864.1__GP

SEQ ID NO: 14998 - RNA, 3408 nt, Artificial Sequence
  derived and/or modified CDS sequence (opt11) from HTNV(LongquanAa-10-98)__JQ912866.1__GP
auggaaaucuggaaguggcugguuauggccagccucgucuggcccgccuuuacccugcgcaacguguaugacaugaagaucgaguguccgcacaccguguccuucggggagaacagcguaauaggguacguggaacuaccucccaugccccucgccgacacggcgcagauggugccggagagcagcuguaacauggacaaucaucagagcaugaacaccauuaccaaauacacccaggucagcuggcgaggcaaggccgaccaggcccaggccucccagaacagcuucgaggcgguguccgccgagguggacuuaaaggggacgugcguauuaaagcauaaaauguuagaggaaagcuacagaucccgcaaaagcauuaccugcuaugaccuguccugcaacucaaccuauugcaaacccacccuguacaugaucguccccauacaugccugcaacaugaugaaguccugccucauugcccugggccccuaucgggugcaggucguguacgagcggaccuacugcaugaccgggguacugauugagggcaaaugcuucgucccggaccagagcguugucuccaucauuaagcacggcaucuucgacaucgcgagcguccauauaguguguuucuuuguggccgucaaggggaacaccuacaagcuccuggaacaggucaagaaauccuuccaguccacgugcaacgauaccgagaacaagguacaaggcuacuacaucugcauugucgggggcaacagcgcacccauauacgugcccacccuggacgacuuccguuccauggaggccuucagcgggaucuuccggagcccccauggcgaggaccaugaucucgccggcgaggagaucgcguccuauuccauagucggucccgccaacgccaaagugccgcacagcgccuccagcgauacccugucccugaucgccuauucuggaauccccuccuacucuucccucagcauucuggcguccuccacggaggccaaacacguguucucucccggguucuucccgcagcugaaccauacgaagugcgacaagaccgccauaccccucacguggaccgguaugauagaccugccuggguacuacgaggccauucaucccugcacuguguucugcgugcugagcgggccaggcgccuccugcgaggcguucagcgagggcggaauauucaacaucacgagcccaaugugucucguguccaaacagaaccgcuuucggcugaccgagcagcaaguaaacuucgugugccagcgcguagacauggacauaaucgucuacugcaacgggcagcggaaggucauauugaccaaaacgcuggucaucggccagugcaucuacaccaucacaucccuguucucccuucuaccaggagucgcccacagcauugccguagagcugugcguacccggguuccacgguugggccaccgccgcgcuccucgucacuuucugcuucggguggguccugaucccggcccugacccuaaucauccugaccauccugaaguucaucgcuaacauuuuccacacgucgaaccaggagaaccgcuuaaagagugugcugcggaagaucaaagaagaguucgagaaaacaaagggcuccauggucugcgacgugugcaaguacgagugcgagaccuacaaggagcucaaggcccacggggugucuugcccccaaucccagugccccuacugcuuuacgcauugcgagcccaccgaagcggccuuccaggcccacuaccgcgucugccaggugacgcaccgcuuccgcgacgaucucaagaagacagugacuccccagaacuucaccccgggcuguuaccguacccugaaccuguuccgcuacaagucgcgguguuacauauucacgauguggguuugccuccuggugcuggaguccauccucugggccgcaagcgcuagugaggugcccuuaaacccggucuggaaugacaacgcccacggcguggggucuguacccaugcacaccgaccuggagcuggacuuuucccucacgagcuccucuaaguacacguaccgccgccgacuaacgaacccucuggaggagacccagagcauuaaccuccacaucgagaucgaggagcagaccaucggcgucgacguacacgcccuugggcacugguucgacggccgccugaaccucaaaaccuccuuucacugcuacggggccugcacgaaguacgaguaccccuggcacacagccaagugccacuacgaacgugacuaccaguacgaaaccagcugggguugcaauccggcggacugccccggcgucgggaccggaugcacggccugcgggcuguaccuggaccaguuaaagcccgucggcucagccuacaagaucaucaccauucgcuacagccggaaggugugcguucaguucggagaagaaaacuuaugcaaagucaucgacaugaacgauugcuucgugacucggcacgugaaggucugcauuaucgggaccguguccaaguucagccagggcgacacgcuccuguucuucgggccccuggagggcggugggcugaucuucaagcacuggugcacaagcacgugccaguucggggauccgggggacaucaugucgccccgggacaaaggcuuccugugcccggaguucccgggguccuuccgcaaaaagugcaacuucgccaccaccccgcugugugaguacgacgguaacaugguaagcggcuacaagaagguaauggccaccaucgacucauuccagagcuucaacaccuccaccaugcacuucacggacgagcggaucgaguggaaggaccccgauggcaugcugcgcgaccacaucaauauccucgugaccaaggacaucgacuuugacaacuuaggcgagaacccauguaaaauaggccuccagaccagcuccauagagggcgcgugggggagcggagugggguuuacccucacaugucugaucucccuaaccgagugccccacuuuccucaccaguaucaaggcuugcgauaaggccauuugcuacggggccgaguccgucacccugacccgggggcagaacacggugaaggucagcgggaagggcgggcacaguggguccaccuucaaaugcugucacggggaggagugcagccagaucggccugcaugccgccgccccgcaccuagauaaagucaacgguauuuccgagaucgagaauaacaaaguguacgacgauggggcgccccagugcggcgucaaguguugguucgugaaaagcggagaguggaucagcggaauuuucagcggaaacuggauagugcugauuguccucugcguguuccucuuguucucccuagugcucuugagcguccugugccccgugcgaaagcacaagaagucuuaa

SEQ ID NO: 14999 - RNA, 3408 nt, Artificial Sequence
  derived and/or modified CDS sequence (opt11) from HTNV(LongquanAa-11-452)__KC344264.1__GP
auggagaucuggaaguggcuggugauggccagccucgucuggcccgcuuucacacugcguaacguguacgacaugaagaucgaguguccgcacaccguguccuucggcgagaacagcgucaucggguacguggagcugccgcccaugccccucgccgacacggcccagaugguacccgaguccagcugcaacauggacaaucaucaauccaucaacaccauuaccaaguauacccaggucagcuggcggggcaaagccgaccaagcccaggccucccagaacagcuucgaggcgguguccgccgagguggaccugaagggcacaugcguccugaagcauaaaaugcucgaggagagcuaccgcucccgcaagucgaucacgugcuacgaccuguccugcaacucgaccuacuguaagcccacccuguauaugaucgugcccauccacgccugcaacaugaugaaguccugccucauugcccugggcccuuaccgggugcaggucguguacgagcggaccuauugcaugaccgggguucugaucgaggggaaaugcuucgucccggaccagagcgugguguccaucaucaagcacggcaucuucgacaucgcgagcguccacaucgugugcuucuucguagcggugaaggggaacaccuacaagcuccuggagcaagucaagaaguccuuccagagcacgugcaacgacacggaaaacaaggugcaaggcuacuacaucugcaucgucgggggcaacucggcgcccauauaugugccaacccuggacgauuuccgcucuauggaggccuucagcgggaucuuccggagcccccacggcgaggaccacgaccucgccggcgaggagaucgcuuccuauuccaucaucgggccagccaaugccaaggugccucacucugccuccagcgacaccuuaucccugauagcauacagcgguauccccucguacagcucccuaagcauucuggcguccagcaccgaggccaaacacgucuucucccccggguucuucccgcagcugaaucacacaaagugcgacaagaccgcuauaccccucaccuggaccgggaugauagaccuacccggcuacuacgaagcgauacauccuugcacgguguucugcguccugagcgggccgggcgccuccugcgaggcuuucagcgagggagggaucuucaacaucaccagccccaugugucucguguccaagcagaaucgcuuccggcugaccgagcagcaggucaacuucgugugccagcgcguggacauggacauaaucguguacugcaacggccagcggaaggucauccugaccaagacgcucguuaucggccagugcaucuacaccaucaccagccuguucucccugcuccccggaguggcgcauagcaucgccgucgaacugugcguacccggguuccacggcugggccaccgccgcgcugcucgugacguucuguuucggauggguccugaucccggcccugacccucaucaucuuaaccauccucaaguucaucgccaacauauuccacaccuccaaccaggaaaaccgccucaaaagcgugcugcggaagaucaaggaggaguucgagaagacgaagggcagcauggugugcgacgucugcaaguacgagugugagaccuacaaggagcugaaggcccacggcgugagcugcccccaaucgcagugucccuacugcuucacccacugcgagcccaccgaggcggccuuccaggcccacuaccgcgugugccagguaacgcacagauucagggacgaccucaagaagaccgugaccccgcaaaacuucacgcccgggugcuaccggacccugaaucuguuccgcuacaagagccggugcuacaucuucacgauguggguaugccuccugguacuggaguccauccucugggccgccagugccuccgaaguaccccugaacccgguguggaacgacaacgcccacggcgucggcagcgugcccaugcacaccgaccuggagcuggauuucucccugaccagcucuagcaaauacaccuaccgccgucgccugacgaauccccucgaggagacacagagcaucaaccugcacaucgagaucgaggagcaaaccaucggcguggauguccacgcccuggggcacugguucgauggccgccugaaccucaagaccuccuuccacugcuacggcgccugcacgaaguaugaguaucccuggcacaccgcgaagugccacuacgagcgggauuaccaauacgagaccagcuggggcugcaacccggcggacuguccaggcguggggaccgggugcacagccugugggcuguaccucgaccagcucaaacccgugggcuccgccuacaagaucaucaccauccgcuacagccggaaggucugcgugcaguucggcgaggagaaccugugcaaggugaucgacaugaaugacugcuucgucacccgccacgugaagguuugcaucauugggaccgucaguaaguucagccaaggcgacacgcuccuguucuucgggccgcuggaagggggcggccugaucuucaagcacuggugcaccuccacgugccaguucggcgacccgggggacaucaugagcccccgggacaagggcuuccucugccccgaguucccuggguccuuccgcaagaagugcaacuucgccaccaccccgcugugcgaguacgacggaaacaugguuagcggguacaagaaggugauggcuaccaucgacuccuuccagagcuuuaauaccuccaccaugcacuucacggacgagcggaucgaguggaaggaccccgacggaaugcugcgcgaccacaucaacauccuagucaccaaggacaucgacuucgacaaccugggcgagaaucccugcaagaucgggcugcagaccagcagcaucgagggcgcgugggggucgggcguggguuucacccucacgugccugauuucccugaccgagugccccaccuuccucaccagcaucaaggccugcgacaaagccauaugcuacggcgcggaguccgugacgcugacuaggggccagaacaccgucaaggugagcgggaagggcgggcacagcggcaguaccuucaagugcugccacggggaggaguguagccagauaggccugcacgcggccgccccgcaccucgauaaggugaacggcaucuccgagauagagaacaacaaagucuaugaugacggggcgccccaaugcggcgugaagugcugguucgucaaaagcggcgaguggaucucaggcaucuucagcggcaacuggaucguccucaucgugcugugcguguuccuccuauucucccuugugcuccugagcgugcugugcccgguccgcaagcacaagaagucguga

SEQ ID NO: 15000 - RNA, 3408 nt, Artificial Sequence
  derived and/or modified CDS sequence (opt11) from HTNV(LongquanAa-11-473)__KC344263.1__GP
augggcaucuggaaguggcuggugauggccagccucgucuggcccgccuucacccugcgcaacguguacgacaugaagaucgagugcccgcacaccguguccuucggggagaacagcgucaucggcuacgucgagcugccacccaugccccucgccgacacggcccagauggugcccgaguccagcugcaacauggacaaccaccaguccaugaacaccaucaccaaguacacccaggucagcuggcgggggaaggccgaucaggcccaagccucccagaacagcuucgaggcgguguccgccgagguggaccugaagggcaucugcguccugaagcacaagaugcucgaggagagcuaccgcucccggaaguccaucacgugcuacgaccuguccugcaacagcaccuacugcaagcccacccuguacaugauugugcccauccacgccugcaacaugaugaaguccugccucaucgcccuggggcccuaccgcgugcaggucguguacgagcgaaccuacugcaugaccggcgugcugcucgagggcaagugcuucgucccggaccagagcgugguguccaucaucaagcacgggaucuucgacaucgcgagcguccacaucgugugcuucuucguggccgucaagggcaacaccuacaagcuguucgagcaggucaagaaguccuuccagagcacgugcaacgacaccgagaacaaggugcagggguacuacaucugcaucgugggcgguaacagugcccccaucuacgugcccacccuggacgacuuccguuccauggaggcuuucagcggcaucuuccggagcccccacggcgaggaccacgaucucgccggggaggagaucgcgagcuacuccaucguuggcccggccaacgccaaagugccccacagcgccuccagcgacacgcugucccugauagcuuacagcgggauccccuccuacagcucccucagcauccuggcgaacuccaccgaggccaagcacguguucagccccggcuucuucccgcagcugaaccacaccaagugcgacaagacggccaucccacugaucuggaccggcaugaucgaccugcccggguacuaugaggccauccaccccugcaccgucuucugcgugcuguccggcccgggggccagcugcgaggcguucuccgagggcgggaucuucaacaucaccagccccaugugccucgugagcaagcagaaccgcuuccggcugacggagcagcagaucaacuucgucugccagcgcguggacguggacaucaucgucuacugcaacggccagcggaagguuauccugaccaagacccucgugaucggccaguguaucuacaccaucacgucccuguucagccugcuccccggggucgcccacagcaucgccguggagcugugcgugcccggcuuccacggaugggccaccgccgcgcugcucgucaccuucugcuucggcugggugcugaucccggcccugacccucaucaucuugacaauccugaaguucaucgccaacaucuuccacaccucaaaccaggagaaccgccugaaguccgugcugcggaagaucaaggaggaguucgagaagaccaaggggagcauggucugcgacgugugcaaguacgaaugcgagaccuacaaggagcugaaggcccacggcguguccugcccccagagccagugccccuacugcuucacgcacugcgagcccaccgaggcagccuuccaagcccauuaccgcgucugccaggugacccaccgguuccgcgacgaccucaagaagaccgugacgccgcagaacuucacccccggcugcuaccggacccugaacuuguuccgcuacaagucccggugcuauaucuucaccaugugggucugccuccuggugcuggagagcauccucugggccgccuccgcgagcgaggugccccugaacccggucuggaacgauaacgcccacggggugggauccgugcccaugcacacugaccuggagcuggacuucagccucacguccagcuccaaguacaccuaccgccggcggcugaccaacccccuggaggagacccagagcaucaacuuacacauagagaucgaggagcagacgaucggggucgacguccaugcccucggccacugguucgacgggcgccugaaccucaagaccagcuuccacugcuacggcgccugcaccaaguacgaguaccccuggcacaccgccaagugccacuacgagcgggacuaccaguacgagacgucuuggggcugcaauccggcggacugccccggggugggcaccgggugcaccgccugcggccuguaucuggaccagcucaaacccgucggcagcgccuacaagaucaucaccauccgcuacucccgcaaggugugcgugcaguucggggaggagaaccugugcaaggucaucgacaugaacgacugcuucgugacgcgccacgugaaggucugcaucauuggcaccgugagcaaguucucccagggggacacccuccucuucuucggcccccuggagggcggcgggcugaucuucaagcacuggugcaccagcacgugccaguucggggacccgggggacaucaugagcccccgggacaagggguuccucugccccgaguuccccggcagcuuccgcaagaagugcaacuucgccaccaccccgcugugcgaguacgacgggaacauggucucaggcuacaagaaggucauggccaccauugacucuuuccaguccuucaauacgagcaccaugcauuucaccgacgagcggaucgaguggaaggaccccgacggcaugcugcgcgaccacaucaacauccucgugaccaaggacaucgacuucgacaaccugggggagaaccccugcaagaucggccugcagacguccagcaucgagggggcguggggcuccggggugggcuucacccugaccugccugaucagucugaccgagugccccacguuccucaccuccaucaaggccugcgacaaggcuaucugcuacggcgcugagagcgucacccugacccgggggcagaacacggugaagguguccggcaagggcgggcacuccgggagcaccuucaagugcugccacggcgaggaaugcucccagauuggccugcacgcggcagccccgcaccucgacaaggucaacgggaucagcgagaucgagaacaacaagguguacgacgacggcgcgccccagugcggggugaagugcugguucgucaaauccggcgaguggaucagcggcaucuucuccgggaacuggaucgugcugaucguccuguguguguuccuccuguucagccuggugcuccuguccguccugugccccgugcgcaagcacaagaaguccuga

SEQ ID NO: 15001 - RNA, 3408 nt, Artificial Sequence; identical to SEQ ID NO: 11715
  derived and/or modified CDS sequence (opt11) from HTNV(LongquanAa-11-642)__KC344262.1__GP

SEQ ID NO: 15002 - RNA, 3408 nt, Artificial Sequence
  derived and/or modified CDS sequence (opt11) from HTNV(LongquanAa-11-774)__KC344257.1__GP
auggagaucuggaaguggcuggugauggccucacucgucuggccagccuucaccuugcgcaacgucuacgauaugaagaucgagugcccgcacaccgugaguuuuggcgagaacagcgucaucggguauguggagcugccgcccaugccccucgccgacacggcccagauggugcccgaguccagcugcaacauggacaaccaucaguccaugaacaccaucacuaaguacacacaggugagcuggcggggaaaagccgaucaggcccaagccucccagaacagcuucgaagcgguguccgccgagguggaccugaaggggacgugcgucuuaaagcacaagauguuagaggagagcuacagguccaggaaguccaucacgugcuaugaccuguccuguaacucaacguacugcaagccuacccuguacaugaucgugccaauccacgccugcaacaugaugaaguccugccucaucgcccugggcccguaccgcgugcaagucguuuacgagcggaccuacugcaugaccggcgugcugaucgagggcaagugcuucgucccggaccagagcgugguguccaucaucaagcauggcaucuucgauaucgcgagcguccacaucguaugcuucuucguggccgucaaggggaacaccuacaagcuguucgagcaggucaagaaauccuuccagagcacgugcaacggcaccgagaauaaggugcagggguacuacaucugcaucgugggcgggaacagcgcacccaucuacgugcccacccuggacgauuuccgcuccauggaggccuucagcggcaucuuccggucuccccacggcgaggaccacgaccuggccggggaagagaucgcgagcuacuccaucgucggcccggccaacgccaaggugccccacagcgccuccagcgauacccucucccugaucgccuacagcgggauccccuccuacagcucccugagcauacucgcgucgagcaccgaggcgaagcacguguucucccccggcuucuucccgcagcugaaccacacgaagugcgacaagaccgccaucccccuaaccuggaccggcaugaucgaccugccgggguauuacgaggccauccaccccuguacgguauucugcgugcugagcgguccgggggcguccugugaggcguucagcgagggcgggaucuucaacaucaccagccccaugugccugguguccaagcagaaccgcuuccggcucaccgagcagcaggucaacuucgugugccagcgcguggacauggacaucaucgucuacugcaauggacagcggaaggugauccugacaaagacgcuggugaucggccagugcauauauacaauaaccagccucuucucccugcuacccggggucgcccacagcaucgccguggagcucugcgugcccggcuuccacgggugggccaccgccgcccugcuggucacguuuugcuucggcuggguacucaucccagcccugacccugaucauccucaccauccugaaguucaucgccaacaucuuccauaccucuaaccaggagaaccgccucaagagcgugcuccggaagaucaaggaggaguucgagaagacgaagggguccauggucugugacgugugcaaguacgaaugcgagaccuacaaggagcugaaggcccacggcgugagcugcccccagucgcagugccccuacugcuucacccacugcgagcccaccgaggcggccuuccaggcgcacuaccgcgucugccaagugacgcaccgguuucgcgacgaccugaagaagaccgugaccccgcagaacuucacccccggcugcuaccggacccugaaucuguuccgcuacaagagccggugcuacaucuucacgaugugggucugccugcucgugcuggaguccauccugugggcugccagcgcguccgaagugccccucaacccggucuggaacgacaacgcccacggggucggaagcguacccaugcacaccgaccuggagcuggacuuuucccugaccagcuccaguaaguacacauaccgccggcgccucacgaacccucuggaggaaacccagagcaucaaccugcacaucgagaucgaggagcaaaccaucggggucgacgugcaugcccucggccacugguucgacgggcgccugaaccugaagaccucauuccacugcuacggcgccugcacgaaguacgaguaccccuggcacaccgccaagugccacuacgagcgggacuaccaguacgagaccagcuggggcugcaacccggcggacugccccggggugggcacagggugcaccgcuugcggacucuaccuggaccagcucaagcccgucggcucggccuacaagaucaucaccauccgcuauucacgaaaggugugcguucaguucggggaggagaaccucugcaaggucaucgacaugaacgacugcuucgugacccgccacgugaaggucugcaucaucggcacaguguccaaguucagccagggggacacgcuucuguucuuuggcccccucgaaggcgggggcuugaucuucaagcacuggugcaccuccacgugucaauucggagauccgggggacaucaugagcccccgggacaagggguuucugugcccggaguuucccggcuccuuccgcaagaagugcaauuucgccacaaccccgcucugcgaguacgacgggaacauggugagcggcuacaagaaggucauggccaccaucgacuccuuccagagcuucaacaccuccaccaugcacuucacggacgagcggaucgaauggaaggaccccgacggcaugcugcgcgaccacaucaacauccugguuaccaaagacaucgacuucgacaaccucggcgagaaccccugcaagaucggccugcagaccagcuccaucgagggcgcguggggcucaggggugggcuucacccugacgugccucauaucccugaccgagugcccuaccuuccugacgagcauuaaggccugcgacaaagccaucugcuacggugccgaguccgucacgcucacucgggggcagaacaccgugaagguauccggcaagggcgggcacagcggguccaccuucaagugcugccacggcgagaaaugcagccagaucggcuugcacgcagccgccccgcaccuggacaaagucaacggaaucuccgagaucgagaacaacaagguguacgaugacggcgcgccccaguguggggugaagugcugguucguuaagagcggggaguggaucuccggcaucuucagcggcaacuggaucgugcucaucguccugugcguguuccuccuguucucccugguucugcucagcguccugugccccgugcgcaagcacaaaaaguccuga

SEQ ID NO: 15003 - RNA, 3408 nt, Artificial Sequence
  derived and/or modified CDS sequence (opt11) from HTNV(LongquanMf-09-8)__JQ912875.1__GP
auggaaaucuggaaauggcucguaauggcuucccuuguauggccugcguucacacucagaaacguguacgauaugaaaaucgaaugcccacacaccgucuccuuuggcgaaaacuccgucaucggauacguagaacucccacccaugccacuagccgacacagcccaaauggucccagaaucgagcugcaacauggacaaccaccagucaaugaauacaaucaccaaauacacgcaagucucguggcgcgggaaagccgaccaagcucaagccucacaaaacagcuucgaagcggucagcgcagaagucgaccucaaaggaacauguguccugaaacacaaaaugcucgaagagucauaccgcucacgcaagagcaucacaugcuaugaccucucgugcaacuccacauacugcaagccaacccuauacaugauaguccccauacacgcgugcaacaugaugaaaaguugccucauagcucuaggccccuaccgcguccagguaguauacgaaagaacguacugcaugaccggcguauugauagaaggaaaauguuucguaccagaccaaucagucguuuccaucaucaaacacggcauauucgauaucgcauccguccacaucguaugcuucuucguggcaguaaaaggaaacaccuacaaacucuucgaacaaguuaagaagucauuccaaucaacaugcaacgggaccgaaaacaaaguccaaggcuauuacaucugcaucgucggcggcaacagcgcgcccauuuacguacccacccucgacgauuuccgcuccauggaagcguucuccggcauuuucagaucaccccacggcgaagaccacgaucucgcuggcgaagaaauagccagcuacagcaucguaggacccgccaacgcaaaggucccacacuccgcaagcuccgacacccuaucacucaucgcguauagugggauccccuccuacucaucgcuuucuauacuagccagcagcaccgaggccaagcacguauucagccccggcuucuucccccaacucaaccacaccaaaugcgauaaaacggcaaucccccucacauggaccggaaugauugaccuccccggcuacuacgaagcuauacauccgugcacaguauucugcguccucucaggccccggcgcaucuugcgaggccuucucggagggaggaauauucaacaucacuucccccaugugccucguaucgaaacaaaauagauuccggcuaacggagcaacaaguuaacuucgucugucaacgaguugacauggacauaauaguauacuguaacggucaacgaaaagucauccuuacaaaaacccuuguuauuggccaaugcaucuauaccauaacaucccucuucucccuucuccccggcgucgcccauucgaucgccgucgagcugugcguuccgggcuuccacggcugggcaaccgccgcauuacucgucacauucuguuucggauggguacucaucccagcccuaacccucauaauccugaccauucuuaaguucaucgccaacaucuuccacaccagcaaccaagaaaaccgccucaaaaguguccuccgcaaaaucaaagaagaguucgaaaagacuaagggcucaaugguaugcgaugucugcaaguaugaaugcgaaaccuacaaagaacuuaaggcucacggcgugagcugcccacagagucaaugccccuacugcuucacacacugcgagcccacagaagcggccuuucaagcccacuacagagucugccaaguaacccacagauucagggacgaccugaagaaaacuguaacgccccaaaauuucacucccggaugcuaccgcacucuaaaucucuuccgauauaaguccaggugcuauaucuucacaaugugggucugccuucuagugcuagaaagcauccuaugggccgccuccgccucagaagucccucuaaaccccguauggaaugauaacgcucacgguguaggauccgucccaaugcacaccgaccuugaacuagauuucaguuuaaccuccucuuccaaauacacauaccgccgccggcucaccaacccucucgaagaaacacaauccaucaaccuucacauagagaucgaagaacaaaccaucggcguggacguccacgcacuagggcauugguucgacggccgauuaaaccuaaaaaccagcuuccacugcuacggugccuguaccaaauacgaauacccauggcacaccgcaaaaugccacuaugagagagauuaucaauaugaaacauccuggggaugcaaccccgcagacugcccaggagucgguacggggugcaccgccugcggacuauaccucgaccaacuaaagcccgucggaucagcauacaaaauuauaaccauacguuacucccguaaggucugcgugcaauucggagaagagaaccuuugcaaaguuaucgacaugaaugacugcuuugucacccgccacgugaaagucuguauaaucgggaccguauccaaguuuucacaaggagauaccuugcuauuuuucgguccacucgaaggaggaggcuuaaucuucaaacacuggugcacuuccacaugccaauucggagaccccggcgacauuaugucaccacgcgacaaaggauuccuuugcccagaguuccccggauccuuccggaagaaaugcaacuucgcaaccacaccccuaugugaauacgacggcaacaugguauccgguuacaagaaaguaauggcaaccaucgacuccuuucaauccuucaacacuucgaccaugcacuucaccgacgaacgcauugaauggaaagaccccgacggaaugcuacgggaucacaucaacauccuagucaacaaggacauagacuucgauaaccuaggcgaaaaccccugcaaaaucggacuccaaacaucauccaucgaaggagccuggggcuccggcgugggcuucacacuaaccugccuuaucucacuaaccgaauguccaaccuuccuaacuucaaucaaggccugugacaaagcgaucugcuacggcgcagaauccgucaccuugacacgcggacagaacaccgucaaagucuccggaaaaggcgggcacagcgguucaacauuuaaaugcugccacggagaagaaugcucccaaauaggccuucacgcagcagcaccgcaccucgacaaagucaauggcauaucagaaauagagaacaacaaagucuacgacgacggagccccacagugcggcguaaaguguugguucgugaaaucgggugaauggaucucgggaaucuucuccggcaacuggauaguacugauagugcuaugcguauuccuccucuucucccucguccuacucucgguacuaugcccagugcgaaagcacaagaaaucuuaa

SEQ ID NO: 15004 - RNA, 3408 nt, Artificial Sequence; identical to SEQ ID NO: 11718
  derived and/or modified CDS sequence (opt11) from HTNV(ROKA14-11)__KU207203.1__GP

SEQ ID NO: 15005 - RNA, 3408 nt, Artificial Sequence
  derived and/or modified CDS sequence (opt11) from HTNV(US8A15-1)__KU207205.1__GP
augggcaucuggaaguggcuggugauggccagccucgucuggcccgugcugacccugcgcaacguguacgacaugaagaucgagugcccgcacacugucuccuucggggagaacagcgugaucggcuacguggagcucccgcccaugccccuggccgacacggcgcagcugguccccgaguccagcugcuccauggacaaccaccagagccucaacaccaucaccaaguacacccagguguccuggcgggggaaggccgaccagagccaguccagccagaacuccuucgagacggugagcaccgaggucgaccugaagggcaccugugugcugaaacacaagaugguggaagaguccuaccgcagccggaaguccauuaccugcuacgaccucagcugcaacuccacauacugcaagcccacccuguacaugaucguccccauccacgccugcaacaugaugaaguccugccugaucgcacucgggcccuaccgcguccaggugguguacgagcggaccuacugcaugacuggcgugcugaucgagggcaagugcuucgugccggaccaguccgucgugagcaucaucaagcacggcaucuucgacaucgccagcgugcacaucgucugcuucuuuguggcagugaagggcaacacguacaaaaucuucgagcaggucaagaaguccuucgagucaaccugcaacgacaccgagaacaaggugcagggguacuacaucugcaucgucggcgguaacuccgcccccaucuacgugcccacccuggacgacuuccgcagcauggaagccuucacgggcaucuucaggagcccccacggcgaggaccacgaccucgccggggaggagaccgcgaccuacagcaucgugggcccggccaacgccaaggucccccacuccgccagcuccgacacccugagcuugaucgccuucuccgggauccccagcuacuccagccucuccauccugacgagcuccaccgaggcgaagcacguguucagccccggccuguucccgaagcucaaccacaccaacugcgacaagggcgccaucccccugauguggaccgggaugaucgaccugcccggcuacuacgaggccauccaccccugcacgguguucugcguccucuccgggccgggcgccagcugcgaggccuucagcgaagggggcaucuucaacaucaccucccccaugugccuggugagcaagcagaaccgcuuccggcugaccgagcagcagguuaacuucgucugccagcgcguggacguggacaucgucguguauugcaacggccagcggaagguuauccucaccaagacgcuggucaucgggcagugcaucuacaccaucaccucccuguucagccucuuacccggcguggcgcacuccaucgcaguggagcugugcguccccgguuuccacggcugggccaccgccgcccuccuggugacguucugcuucgggugggugcugauccccgcgaucacuuuuaucauccucaccauccugaaguucaucgccaacaucuuccacaccagcaaccaggagaaccgcuuaaaguccguccuccggaagaucaaggaggaguucgagaagacgaagggcagcauggugugcgacgugugcaaguacgagugcgagaccuacaaggaauuaaaggcccacggcgucuccugcccccagagccagugccccuacugcuucacccacugcgagcccaccgaggccgccuuccaggcgcacuacaaagucugccaggugacccaccgcuuccgggacgaccugaagaagacgguaaccccgcagaacuucacccccgggugcuaccgcacccucaaccuguuccgguacaagucccgcugcuacaucuucacgauguggaucuuccugcucgugcuggagagcauccugugggccgccuccgccagcgaaacgccccucaccccggucuggaacgauaacgcgcacggcgucggguccguacccaugcacaccgaccuggagcuggacuucagccugaccuccagcagcaaguacaccuaccggcgcaagcucacaaaccccuuggaggaggcccagucgaucgaccugcacaucgagaucgaggagcagaccaucggcguggacguccacgcccucgggcacugguucgacggccggcugaaccugaagacgagcuuccacugcuacggcgccugcaccaaguacgaguaccccuggcacaccgccaagugccacuacgagcgcgacuaccaguacgagaccuccugggggugcaacccgagcgacugccccggcguggggacgggcugcaccgcgugcggccucuaccuggaccgccugaagcccgugggguccgccuacaagaucaucaccauccgguacagcagacgggucugcgugcaguucggcgaggagaaccucugcaagaucaucgacaugaacgacuguuucgugucccgccacgucaaggugugcauaauugggaccgugagcaaguucucccagggcgacacgcugcuguucuucgggccccucgagggcggcgggcugaucuucaagcacuggugcaccagcacaugccaguucggcgacccgggggacaucaugagcccccgggacaagggcuuccugugccccgaguuccccggguccuuccgcaagcacugcaacuucgccacuacgccgaucugcgaguacgacggcaacauggucuccggcuacaagaaggugauggccaccaucgacagcuuccaauccuucaacaccagcaccaugcacuucacggacgagcggaucgaguggaaggaccccgacgggaugcuccgcgaccacaucaacauccuggugaccaaggacaucgacuucgacaaccugggcgagaaccccugcaagaucgggcuccagaccuccagcaucgagggcgccuggggguccggcgucggcuucacccugacgugccuggugagccucaccgagugcccaaccuuccugaccucgaucaaggcuugugacaaggccauaugcuacggggccgaguccgugacgcugacccggggccagaacaccgucaaggugagcgggaagggcgggcacuccggcagcaccuucaaaugcugccacggcgaggacugcucccagaucgggcuccacgccgccgcgccgcaccuggacaaggugaacggcaucagcgagauggagaacuccaaggucuaugacgacggggcaccccaguguggcaucaagugcugguucgucaagagcggcgaguggaucuccgggaucuucagcggcaacuggaucgugcugaccgugcucugcguguuccugcuguucucccucguccuguuaagcauccucugccccgugcgcaagcauaagaaguccuga

SEQ ID NO: 15006 - RNA, 3408 nt, Artificial Sequence
  derived and/or modified CDS sequence (opt11) from HTNV(Lee)__D00377.1__GP
augggcaucuggaaguggcuggugauggccagccucgucuggcccgugcugacccugcgcaacguguacgacaugaagauagagugcccgcacaccgucuccuucggggagaacagcgugaucggcuacguggaacucccgcccaugccccuggccgacacggcccagcugguccccgaguccagcugcuccauggacaaccaccagagccucaacacuaucacuaaguacacccaggugucguggcgggggaaggccgaccagagccaguccagccagacguccuucgagaccgugucgaccgaggucgaucugaaggggaccugcgugcuuaagcacaagaugguggaggaguccuaccgcagccggaaguccaucacgugcuacgaucucagcugcaacuccaccuacugcaagcccaccuuguacaugaucguccccauccacgccugcaacaugaugaaguccugccugaucgcccucgggcccuaccgcguccaggugguguacgagcggaccuacugcaugacgggcguucugaucgaggggaagugcuucgugcccgaccaguccgucgugagcaucaucaagcacggcaucuucgacaucgccagcgugcacauugucugcuucuucgucgcggugaagggcaacaccuacaagaucuucgagcaggucaagaaguccuucgaaagcacaugcaacgacaccgagaacaaagugcagggcuacuacaucugcaucgucggcgggaauagcgcccccaucuacgugcccacgcuggacgacuuccgcagcauggaggccuucacaggcaucuuccggucgccccacggcgaggaccacgaccucgccggggaggagaccgcgaccuacagcaucgugggcccggccaacgccaaggucccccacuccgccagcuccgacacacugagcuugaucgccuucuccgggauccccagcgacuccuccuuauccauucugaccaguuccaccgaggcgaagcacguguucagccccggccuguucccgaagcucaaucacaccaacugcgacaagggcgccaucccccugauguggacugggaugaucgaccugccgggcuacuacgaggccauucaccccugcaccguguucuguguccucuccgggccgggcgcgagcugcgaggccuucagcgaaggagguaucuucaacauuaccuaucccaugugccugguguccaagcagaaccgcuuccggcugaccgagcaacaggugaacuucguuugccagcgcguggacguggacaucgucguguacugcaacggccagcggaagguuauccucacaaagacccuggucaucgggcagugcaucuacaccaucaccagccuguucucgcuccugcccggcgucgcgcacagcaucgccguggagcugugcguccccggguuccacggcugggccacggccgcccuccuggugaccuucugcuucggguggguucugaucccggcgaucaccuucaucauccucaccauccugaaguucaucgcgaauaucuuccacacguccaaccaggagaaccggcucaagagcguccugcggaagaucaaggaggaguucgagaagaccaaaggcuccaugguaugcgacgugugcaaguacgagugcgagaccuacaaggagcugaaggcccacggcgucaguugcccccagucccagugccccuacuguuucacccacugcgagcccacagaggccgccuuccaggcgcacuacaagguuugccaggugacacaccgcuuucgggacgaccugaagaaaaccguaaccccgcagaacuucacccccggguguuaccgcacgcugaaccuguuccgguacaagagccgcugcuacaucuucacgauguggauauucuuacucgugcuggagucuauucugugggccgccagcgccuccgagacgccccucaccccgguguggaacgacaacgcgcauggcgucgggucugugcccaugcacaccgaucuggagcuggacuucucccugaccagcuccagcaaguacaccuaccggcgcaagcucacaaacccccuggaagaggcccagagcaucgaccugcacaucgagaucgaggagcagacgaucggcguggacguccacgcacucgggcacugguucgacggcagacugaaccugaagaccuccuuccacugcuacggcgccugcaccaaguacgaguaccccuggcacaccgccaagugccacuacgagcgcgacuaccaguacgagacgagcugggggugcaacccguccgacugccccggagugggcaccggcugcacagcgugcggccuauaccuggaccgccugaagcccguggggucugccuauaagaucaucaccauccgguacucccgccgggucugcgugcaguuuggagaggagaaccucugcaagauaaucgacaugaacgacugcuucgugagccgccacgucaagguguguaucaucgggacgguguccaaguucagccagggcgauacccugcuguucuucgggccccucgagggcggcgggcuuaucuucaagcacuggugcaccuccacuugccaguucggcgacccgggggacauaaugagcccgcgggacaagggcuuccugugccccgaguuccccggguccuuccgcaaaaagugcaacuucgccacaaccccaaucugcgaguacgacggcaacauggugagcggcuacaagaaggugauggccaccaucgacucauuccagagcuucaacaccuccacgaugcacuucaccgacgagcggauugaguggaaggaccccgacgggaugcuccgcgaccacaucaacauacuggucaccaaagacaucgacuucgacaaccugggcgagaaccccugcaagaucggccuccagaccagcuccaucgagggagccugggggucaggcgucggcuuuacgcugaccugccuggugucccucaccgagugucccaccuuccugacgagcaucaaggcgugcgacaaggcgaucugcuacggggccgagagcgugacccugacccggggccagaacaccgucaaggugagugggaagggcggacacagcggcuccaccuucaaaugcugccacggcgaggauugcagccagaucgggcuccacgccgccgcgccgcaccuggacaagguaaacggcaucuccgagauggaaaacagcaaggaguacgacgacggggcgccccagugcggcaucaagugcugguucgucaaguccggcgaguggaucagcgggaucuucuccggcaacuggaucgugcugaucguccucugcguguuccugcuguucucucucgugcuacuguccauccuaugccccgucaggaaacacaaaaagagcuga

SEQ ID NO: 15007 - RNA, 3384 nt, Artificial Sequence
  derived and/or modified CDS sequence (opt11) from HTNV(M)__U38177.1__GP
auggccagccugguguggccgguucucacccugcgcaacguguacgacaugaagaucgagugcccgcacaccguguccuucggcgagaacagcgucaucgguuacguggagcugccgcccgugcccuuggccgacacggcccagaugguccccgaguccagcugcaacauggacaaccaccagucccugaacaccaucaccaaguacacccaggugagcuggcggggcaaggccgaccagucacagagcucccaaaacagcuucgagacuguguccaccgaggucgaccugaaggggaccugcgugcucaagcacaagaugguggaagagagcuaccgcucccgcaagagcgucacauguuacgaccuguccugcaacagcaccuacugcaagcccacccuguacaugaucgugcccauccacgccugcaacaugaugaaguccugccucauagcccugggccccuaccgcgugcaggucguguacgagcggagcuacuguaugaccggggugcugaucgagggcaagugcuucgucccggaccaguccgucgugagcaucauaaagcacggcaucuuugacaucgccagcgugcacaucgugugcuucuuuguggcggucaaggggaacaccuacaaaaucuucgagcaggucaagaaguccuucgagagcacgugcaacgacaccgagaauaagguccagggcuacuacaucugcauugucgggggcaacuccgcccccaucuacgugcccacccucgacgacuuccgcuccauggaggccuucaccgggaucuuccggagcccccacggcgaggaccacgaccuggccggcgaggagaucgcguccuacuccaucgugggggccgccaacgccaaggugccacacagcgccuccagcgacacgcugagacucaucgcguacuccggcauccccagcuacuccagccuguccauccugaccagcuccaccgaggccaagcacguguuuagccccggccucuucccaaagcugaaccacaccaacugcgacaaguccgccaucccguugaucuggacgggaaugaucgaccuccccggguauuacgaggccguccaccccugcaccguguucugcgugcuuagcgggcccggggccagcugcgaggcguucuccgagggcgggauauucaacaucaccagcccgaugugccugguguccaagcagaaccgguuuagacucaccgagcagcaggucaauuucgugugccaacggguggauauggacaucgugguguacugcaacgggcagcgcaaggucauccugaccaagacccuggugaucggccagugcaucuacaccaucaccagccucuucucccugcuucccggcguggcccacagcaucgccgucgagcucugcgugcccggguuccacggcugggccacggccgcgcugcuggugaccuucugcuucggguggguccuuauccccgccaucacguucaucauccugaccguacugaaguucauugccaacaucuuccacacguccaaccaggagaaccggcucaagagcgugcugagaaagaucaaggaggaguucgagaagaccaagggcuccauggucugcgacgugugcaaguacgagugcgagaccuacaaggagcugaaggcccacggggugagcugcccgcagucccagugcccguacugcuucacccacugcgagcccacggaggccgcguuccaggcccacuacaaggucugccaggugacccaccgguuccgagacgaccucaagaagaccgugacgccccagaacuucaccccgggcugcuaccggacccugaaccuguuccgcuacaagagccggugcuacaucuucaccauguggaucuuccuccugguccuggaguccauccucugggccgccagcgccuccgagacgccccugacucccguguggaacgacaacgcccacggcguggggagcgucccgaugcacaccgaccuggagcucgacuucucccugaccucuagcuccaaguacaccuaccgccggaagcugaccaacccccuggaggaggcccagagcaucgaccuccacaucgagaucgaggagcagacgaucggcguggacgugcacgcccuggggcacugguucgacggccgccugaaccucaagacauccuuucacuguuacggggccugcaccaaguacgaguaucccuggcacaccgcgaagugccacuacgagcgcgacuaccaguacgagacgagcuggggcugcaaucccuccgacugcccgggcgucgggaccggcugcaccgccugcgggcuguaccuggaccaguuaaagcccgugggcagcgccuacaagaucaucaccauccgguacucccgccgggugugcguccaguucggcgaggagaaccugugcaagaucaucgacaugaacgacugcuucgugagccgccacguuaaggucugcaucaucgggacgguguccaaguucagccagggcgacacccuccuguucuucgggccccuggagggcgggggccugaucuucaagcacuggugcaccagcacgugccaguucggggaccccggggauauaaugagcccgcgggacaagggcuuccucugccccgaguuccccggguccuuccgcaagaagugcaacuucgccaccacccccaucugcgaguacgacggcaacauggugucuggguacaaaaaggucauggccaccaucgacuccuuccagagcuucaacaccuccacgaugcacuucaccgacgagcggaucgaguggaaggacccggacggcaugcugcgcgaccacaucaacauucugguuaccaaagacaucgacuucgacaaccucggcgagaaccccugcaagaucgggcugcagaccagcuccaucgagggugcaugggggagcggcgugggguucacgcugaccugccucgucagccugaccgagugccccaccuuccugacguccaucaaagccugcgacaaggccaucugcuacggcgccgagagcguuacgcucacccggggccagaacaccgugaaggucuccgggaagggagggcacagcggguccacguucaagugcugccacggggaagacugcagccagaucggccugcacgccgcggcgccccaccuggacaaggugaacggcaucuccgagaucgagaacagcaaggucuacgacgacggggccccgcagugcggcauuaagugcugguucgugaaguccggggaguggaucagcggcaucuucuccggcaacuggaucgugcucauuguccugugcguguuccucuuauucagccugguucuccucuccauccugugccccguccgcaagcacaagaaguccuga

SEQ ID NO: 15008 - RNA, 3408 nt, Artificial Sequence
  derived and/or modified CDS sequence (opt11) from HTNV(N8)__EF077656.1__GP
augggcaucuggaaguggcuggugauggccagccucgucuggcccgccuacacccugcgcaacguguacgacaugaagaucgagugcccccacaccgugagcuucggggagaacucugucaucggcuacguggagcuaccgcccaugccccucgcggacacggcccagauggugcccgaauccagcugcaacauggauaaccaccaguccaugaacaccaucaccaaguacacccaggucagcuggcgggggaaagccgaccaggcucaggccucccagaacagcuucgaggcgguguccgccgagguugaccugaaaggcacgugcguccugaagcacaagaugcucgaggaguccuaccgcucccgcaagagcaucacgugcuacgaccuguccugcaacaacaccuacugcaagccaacccuguacaugaucgugcccauccacgccugcaacaugaugaaguccugucucaucgcccuggggcccuaccgggugcaggucaucuacgagcggaccuacugcaugaccggcgugcugaucgagggcaagugcuucgugccggaccaguccgucgugagcaucaucaagcacgggaucuucgacaucgcauccgugcacaucgucugcuuuuucguggccgugaagggcaacaccuacaaacuguucgagcaggucaagaaguccuuccagagcacgugcaacgauaccgagaacaaggugcagggguacuacaucugcaucgugggcgggaacagcgcccccaucuacguccccacccuggacgacuuccgcagcauggaggccuucuccgggaucuuccggagcccccacggcgaggaccaugaccuagccggggaggagaucgcguccuacagcaucgugggcccggccaacgccaaggucccccacuccgccaguuccgacacccucagccugaucgccuacuccgggauccccucguacuccagccuguccauccucaccggcagcacggaggcgaagcauguguucucccccggcuucuucccgcagcugaaccacaccaagugcgacaagaccgccaucccgcugaccuggacggggaugaucgaccucccaggcuacuacgaggccauccaccccugcaccguguucugcguccugagcgggccgggcgccuccugcgaggccuucagcgagggcgggaucuucaacaucaccucccccaugugcuuaguuagcaagcagaaccgcuuccggcucaccgagcagcaagucaacuucgugugccagcgcguggacauggacaucaucguauauugcaacggccagcggaaggucauuuuaacgaagacccuggugaucgggcagugcaucuacaccaucaccagcuuauucuccuuacugcccggcguggcgcacagcaucgccgucgagcucugcgugcccggguuccacggcugggccacggccgcccugcuggugaccuucugcuucggguggguccucaucccggcaaucaccuucaucauccugaccgugcugaaguucaucgccaauaucuuccacacguccaaccaggagaaccgccuccgggccgugcugcgcaagaucaaggaggaguucgagaagaccaagggcagcauggucugcgacgugugcaaguacgagugcgaaaccuacaaggagcugaaggcccacggcguguccugcccccagagccagugccccuacugcuucacccacugcgagcccacggaggcggccuuccaggcccacuaccgggucugccaggugacccaccgguuccgggacgaccucaagaagaccgugaccccgcagaacuucacccccgggugcuaccgcacgcugaaccuguuccguuacaagucgcgcugcuacaucuucaccaugugggucugccuucugguguuagagagcauccucugggccgccuccgcgagcgaggugccccugaacccggucuggaacgacaacgcccacggcguaggguccgugcccaugcacaccgaccuggagcucgacuucagccugaccucaagcuccaaguacacguaccggcgccgccugacgaacccccuggaggagacccaggccaucaaccuccacaucgagaucgaggagcagaccaucggcgucgacgugcacgcccugggucacugguucgacggccgucugaaccucaagacgagcuuccacugcuacggcgccugcaccaaguacgaguaccccuggcacacagcgaagugccacuacgagcgcgacuaccaguacgagaccuccugggggugcaacccggccgacugccccggcguggggacgggcugcaccgccugcggccuguacauagaccagcugaagcccgucgggagcgccuacaagaucaucaccauccgguacagccgcaaagugugcgugcaguucggcgaggagaaccucugcaaggucaucgauaugaacgacugcuuugugucccggcacgugaaggucugcaucaucgggaccgugagcaaguucucccagggcgacacgcuccuguucuucgggccccucgagggcggcgggcugauauuuaaacacuggugcaccagcacgugccaguucggcgaccccggggacaucaugagcccccgcgacaagggcuuccugugccccgaguuccccgggagcuuccggaagaagugcaacuucgccaccacgccccucugcgaguacgauggcaacaugguguccggcuacaagaaggucauggcgaccaucgacagcuuccaguccuucaacaccagcaccaugcacuucaccgacgagcgcaucgaguggaaggaccccgacgggaugcugcgggaccacaucaacauccuggucaccaaggacaucgacuucgacaaccucggcgagaaccccugcaagaucgggcugcagaccucaagcaucgagggcgccuggggguccggcgugggcuucacccugacgugccucgucagccugaccgagugccccaccuuccugaccuccaucaaggccugcgacaaggccaucugcuacggggcggagaguguggcccucacgcgcggccagaacaccgugaaggucuccgggaagggcgggcacagcggcucgaccuucaagugcugccacggcgaggaguguagccagaucgggcugcacgccgccgccccgcaccuggacaaggugaacggcaucucagagguggagaacaacaaggucuacgacgacggggcuccccagugcggcgugaagugcugguucgucaaguccggcgaguggaucagcgggauuuucuccggcaacuggaucgugcucaucgugcugugcgucuuccuccuuuucagccuggugcugcucuccgugcugugccccguucggaagcacaaaaaguccuga

SEQ ID NO: 15009 - RNA, 3408 nt, Artificial Sequence; identical to SEQ ID NO: 11723
  derived and/or modified CDS sequence (opt11) from HTNV(Q32)__DQ371905.1__GP

SEQ ID NO: 15010 - RNA, 3408 nt, Artificial Sequence
  derived and/or modified CDS sequence (opt11) from HTNV(Bao14)__AB127995.1__GP
auggggauguggaaguggcuggugaucgccagccucgucuggcccgcccuggcccugcgcaacguguacgacaugaagaucgagugcccgcacacuguguccuucggggagaacagcgucaucggcuacguggagcucccgcccaugccccuggccgacaccgcccagaugguacccgaguccagcugcuccauggacaaccaccagagcaucaacacgaucaccaaguacacccaggugaucuggcgggggaaggccgaccccggccaguccagccagaacagcuucgagaccgucagcacggagguggaccugaaggggaccugcguccucaagcacaagaugguggaggaguccuaccgcagccguaaguccauaaccugcuacgaccugagcugcaacuccaccuacugcaagcccacgcuguacaugaucgugcccauccacgccugcaacaugaugaagucuugccucaucgcccucggcccguaccggguacaggugguguacgagcggaccuacugcaugaccggcguacucaucgaggggaagugcuucgugcccgaccaauccguggucagcaucaucaagcacggcaucuucgacaucgccuccgugcacaucguuugcuucuucgucgccgugaaagggaacaccuauaagcuguucgagcaagugaagaaguccuucgagagcacgugcaaugacaccgagaacaaaguccagggauauuacaucugcaucgucgggggcaacuccgcccccaucuacgugcccacccuggacgacuuccgcagcauggaggcguucaccggcaucuucaaguccccgcacggggaagaccacgaccuggccggugaggagaucgccagcuacucgaucguggggcccgccaacgccaaggugccccacagcgcguccagcgacacgcucucccugaucgccuacagcggcauccccuccuacagcucccugagcauccucaccuccagcaccgacgccaagcacguguucuccccgggacuguuccccaagcugaaccacacaaacugcgacaagagcgccaucccccucacguggaccgggaugaucgaccugcccggcuacuacgaggccauccacccgugcaccguguucugcgugcuguccgggcccggcgcgagcugcgaggccuucagcgaagggggcaucuucaacaucaccucccccaugugccucgucagcaaacagaaccgguuccgccugacggagcaacaggugaacuucgugugccagcgggucgacauggacaucgugguguacugcaacggccagcgcaaggucauccugacaaagacgcucgugaucgggcagugcaucuacaccaucacgucccucuuuagccugcuccccggcguggcccacuccaucgccgucgagcugugcgugcccggguuccacggcugggccaccgcggcccugcucgugaccuucugcuucggguggguccugaucccagccgugaccuucaucauccugacggugcucaaguucaucgccaacaucuuccacaccagcaaccaggagaaucggcugaaaucgguccugcgcaagaucaaggaggaguucgagaagaccaagggcagcauggugugcgacgugugcaaguacgagugcgagaccuacaaggagcucaaggcccacgggguguccugcccccagagccagugccccuacugcuucacgcacugcgagccgaccgaggcggccuuccaggcccacuacaaggugugccaggugacccaccgguuccgcgacgaccugaagaagaccgucacgccccagaacuucacccccgggugcuaccggacccugaaccucuuccgcuacaaaucccguugcuacaucuucaccauguggguguuccugcuuaucuuagagagcguccugugggccgcguccgccagcgagaccccgcugacgcccgucuggaacgacaaugcacacggcgugggguccgugcccaugcacaccgaccucgagcuggacuucagccugacgucgagcagcaaguacaccuaccgccggaagcugacgaacccccuggaggaggcccaguccaucgaccugcacaucgagaucgaggagcagaccaucggcgucgaugugcacgcccuggggcacugguucgacggccgccucaaccugaagaccagcuuccacugcuacggcgcguguaccaaguacgaguacccguggcacacggccaagugccacuacgagcgggacuaccaguacgagaccuccugggggugcaaccccagcgacugccccggcguggggaccggcuguaccgccuguggccuguaccucgaccagcugaagcccguaggguccgccuacaagaucaucacgauccgcuauagccgccgggugugcgugcaguucggcgaggagaaccugugcaaaaucaucgacaugaacgacugcuucguaucccgccacguuaaggugugcaucaucgggacugucagcaaguucucccagggcgacacccuccuguucuucgggccgcuggagggcggcgggcucaucuucaagcacuggugcacgagcacgugccaguucggcgaccccggggacaucaugagcccccgggacaagggcuuccugugccccgaguucccgggguccuuccgcaagaagugcaacuucgccaccacccccaucugcgaguacgacggcaacaugguguccgguuacaagaaggugauggcgaccaucgacagcuuccagaguuucaacacgagcaccaugcacuucaccgacgagcggaucgaguggaaggaccccgacggcaugcugcgcgaccacaucaacauccucgucaccaaggacaucgacuucgacaaccugggcgagaaccccugcaagaucgggcugcagacguccagcaucgagggagccuggggguccggcgugggcuucaccuuaaccugccuggugagcuuaaccgagugcccgacguuccucaccagcaucaaggccugcgacaaggccaucugcuacggggccgaguccgucacccugacccggggccagaacacggugcgcgugagcgggaagggcgggcacuccggcagcaccuucaagugcugccacggcgaagacugcuccaagaucgggcugcacgcggccgcgccccaccucgacaagguuaacggcaucagcgagaucgagaacucgaagguguacgacgacggggcaccccagugcggcaucaagugcugguucgucaagagcggcgaguggaucuccgggaucuucucuggcaacuggaucgugcugaucgugcugugcguauuccuccuguucucccugguucuccugagcauccugugccccgugcggaagcacaagaaguccuga

SEQ ID NO: 15011 - RNA, 3408 nt, Artificial Sequence
  derived and/or modified CDS sequence (opt11) from HTNV(HubeiHu02)__JQ665881.1__GP
augggcaucuggaaguggcucgucauggccagccucgucuggcccgccuucgcucugcgcaacguguacgacaugaagaucgagugcccgcacaccguguccuucggggagaacagcgucaucggcuacguugagcugccgcccaugccccuggccgacaccgcccagaugguacccgaguccucgugcuccauggacaaccaccagagccugaacaccaucacaaaauacacgcagaucgucuggcgcgggaaggccgaucagucccagagcucccagaacagcuucgagaccguguccacggaaguggaccugaaggggaccugcguccucaagcacaagaugguggaggagagcuaccgcucccgcaaguccaucacgugcuacgaccuguccugcaacagcaccuacugcaagcccacccuguacaugauagugcccauccacgccugcaacaugaugaaguccugccucaucgcgcuggggcccuaccgcguccaggugguguacgagcggaccuacugcaugaccggcguccugaucgagggcaagugcuucgugccggaccagagcguggucuccaucaucaagcacgggaucuuugacaucgccagcgugcacaucgugugcuuuuucgucgccgugaagggcagcaccuacaagcuguucgagcaggucaagaaauccuucgagaguaacugcaacgacaccgagaacaagguacaggggcacuacaucugcauagugggugggaacucggcccccaucuacguccccacccuggacgacuuccgaagcauggaggccuuuuccggcaucuucaagagcccccacggcgaggaucacgacuuagcgggggaggaaguggccuccuacagcaucgugggcccggcuaacgccaaggucccacacucugcgagcuccgacacccucagccucaucgccuacuccgggauccccagcuauuccagccuguccauccucaccagccugacggaggccaagcacguguucucccccggccuguucccgcagcucaaccacacaaaaugugacaagaccgccaucccgcugaccuggacgggaaugaucgaccugcccggguacuacgaggccgugcaccccugcaccgucuucugcgugcucagcggcccgggggcgagcugcgaggccuucuccgaaggcgggauucugaacaucaccagccccaugugccugguguccaagcagaaccgguuccgucucaccgagcagcagguaaacuucgugugccagaggguggacguggacaucgugguguacuguaacggccagcgcaaggucauccugaccaagacccuggugaucggccagugcaucuacaccaucaccagccucuucucccugcugcccgggguggcccacagcaucgccguggagcucugcgugccaggcuuccacgggugggccacggcagcccugcuggugaccuucugcuuuggcugggucuugaucccggccaucaccuucaucauccugaccauccugaaguucaucgcgaacaucuuccacaccaguaaccaggagaaccggcucaagagcgugcugcgcaagaucaaagaggaguucgagcggacaaagggguccauggugugcgacguuugcaaguacgagugcgagaccuacaaggagcugaaagcccacggcgugucgugcccccagucccagugccccuacugcuucacccacugcgagccaacggaggcggccuuucaggcccacuacaaggugugccaggucacccaccgcuuccgggacgaccucaagaagaccgugaccccgcagaacuucacccccggcugcuaccgcacguuaaaccuguuccgguacaagagccgcugcuacaucuucaccauguggguauuccuccugguccuggaguccauccucugggccgcgagcgccucggaaacgccccugaacccgguguggaacgacaacgcccacggagugggcagcgucccaaugcacacggaccuggagcuggacuucucccucaccagcagcuccaaguacaccuaccggaggaagcugaccaauccccuggaagagagccaggccaucaaccuccacaucgagaucgaggagcagaccaucgggguggacgugcacgcccugggccacugguucgacgggcggcugaaccucaaaacguccuuccacugcuacggcgcgugcaccaaguacgaguaccccuggcacaccgccaagugccauuacgagcgcgacuaccaguacgagaccagcuggggcugcaacccgagugacugccccggggucggcacggggugcaccgccugcggccuguaccuggaccagcucaagccagugggcagcgccuacaagauuaucaccauccgcuacagucggcgcgugugcguccaguuuggggaggagaaccugugcaagaucauugacaugaacgacugcuucgugucacggcacgugaaggucugcaucauuggcaccguguccaaguucagccagggggacacgcuccucuuuuucggcccccuggagggcggcgggcuuaucuucaagcacuggugcacaucuacgugccaguucggggacccgggggacaucaugagcccgcgcgauaagggguucuugugccccgaguuucccggcuccuuccggaagaagugcaacuucgccaccaccccgaucugcgaguacgacgggaacauggugagcggcuacaagaaggucauggcgaccaucgauuccuuccagagcuucaacaccuccaccaugcacuucacugacgagcgcaucgaguggaaggaccccgacggcaugcugcgggaccacaucagcauccuugugaccaaagacaucgacuucgacaaccucggcgagaaccccugcaagauaggccugcagaccuccagcaucgagggggccuggggcagcggggugggcuacacccugacgugccuuaucucccuaaccgagugccccaccuuccugaccagcaucaaagccugcgauaaggccaucugcuacggcgccgaguccgucacgcucaccagagggcagaacaccgugaaggugagcggcaagggcgggcacuccggcagcuccuucaagugcugccacggcgaggacugcagccagaucggcuugcacgcggccgccccgcaccuugacaaagucaacgggaucuccgagaucgagaacagcaagguguucgacgacggcgcgccccagugcgggauaaagugcugguucguuaaauccggcgaguggauuagcggcaucuucaacgggaacuggaucgugcucaucgugcuaugcgucuucuuacuguucucccugguguugcuaaguaucuugugcccggugcggaagcacaagaaguccuaa

SEQ ID NO: 15012 - RNA, 3408 nt, Artificial Sequence
  derived and/or modified CDS sequence (opt11) from HTNV(HV004)__JQ083394.1__GP
auggguaucuggaaguggcuggugauggccagccucgucuggcccgccuucgcccugcgcaacguguacgacaugaagaucgaguguccgcacaccguguccuucggggagaacucgguaaucggauacguggaguugccgcccaugccccucgccgacaccgcccagauggugcccgaauccagcugcuccauggacaaccaccagagccucaauacgaucaccaaguacacgcagaucaucuggcgggggaaggccgaccagucccagagcucccagaacaguuucgagaccgucuccaccgagguggaucugaaggggaccugcgugcucaagcauaagauggucgaggagagcuaucgcucccgaaagaguaucacgugcuaugaccuguccugcaacagcacuuacugcaagcccacccuguauaugaucguucccauccacgccugcaacaugaugaaguccugccucaucgcgcuggggcccuaccgcgugcaggucguguacgaacguaccuacugcaugaccggcgugcugaucgagggcaagugcuucgucccugaccagagcguaguguccaucaucaagcaugggaucuucgacaucgccuccguccacaucguuugcuuuuucguggccgucaagggcagcacauacaagcuguuugagcaggucaagaaguccuuugagucaaacugcaacgacacggagaacaagguccagggguacuacaucugcaucgugggcgggaacuccgcccccaucuacgugcccacccucgacgacuuccgcagcauggaggcguucuccggcaucuucaagagcccccacggcgaagaccacgaccuggccggugaggaggucgccuccuauagcaucgugggcccggccaacgccaaggucccucacuccgcgucuuccgacacucucagccugaucgcauauuccgggauccccagcuacaguagccuuuccauccucaccagcuccacggaggccaagcacgucuucucgcccggccuguucccgcaacugaaccacaccaagugcgacaaaaccgccaucccccuaaccuggacgggcaugaucgacuuacccggauacuacgaggcgauccacccuugcaccguguucugcgugcugagcggaccgggggcguccugcgaggccuucagcgagggcgggaucuucaacauaaccucccccaugugccucgucagcaagcagaaccgguuccgccugaccgagcagcaggucaacuucgugugccagcgaguggacguggacaucguggucuacugcaauggccagcgcaaggugauacugacuaagacccuuguuaucggccagugcauauacacaaucacuucccuguucagccugcuccccggggucgcgcacuccaucgccguggaguugugcgugcccggcuuucauggaugggccacugcggcccuucucgucacuuucugcuucggcugggugcugaucccggcgauaaccuuuaucauccugacuauccucaaguucaucgcaaacaucuuccauacgagcaaucaggagaacaagcugaaguccguguugcggaagaucaaggaggaguucgagcgcaccaaaggaagcaugguuugcgaugugugcaaguacgagugugaaaccuacaaagagcucaaggcccauggcguguccugcccacagagccagugccccuacuguuucacccacugugagccgacggaggcggcauuccaggcccacuacaaggucugccaggucacccaccgcuuccgcgacgaccugaagaagaccgugaccccgcagaacuucaccccuggaugcuaccgaacacugaaccuauuccgguacaagucccggugcuacaucuucaccaugugggucuuccugcugguacucgaaucuauucugugggcugccuccgccagcgagacgccucugaacccgguguggaaugacaacgcccacggggucggcuccgugcccaugcauaccgaccucgaacuggacuucagccugaccagcuccagcaaguacaccuaccgccgcaagcucaccaauccucucgaggagucccaggccauaaaccugcacaucgagaucgaggaacaaaccaucgggguggacguccacgcacugggacacugguucgacgggcgccucaaccugaagacgagcuuccacugcuacggcgcgugcacuaaguacgaauacccauggcauaccgcuaagugccacuacgagcgggacuaccaguacgaaaccuccuggggguguaaccccagcgacugccccggggugggcacgggaugcaccgccuguggccuguacuuagaccaacugaagcccguaggguccgccuacaaaauuaucaccauccgcuacagcagacgcgugugugugcaguucggagaggaaaaccugugcaagaucaucgacaugaacgacugcuucguguccagacaugucaaggugugcaucaucggcaccgugagcaaguucucccagggggacacgcucuuguucuucggcccccuggagggcgggggccucaucuucaagcauuggugcaccagcacaugccaguucggggacccgggcgacaucaugagcccccgggacaagggguuccugugcccagaguuccccgguagcuuccgcaaaaagugcaacuucgccacuaccccgaucugcgaguacgacggaaacauggucuccgguuauaagaaggugauggcgaccaucgacagcuuccaguccuucaacacgagcaccaugcauuucacggacgaacgaaucgaguggaaggaccccgauggcaugcugcgcgaccacauaaacauccucgugacaaaggauaucgauuucgacaaccuuggggagaaucccugcaagaucggccugcagaccuccagcaucgagggggccuggggcucaggggucggcuucacccucacgugccugauaagccugaccgagugccccacguuccucaccucaaucaaagccugcgacaaggccaucugcuacggcgccgaguccgugacgcuuacccgugggcagaacaccgugaaagucagcggcaagggcgggcacagugggagcuccuucaagugcugccacggcgaagacuguagccagaucggccugcacgcggccgcaccgcaccucgacaaggugaacgggaucagcgagauagagaacucuaagguguucgacgacggggcuccccagugugggaucaagugcugguucgucaaguccggagaguggaucagcggcaucuucaacgggaacuggaucguccugaucguccugugcguauuccuccuguucucccugguucuccugucuauccugugccccguccgcaagcacaagaaguccuaa

SEQ ID NO: 15013 - RNA, 3405 nt, Artificial Sequence; identical to SEQ ID NO: 11727
  derived and/or modified CDS sequence (opt11) from HTNV(NC167)__AB027115.2__GP

SEQ ID NO: 15014 - RNA, 3408 nt, Artificial Sequence
  derived and/or modified CDS sequence (opt11) from HTNV(WuhanAaJ10)__JQ665882.1__GP
augggcaucuggaaguggcuggugauggccagccucgucuggccugccuucgcccugcgcaacguguaugacaugaagauagagugcccgcauaccguguccuucggugagaacagcgucaucggcuacguggaacugccgcccaugccccucgccgacaccgcccagauggugcccgaguccagcugcuccauggacaaccaccagagccugaacacgaucaccaaguacacgcagaucaucuggcgggggaaggcugaccaaucucagagcucccagaacagcuucgagaccgucuccacggagguggaccugaaagggaccugcgugcucaaacacaagaugguagaggagagcuaccgcucccgcaagagcaucacgugcuacgaccuguccugcaacagcacuuacugcaagcccgccuuauacaugaucgugcccauccacgcgugcaacaugaugaaguccugucucaucgcccuggggcccuaccgcgugcaagucguguacgagcggacguacugcaugaccggcgugcugaucgagggcaagugcuucgucccggaucagagcgugguguccaucauaaagcacgggaucuucgacaucgccagcguacacacugugugcuucuucguugccgucaagggcagcaccuacaagcuguucgagcaggcgaaaaaguccuuccagaguaacugcaacgacacagagaacaaggugcagggguacuacaucugcauagugggcggguccucagcgcccaucuacguccccacccuggacgacuuccguuccauggaggccuucagcgggcuguucaagagcccucacggcgaggaccacgacuuagcgggggaggagguggccuccuacuccaucgucggcccggcgaaugccaaggugccccacagcgccuccagcgacacacugucccugaucgccuacagcgggaucccauccuauagcucccucagcauccugacgucgucaacggaagccaagcacgucuucagccccggccuguucccgcagcucaaccacaccaagugcgacaagaccgcgaucccccugaccuggacgggcaugaucgaucugcccggguauuacgaggccguccaccccugcacgguauucugcguucucagcggcccaggcgccagcugcgaggccuucuccgagggcgggaucuucaacaucaccagccccaugugucucgucuccaagcagaaucgguuccggcugaccgagcagcaagucaacuucgugugccagcgaguggacguggacaucaucguguacugcaacggccagcgcaaggucauccucaccaagacccuggugauuggccaaugcaucuacaccaucaccagcuugaucucacuccugccggggguggcgcacagcaucgcggucgagcugugcgugcccggcucccacgggugggcuacggccgcgcuccuggugaccuucugcuucggcuggguucugaucccugccaucaccuucaucauccucaccauccugaaguucaucgcuaauaucuuccacacgagcaaccaagagaaccggcugaaguccgugcuccgcaagaucaaggaagaguucgagcggaccaaggggagcauggugugcgacgucuguaaauacgagugcgagacauacaaggagcugaaggcacacgguguguccugcccccagagccagugccccuauugcuucacccacugcgagcccacggaggccgccuuccaggcgcacuacaaagugugccaggucacccaccgcuuccgggacgaucugaagaagacagugaccccgcagaacuucaccccgggcugcuaccgcacgcucaacuuauuccgguacaagucccgcugcuacaucuucacaauguggguguuccuccucguccuggagagcauccugugggccgccuccgccagcgagacgccccucaacccgguauggaacgacaacgcccacggggugggcagcgucccuaugcacaccgaccuggagcuggacuucucccugaccaguuccucaaaguauacuuaccggcgcaagcucacuaacccccuggaggagucccaggcgaucgaucugcacaucgagaucgaagaccagaccaucgggguggaugugcacgcccucggacauugguucgacgggcggcugaaccuggagacgagcuuccacugcuacggcgccugcaccaaguacgaguaccccuggcacaccgccaaaugccacuacgagcgcgacuaccaguacgagaccuccuggggcugcagcccguccgacugccccggggucggcacggggugcaccgccugcggccucuacuuagaccagcugaaacccguggguucagcguacaagaucaucaccauccgcuacucccgacgcgugugcguucagagcggggaggaaaacuugugcaagaucaucgacaugaaugacugcuucgugucccggcacgugaaggucugcaucaucggcaccgugagcaaguucucccaaggggacacucugcuguucuucggcccccucgagggcgggggccugaucuucaagcacuggugcaccuccacgugccaguucggggacccgggcgauaucaugagcccccgcgacaagggguuccugugccccgaguuccccggcagcuucaggaagaagugcaauuucgccaccacuccgaucugcgaguacgacgggaacaugguguccggcuacaagaagguuauggccaccaucgacucguuccagagcuucaacaccucgaccaugcacuucacggacgagcgcaucgaguggaaggaccgggacggcaugcuccgcgaccacaucaacauccuggugaccaaagacaucgacuucgacaaccugggggagaacccaugcaagaucggccuccaaacgagcuccauugagggggccuggggcagcggugugggcuucacacugacgugccugaucucccucacagagugccccaccuuccugaccagcaucaaggccugcgacaaggccaucugcuacggcgccgaguccgucacgcugacccgggggcagaauacagugaaagugagcggcaagggcgggcacuccgggagcuccuucaagugcugccacggcgaggauugcagccagaucggccuccacgccgccgcgccccaccuggacaaggucaacgggaucuccgagaucgagaacagcaagguguucgacgacggugcuccgcagugcgggaucaagugcuggucugucaagagcggcgaguggaucuccgguauuuucuccgggaacuggaucgugcugaucgugcucugcguauuccuccuguucucccucgugcugcugaguauccucugccccgugcgcaagcacaagaagucuuag

SEQ ID NO: 15015 - RNA, 3408 nt, Artificial Sequence
  derived and/or modified CDS sequence (opt11) from HTNV(Z5)__EU074224.1__GP
augggcaucuggaaguggcuggugauggccagccucgucuggcccgccugcacccugagaaacguguacgacaugaagaucgagugcccccacaccguguccuucggugagaacagcgucaucggcuacguggagcugccucccaugccccucgccgauaccgcccagcugguacccgaguccagcugcaacauggacaaccaucaguccaugaacaccaucacaaaguacacccaggucagcuggcgcuccaagguggaccaggcccaggccucgcagaacaguuucgaggccgugagcgcggaggucgaccugaaggggacgugcgugcucaagcacaagaugcuggaggagaguuaccgcagccggaaguccaucacaugcuacgacuuaagcugcaacuccacuuacugcaagcccacccucuacaugaucgugcccauacacgccugcaacaugaugaagggcugccugaucgcccuggggcccuaccgcguccaggugguguacgagcggaccuacugcaugacgggcgugcucaucgaggggaagugcuucgugccggaccagagcguggucuccaucaucaagcacgggaucuucgauaucgccucugugcacaucgugugcuucuucgucgcggucaagggcaacaccuacaagcuguucgagcaggucaagaagucauuccagagcacguguaacgacaccgagaacaaggugcagggguacuacaucugcaucguuggcgguaacucagcccccaucugcguccccacccuggaugacuuccgcuccauggaagcauucagcggcaucuuccggagcccgcacggcgaggaccacgaccuugccggggaggagaucgccagcuacuccauagugggcccggcgaacgccaaggugccccacagcgccuccagcgacacccuuucgcugaucgccuacagcgggauccccuccuacagcucccucagcauccuggccggcuccacagaggcgaagcacgucuucagccccggcuucuucccgcaacugaaccacacuaagugcgacaagaccgccaucccccucaccuggaccgggaugaucgaccugccuggcuacuacgaggccauccaccccugcacgguguucugcgugcuguccgggccgggcgccagcugcgaggccuucuccgagggcgggaucuucaacaucaccagccccaugugucucgucagcaagcagaaccgcuuccggcugaccgagcagcaaguaaacuucgugugccagcgcgucgacauggacauaaucguguacugcaauggccagcggaaggugauccugaccaagacgcucgucaucgggcagugcauuuauaccaucaccucccuguucucccuucuccccggcguagcacacuccauagccguggagcugugcguccccggguuccacggcugggccaccgccgcccugcucgugacguucugcuucgggugggugcuuaucccagcgaucaccuuugucauccugaccauccucaaguuuaucgccaacaucuuucacacaagcaaccagggcaaccgacugaaguccgugcugaagaaaaucaaggaggaguucgagaagacgaagggcagcauggugugcgacgucugcaaguacgagugcgagaccuacaaggagcucaaggcccacggcguguccugcccccagagucagugcccguauugcuucacccacugugagcccaccgaggccgcguuccaggcccacuaccgcgugugccagguuacgcacagauuccgggacgaccugaagaaaaccgugaccccgcagaacuucacccccggcugcuaccgcacccucaaccucuuccgguacaaaucccguugcuacaucuucacgaugugggucugccugcugguccucgagucuauccugugggccgccuccgccagcgaggugcccuugaacccgaucuggaacgacaacgcgcacggggugggcuccguccccaugcacaccgaccucgagcuggacuucagccugaccuccagcuccaaguacaccuaccggcgccggcugacgaacccccucgaggaaacccaggcgaucaaccugcacaucgagaucgaggagcagaccaucgggguggacgugcacgcccugggccacugguucgacggccgccucaaccugaagaccagcuuccacugcuacggggccugcacgaaguacgaguaccccuggcacaccgccaaaugccacuaugagcgcgacuaccaguacgagaccagcuggggcugcaacccggcggauugucccggggucggaaccggcugcacggccugugggcuguaccucgaccagcugaagccagugggcuccgccuacaagaucaucaccauccgguauagccgcaaggugugcguccaguucggggaggaaaaccuguguaaggugaucgacaugaacgacuguuucgugucccggcacgucaaggucugcaucaucggcaccgugagcaaauucucccagggggacacacuccuguucuucggcccccuggagggcgggggccucaucuucaagcacuggugcacgagcacgugucaguucggggacccgggcgacauuaugagcccccgcgacaagggguuccugugccccgaguuccccggcuccuuccggaagaagugcaacuuugccaccaccccgcugugcgaguacgacggcaacauggucuccggauacaaaaaggugauggccaccaucgauagcuuccaguccuucaacaccagcaccaugcacuucaccgacgagcgcaucgaguggaaggaccccgacggcaugcuccgggaccacaucaauauccugguuacgaaggacaucgacuucgauaaucugggggagaaccccugcaaagucggccuccagaccuccagcaucgagggagcguggggcuccggcgugggauucacccugaccugccuggugagccucacggagugccccaccuucuuaaccuccaucaaggccugcgacaaggccaucugcuacggcgcggagagcgucacccugacgcgcgggcagaacaccgugaagguguccggcaagggcgggcacagcggaagcaccuucaagugcugccacggggaggaguguucccagaucggccuccacgcggccgccccgcaccuggacaaggucaacgggaucagcgagauagaaaacaacaagguguaugacgacggcgcgccccagugcggcgucaagugcugguucgugaaguccggggaguggaucagcggcauauucuccgggaacuggaucguucugaucguccucuguguguuccugcuguucagccucgcacugcuguccgugcucugccccguccggcgccauaagaaguccuga

SEQ ID NO: 15016 - RNA, 3408 nt, Artificial Sequence
  derived and/or modified CDS sequence (opt11) from HTNV(ZLS-12)__FJ753399.1__GP
augggcaucuggaaguggcugaucauggccagccucguuuggcccgccuacacccugcgcaacgucuacgacaugcggaucgaguguccgcacaccgugagcuucggggagaacagcgugaucggcuacgucgagcugccgcccaugccgcucgccgacacgucccagauggugcccgagagcuccugcagcauggacaaccaccagucccugaacaccaucaccaaguacacccaggugagcuggcgcgggaaggccgaccagucccaggccagccagaacuccuucgaggccgucagcgccgagguggaccugaagggcacgugcgugcucaagcacaagaugcuggaggaguccuaccggagccgcaaguccaucacgugcuacgaccuaagcugcaacuccaccuacugcaagcccacccucuauaugauuguccccauccacgcgugcaacaugaugaaguccugccugaucgcccuggggccauaccgggugcaagugguguacgagcgcaccuacugcaugaccggcauccucaucgagggcaagugcuucguaccggaccagagcguggucagcaucaucaagcacgguaucuucgacaucgccagcguacacaucgugugcuucuucgucgccgugaagggcaacaccuacaagcuguucgaacaggucaagaaguccuuccagagcacgugcaacgacaccgaggacaaggugcagggguacuauaucugcaucgcgggcgggaacuccgccccaaucuacgugcccacucuggacgauuuccggagcauggaggccuucuccggcaucuucaagagcccccacggcgaggaccacgaccucgccggagaggagaucgccuccuacagcaucgugggcccggcgaacgccaaggucccgcacuccgccagcuccgacacccugagccugacagccuacuccgggauccccagcuacuccagccucuccauccugacgagcuccaccgaggccaagcacguguucagccccggcuucuucccucagcugaaucacaccaagugcgacaagaccgcgaucccccucauguggacgggcaugaucgaccugcccggguacuacgaggccauccaccccugcaccgucuucugcgugcugagcggcccgggggcguccugcgaggccuucagcgaaggcgggaucuucaacauaaccucccccaugugccucgugagcaagcagaaccgcuuccggcugaccgagcagcaggucaacuucgugugccagcgcguggacauggacaucgucguguacugcaacggccagcggaagguuauccugacgaagacccucgucauuggccagugcaucuacaccaucaccucccuguucagccugcuccccgggguggcccacuccaucgccguggagcucugcguccccggcuuucacggaugggccacggccgcccugcucgugaccuucugcuucggaugggugcugaucccggcgaucaccuucaucauccugacaauccucaaauucaucgcgaacaucuuccacacgucuaaccaggagaaucgccugaaauccguacugcggaagaucaaggaggaguucgagaagaccaaggggagcauggugugcgacgugugcaaguacgagugcgagaccuacaaggagcucaaggcccacggcgucuccuguccccagagccagugccccuacugcuucacccacugcgagcccacggaggccgccuuccaggcgcacuaccgcgugugccaggugacccaccgguuccgcgacgaccugaagaagaccgucaccccgcagaacuucacccccggcugcuaccggacgcugaaccucuuccgcuacaagucacggugcuacaucuucaccauguggguguuccuguuagugcucgagagcauccugugggcugccuccgccagcgaggucccccuguccccgguguggaacgacaacgcccacggggucggcagcauccccaugcacaccgaccucgagcuggacuucagccugaccuccaguuccaaguacacguaccgacggaagcugaccaacccccucgaggagacccaggcgaucaaccugcacaucgagaucgaggagcagaccaucggggucgacgugcacgcccugggccacugguucgaugggcgccucaaccugaagaccagcuuccacugcuacggcgccugcacaaaguacgaauaccccuggcacaccgccaagugccauuacgagcgcgacuaccaguacgagaccuccuggggcugcaaccccgccgacugccccggggugggcacggggugcaccgcgugcggccuguaccucgaccagcugaagccugucggcucagccuacaagaucaucaccauccgguacucccgccgggugugcgugcagcugggggaggagaaccucugcaaaaucaucgacaugaacgacugcuucgucagccgccacgugaagguuuguaucaucggcaccgucuccaaguucagccagggggacacgcugcuguucuucggcccccucgagggcgggggccugaucuuuaagcacuggugcaccuccacgugccaguucggggauccgggcgacauuaugagcccccgggacaagggguuccugugccccgaguuccccggcuccuuccgcaagaagugcaacuucgccaccaccccgcuuugcgaguacgacgggaacaugguguccggcuacaagaaggugauggcuaccaucgacuccuuucagagcuucaacaccuccacgaugcacuucacggacgagaggaucaaguggaaggaccccgacggcaugcugcgcgaccacaucaacauccuggucaccaaggacaucgacuucgacaaccucggggagaaccccugcaagaucggccugcagaccagcgccaucgagggggcguggggcuccggggugggcuucaccuugacgugccucgugagccugaccgagugccccaccuuccugacgagcaucaaggcgugcgacaaggccaucugcuacggcgccgaguccgucacgcucacccgggggcagaacaccgucaaggugagcggcaagggcgggcacuccgggagccuguucaagugcugccacggggaggagugcucccagaucggccugcacgcggccgccccgcaccucgacaaggucaaugggaucagcgaaaucgagaacaacaagguguacgacgacggcgcgccccagugcggggugaagugcugguucgucaaguccggcgaguggaucagcggcaucuucuccgggaacuggauagugcugaucgugcuuugcgucuuccuccuguucucucuggugcuccuguccguccugugccccgugcgcaagcauaagaaguccuga

SEQ ID NO: 15017 - RNA, 3408 nt, Artificial Sequence; identical to SEQ ID NO: 11731
  derived and/or modified CDS sequence (opt11) from HTNV(ZLS6-11)__FJ753397.1__GP

SEQ ID NO: 15018 - RNA, 3408 nt, Artificial Sequence
  derived and/or modified CDS sequence (opt11) from HTNV__AB030232.1__GP
augggccuguggaaguggcucaucauggccgugcuggucuggcccugcuucgcccugcgcaacguguacgacaugaagaucgagugcccgcacaccgugaacuucggggagaacagcgucgucggcuacguggagcucccgcccaugcccaucgcggacaucacccaaaugaugcccgaguccagcugcuccauggacaaccaccagucgcugaacacgaucaccaaguacacccaggucuccuggcggaagaaggccgacagggcccagagcucccagaccagcuucgaaacgguguccagcgagguggacuuuaaggggaccugcguccugaagcauaaaaugguggaggacuccuaccggagccgcaaguccaucaucugcuacgaccucagcuguaacuccaccuucugcaagcccacccuguaccugaucgugcccguccacgccugcaacaugaugaaguccugccucaucgcucugggccccuaccgggugcaggacguguacgagcgcacguacugcaugagcgggguccugcucgagggcaagugcuucgugccggaccggagcguggucuccaucaucaagcacggcaucuucgacaucgcgagcgugcacaucgugugcuucuucgucgccaucaaggggagcaccuacaagauccuggagcaggucaagaaguccuucgagcugaccugcaacgacaccgacaacaagauccagggcuauuacaucugccucgucgggggcaacagcgcccccaucuacgugcccacgcuggacgacuuccguucaauggaggcguucgcggggaucuucaagagcccccacggugaggaccacgaccuggccggcgaggagguggccuccuacagcaucguggggccggccaacgccaaggugccccacuccgcgagcgccgacacccucucccugguggccuucagcggcauccccuccuacagcuccuucagcguccugaccggauccacagacgcccggcacguguucagucccggcuuuuucccgcagcucaaccagacgcgcugcgacaagaccgccaucccccugaccuggaccggcaugaucgaccugcccggcuacuacgaggcggugcaucccugcacggucuucugcgugcucuccggcccgggggccagcugcgaggccuucuccgagggcgggaucuucaacaucaccagccccaugugccuggugagcgagcagaaccgguuccgcuccagcgagcagcagguuaacuucgugugccagcggguggacauggacaucgucguauacugcaauggccagaagaaggugauccugaccaagacccucgugaucggccagugcaucuacacgaucaccucccuguucagccugcuucccgggguggcgcacuccaucgccguggagcugugcguccccggcuuccacgggugggcgaccgccgcccugcucguaaccuucugcuucggcugggugcugaucccggccgucacgcuggugauccucaccauccuuaaguucaucgccaacauuuuccacaccagcaaccaggagaaccgccugaaguccgugcucaagaagaucaaagaggaguucgagaagaccaaagggagcauggucugcgacguaugcaaauacgagugcgagacguauaaggagcugaaggcgcacggcguguccugcccccagagccagugccccuacugcuucacccacugcgagcccaccgaggccgccuuccaggcgcauuacaaagucugccaggugacccaccgguuccgcgacgaccugaagaagacggugaccccgcagaacuucacucccggcugcuaccggacccucaaccuguuccgcuacaagucccggugcuacaucuucaccaugugggucuuccugcugauccuggagagcauccugugggcggccuccgccagcgagacgcccuccacgccgaucuggaacgacaacgcccacggggugggcagcauccccaugcauaccgaccucgagcucgacuucucccugaccagcagcuccaaguacacguaccgccggaagcugaccaacccccucgagaagacccaggccguggaccugcacaucgaguuagcgguccagacuaucgggguggacgugcacgcucucggccacugguuugacgggcgccugaaccugaagacgagcuuucacugcuacggcgccugcaccaaguacgaguaucccuggcacaccgccaagugccacuacgagcgcgauuaccaguacgagaccuccuggggcugcaacccggccgauugcccgggcgucggcacggggugcaccgcgugcggccucuaccuggaccaguuaaagcccgugggcagcgccuacaagaucaucaccaucaaguacucccggcgcgucugcguccaguucggggaggaaaaccuaugcaaggugaucgauaugaacgacugcuucgugagccggcacgucaagaucugcaucaucggcaccguguccaaguucagccagggggacacgcugcuguucuucggcccccucgagggcgggggccugauauucaagcacuggugcaccuccacgugccaguucggggacccgggcgacaucaugagcccccgcgacaaaggguuccugugccccgaguuccccggcagcuuccggaagaagugcaacuucgccaccaccccggugugcgaguacgacgggaacauggucagcggcuacaagaaggugauggccaccauagacuccuuccagagcuucaacaccuccaugaugcacuucaccgacgagcgcaucgaguggaaggacccggacggcaugcuccgggaccacaucaacauccuggugacgaaggacaucgacuucgacaacuuaggggacaaccccugcaaggucggccuccagaccagcgccaucgagggggcguggggcuccggagugggcuucacccugaccugccaggugagccugacggagugccccaccuuccucaccuccaucaaggccugcgacaaggccaucugcuacggcgccgagagcaucacccugacgcgcgggcagaacacagucaaggugagcggcaagggcggacacuccggaagcaccuucaagugcugccacggcgaggagugcucccagaucggccugcacgcggccgccccgcaccucgacaaggucaacgggaucagcgagauggaaaacuccaagguguacgacgacggcgcccccgagugcgggaucaagugcugguucgucaagagcggcgaauggaucuccggcaucuucaacgggaacuggaucguguuaaucgugcugugcgccuuccucaucuucagccuggugcugcucucccugcugugccccguccggaagcacaagaaagccuga

SEQ ID NO: 15019 - RNA, 3408 nt, Artificial Sequence; identical to SEQ ID NO: 11733
  derived and/or modified CDS sequence (opt11) from HTNV__AB620032.1__GP

SEQ ID NO: 15020 - RNA, 3408 nt, Artificial Sequence; identical to SEQ ID NO: 11734
  derived and/or modified CDS sequence (opt11) from HTNV__D25532.1__GP

SEQ ID NO: 15021 - RNA, 3408 nt, Artificial Sequence; identical to SEQ ID NO: 11735
  derived and/or modified CDS sequence (opt11) from HTNV__L08753.1__GP

SEQ ID NO: 15022 - RNA, 3408 nt, Artificial Sequence
  derived and/or modified CDS sequence (opt11) from HTNV__M14627.1__GP
auggggaucuggaaauggcuggugauggccagccucgucuggcccgugcuaacccugcgcaacguguacgacaugaagaucgaaugcccgcacacggucuccuucggggagaauagcgugaucggcuacguggagcucccgcccguaccccuggccgacacggcccagauggugcccgaguccagcugcaacauggacaaccaccagucccugaacacgaucacgaaguauacccagguaagcuggcgggggaaggcggaccagucucagagcucccagaacagcuucgagacggucuccaccgagguggaccucaaggguaccugcgugcugaagcacaagauggucgaggagagcuaccgcucccguaagagcguaaccugcuacgacuuguccugcaacagcacuuauugcaagcccacccuuuacaugaucgugcccauacacgccugcaacaugaugaaaagcugucugaucgcccuggggccguaucgcguccaggugguguacgagagguccuacuguaugaccggcguccucaucgagggcaaguguuucgugccggaccaguccguggucagcaucaucaagcacgggaucuucgacaucgccagcgugcauaucgugugcuucuucgucgcugugaagggcaacaccuacaagaucuucgagcaagucaaaaaguccuucgagagcacuugcaacgacacggagaacaaaguccagggguacuacauaugcaucgugggcggaaauuccgcacccaucuacguccccaccuuagacgacuuccgcagcauggaggccuucaccgggaucuuccggagcccccacggcgaggaccacgaccuggcaggggaggaaaucgcauccuacuccaucguggguccggccaaugccaaggugccccacagcgccaguagcgacacccucuccuuaaucgccuacucagggauccccuccuacaguucccugagcauccucaccucaucuaccgaggcgaagcacguguucucccccggccuguuuccgaagcugaaccacaccaacugcgacaagagcgccaucccccucaucuggacgggcaugauugaccugcccggguacuacgaggccgugcaccccugcaccguguucugcguccuuagcggcccgggcgcuaguugcgaggccuucagcgaaggcgggaucuucaauaucacaucacccaugugccucgugagcaagcagaaccgguuccggcucaccgagcagcaggucaacuucgugugucagaggguggacauggacaucgucgucuacugcaacggacaacggaaagugauacugacgaagacccucgugauaggccagugcaucuauaccaucaccucccuguucucuuuacuccccggggucgcccacuccaucgccguggagcucugcgugcccggcuuccacgggugggccacggccgcccuguuagucaccuucugcuucggaugggugcugaucccggcgaucaccuucaucaucuugacaguccucaaguucaucgccaauaucuuccacacgaguaaccaagagaaccgccugaaguccgucuuacgcaagaucaaggaggaguucgagaagaccaaggggagcaugguaugcgacguguguaaauacgagugcgagaccuacaaagagcucaaggcccacggcguguccugcccacagagccaaugccccuacugcuucacccacugcgagcccacggaggccgccuuccaagcacacuacaaagugugccaggugacccauagauuccgugacgaccugaagaaaaccgucaccccacagaacuucacgcccggcugcuaccgcacacugaaccucuuccgguacaagucccgcugcuacaucuucaccauguggaucuuccuguuagugcucgagagcauccugugggccgccuccgccagcgagacgccacugaccccgguguggaacgacaacgcgcacggggucggcuccgugcccaugcacaccgaccucgagcuggacuucucccugaccucuaguagcaaguacaccuaccggcgcaagcugaccaacccccucgaggaggcccagucaaucgaccugcacaucgagauugaggagcagacuaucgggguggacguccacgcccugggccacugguucgacgggcggcucaaccuaaagaccagcuuccacugcuacggcgccugcacgaaauacgaguaccccuggcacaccgccaagugccacuacgagcgcgacuaccaguacgaaacguccuggggcugcaacccguccgacugccccgggguuggcaccgggugcaccgcgugcggacuguaccucgaucagcuuaagcccgugggauccgccuacaagaucaucaccauccgcuacagccggcgcguaugcgugcaguucggggaggagaaccugugcaagaucaucgacaugaaugacugcuuugugucccggcacguuaaggugugcauuaucggcacgguaagcaaguucucccagggggauacccuccuuuucuucggcccccuggagggcgggggccuaaucuucaaacacuggugcaccuccacgugccaguucggggacccgggcgacaucaugagcccccgcgacaagggguuccugugccccgaguuccccggcagcuuccggaaaaagugcaacuucgccaccaccccgaucugcgaguacgacgguaacauggucuccggcuacaagaaggugauggccacuaucgacagcuuccaguccuucaauaccucgaccaugcauuuuacggacgagcgcaucgaguggaaggacccggauggcaugcuccgggaccacaucaacauccuugugaccaaggacauagauuucgacaaccugggggagaacccaugcaagauuggccugcagaccuccucgaucgagggcgccuggggcagcggggucggcuucacgcugacgugccugguauccuugaccgagugcccgaccuuucucacgagcauaaaggcgugcgacaaggcgaucugcuacggggccgaguccgugacauuaacccgcggucaaaauaccguuaaggugagcggcaaaggcggccacuccgggagcacguuccggugcugccacggggaggacugcucccagaucggccugcacgccgccgcgccgcaccucgacaaggucaacgggaucucagagauagaaaacuccaagguguacgacgacggcgcgccccagugcgguaucaagugcugguucgucaagagcggcgaguggauuuccggcaucuucagugggaacuggaucgugcugaucgugcuaugcguguuccugcuguucucccuggugcuccugagcauacugugccccgugcgcaagcauaagaagucauga

SEQ ID NO: 15023 - RNA, 3408 nt, Artificial Sequence
  derived and/or modified CDS sequence (opt11) from HTNV__EU074672.1__GP
augggcaucuggaaguggcuggugauggcgagccucgucuggcccgccuucgcgcugcgcaacguguacgacaugaagaucgagugcccgcacaccgugucguucggggagaacagcgucaucggcuacguggagcugccgcccaugccccucgccgacaccacgcaaauggugcccgaguccagcugcuccauggacaaccaccagagccugaacaccauuacuaaguauacccagaucaucuggcgggggaaggccgaccagucccagagcucccagaacagcuucgagacggucuccaccgagguggaccugaaggguaccugcgugcucaagcacaagaugaucgaggaaagcuaccgcucccguaagucaaucacgugcuacgaccuguccugcaacagcaccuacugcaagcccacgcuguacaugauaguccccauccacgccugcaauaugaugaaguccugccucaucgcucuggggcccuaccggguccagguaguguacgagcggaccuacugcaugaccggcgugcugauagagggcaagugcuucgugccggaccagagcgucguguccaucaucaagcauggaaucuucgacaucgcgagcgugcacaucgucugcuucuucguggccgugaaggggaauacguacaagaucuucgagcaagucaagaaguccuucgaaagcaacugcaacgacaccgagaacaaggugcagggguacuacaucugcaucauuggcgggaacagcucccccguguacguccccacccucgacgacuuccgcagcauggaggcguucuccggcaucuuccggagcccccacggcgaggaccacgaccuggccggggaggagguggcguccuacagcaucguuggcccggccaaugccaaggugccccacuccgccagcuccgacacccuggggcucaucgcuuacagcggcauccccuccuauagcucccugagcauccugacguccagcaccgaggcgaagcacguguucucgcccggccucuuuccgcagcucaaccacaccaagugcgacaagaccgccaucccccugacguggaccgggaugauagaccuccccggcuacuacgaggccauccaccccugcaccgucuucugcgugcugagcgggccgggcgccagcugcgaggccuucuccgagggcggcaucuucaacaucaccagccccaugugccugguguccaagcagaaccgcuuccggcucacggagcagcaggucaacuucgugugucagcgcguggacgucgacaucaucguguacugcaacggccagcggaaggugauccugaccaagacccuggucaucgggcagugcaucuacaccaucacgagccucuucucccugcugcccggcguggcgcacagcaucgccguggagcucugcguccccggguuccacggcugggccaccgccgcccugcuggugaccuucugcuucgggugggugcucaucccggcgaucaccuuuaucauccugacgauccugaaguuuauagccaacaucuuccacaccuccaaccaggagaaccgccucaagagcguccugcggaagaucaaggaggaguucgagcgcaccaagggcuccauggugugcgacauuugcaaguacgagugcgagaccuaccgggagcugaaggcccacggcguaagcugcccgcagucccagugccccuauugcuucacccacugcgagcccaccgaggccgccuuccaggcgcacuacaaggucugccaggugacccaccgcuuccgggacgaccucaagaaaaccguaaccccgcagaacuucacgcccgggugcuaccgcacccucaaccuguuccgguacaagagccgcugcuacaucuucaccaugugggucuuccuccuggugcuggagucuauccucugggccgccagcgccuccgagaucccccugaacccgguguggaacgacaacgcgcacggcgucgggucuaucccaaugcacaccgaccuggagcucgacuuuucccugacgagcagcuccaaguacaccuaccggcgcaagcugaccaacccccuagaggaaagccaggccaucgaccuccacguggagaucgaggagcagaccaucggcguggacguccacgcccuggggcacugguucgacggccgccugaaccucaagacguccuuccacugcuacggcgccugcaccaaguacgaguaccccuggcacaccgccaagugccacuacgagcgggacuaccaguacgagaccagcugggggugcaacccgucugacugccccggcguggggacgggcugcaccgcgugcggccuguaccuggaccagcucaaacccguggggagcgccuacaagaucaucaccauccgcuacucccggcgcgucugcgugcaguucggcgaggagaaccugugcaagaucaucgacaugaacgacugcuucguaagccggcacgucaaagugugcaucaucgggaccguguccaaguucagccagggcgacacgcugcuguucuucgggccccuggagggcggcgggcugaucuucaagcacuggugcaccuccacgugccaguucggcgacccgggggacaucaugagcccccgcgacaagggcuuccucugcccggaguuccccggguccuuccggaagaagugcaacuucgccaccaccccggucugcgaguacgacggcaacauggucagcggcuacaagaaggugauggccaccaucgacuccuuccagagcuucaacaccuccaccaugcacuucacggacgaaagaaucgaguggaaggaccccgacggcaugcugcgggaccacaucaacauccuugucaccaaggacaucgacuucgacaaccucggcgagaaccccugcaagaucggccugcagaccagcuccaucgagggcgccugggggagcggcgugggcuucacccugacgugccucaucagccugaccgagugcuccaccuuccugaccagcaucaaggcgugcgacaaggccaucugcuacggggccgaguccgugacgcucacccgcggccagaacaccgucaagguuagugggaagggcgggcauuccggcagcuccuucaagugcugccacggcgaggagugcagccagaucgggcugcacgccgccgcuccccaccuggacaaggugaacggcaucuccgagauggagaacucaaaggucuucgacgacggggccccgcagugcggcaucaagugcugguucgugaaguccggcgaguggaucagcgggaucuucuccggcaacuggaucgugcucaucguccugugcguguucuuacucuucagccugguccugcucuccauccugugcccugugcggaagcacaagaaguccuga

SEQ ID NO: 15024 - RNA, 3408 nt, Artificial Sequence
  derived and/or modified CDS sequence (opt11) from HTNV__GQ120966.1__GP
auggagaucuggaaguggcuggugauggccagccucgucuggcccgccuucacucugcgcaacguguacgacaugaagaucgagugcccacacaccguguccuucggcgagaacagcgucaucggguacguggagcugccgcccaugccccucgccgacacggcccagauggugcccgaguccucaugcaacauggacaaccaccaguccaugaacaccaucaccaaguacacccaggucagcuggcggggcaaggccgaccaggcccaggccucccagaacagcuucgaggccguguccgccgagguggaccugaaggggacgugcguccugaagcacaagaugcucgaggagagcuaccgcucccgcaagagcauaaccugcuacgaccugaguugcaacagcaccuacugcaagcccacccuguacaugaucgugcccauccacgccugcaacaugaugaaguccugccucaucgcccugggccccuaccgggugcagguuguguacgagcggacguacugcaugaccggggugcugaucgaaggcaagugcuucgucccggaccagagcgucguguccaucaucaagcacggcaucuucgacaucgcgagcguccacaucgugugcuucuucguggccguaaaggggaacaccuacaaacucuucgaacaggugaagaaguccuuccagagcacgugcaacggcaccgagaacaaggugcagggguacuacaucugcaucgucggcgggaacagcgcccccaucuacgugcccacccuggacgauuuccgauccauggaggcguucagcggcaucuuccggagcccccacggcgaggaccacgaccuggccggggaggagaucgcgagcuacuccaucgucggcccggccaacgcaaaggugccccacagcgccuccagcgacacccucucccugaucgccuacagcgggaucccauccuacagcucccugagcauccucgcguccagcaccgaggccaagcacguguucucccccggcuucuucccgcagcugaaccacacgaagugcgacaagaccgccaucccccugaccuggaccgguaugaucgaucuccccggguacuacgaggccauccaccccugcacggucuucugcgugcugagcggcccgggagcuuccugugaggcguucagcgagggcgggaucuuuaacaucaccagcccgaugugccugguguccaagcagaaccgcuuccggcucaccgagcagcaggucaacuucgugugccagagaguggauauggacaucaucgucuacugcaacggccagcggaaggugauccugacaaagacgcugguaauaggccaguguaucuacaccaucaccagccucuucucccugcugcccggggucgcccacagcaucgccguggagcucugcgugcccggcuuccacgggugggccaccgcggcgcugcuggucacguucugcuucggaugggugcucaucccggcccugacccugaucauccucaccauccugaaguucaucgccaacaucuuccacaccuccaaucaggagaaucgccucaagagcgugcugcggaagaucaaggaggaguucgagaagacgaagggguccauggucugcgacgugugcaaguacgagugcgagaccuacaaggagcugaaggcccacggcguaagcugcccccagucacagugccccuacugcuucacccauugcgagcccaccgaagcggccuuccaggcccacuaccgcgucugucaggugacgcaccgguuccgcgacgacuugaagaagaccgugaccccgcagaacuucacccccggcugcuaccggacccucaaccuguuccgcuacaagagccggugcuacaucuucacgauguggguaugccugcucgugcuggaguccauccugugggccgccagcgcguccgaggugccccucaacccagucuggaacgacaacgcccacggggugggcagcgugcccaugcacaccgaccuggagcuggacuucccccugaccuccucuuccaaguacacguaccgccggcgccucacgaacccccuggaggagacccagucgaucaaccugcacaucgagaucgaggagcagaccaucggggucgacgugcacgcccucggccacugguucgacgggcgccugaaccugaagaccagcuuccacugcuacggcgccuguacgaaguacgaguacccguggcacacagccaagugccacuacgagcgggacuaccaguacgagaccuccuggggcugcaaucccgcggacugccccggggugggcaccgggugcacggccugcggccucuaucuggaccagcugaagcccgucggcagcgccuacaaaaucaucaccauccgcuacucccggaaggugugcgugcaguucggggaggagaaccucugcaaggucaucgacaugaacgacugcuucgugacccgccacgugaaggucugcaucaucggcaccgugagcaaguucucacagggggacacgcugcuguucuucggcccgcucgaagggggcggccugaucuucaagcacuggugcacguccaccugucaguucggggacccuggcgacaucaugagcccccgggacaagggguuccugugccccgaguucccgggcuccuuccgcaagaagugcaauuucgccaccacgccccucugcgaguacgacgggaacaugguguccggcuacaagaaggucauggccaccaucgacagcuuccaauccuucaacaccagcaccaugcacuucacggacgagcggaucgaguggaaggaccccgacggcaugcugcgcgaccacaucaacauccuugugaccaaggacaucgacuucgacaaccucggggagaaccccugcaagaucggccugcagaccuccagcaucgagggggcguggggcuccggggugggcuucacgcugacgugccucaucagccugacugagugcccgaccuuccugaccuccaucaaggcuugcgacaaggccaucugcuacggagccgagagcgucacgcucacccgggggcagaacaccgugaagguguccggcaaagggggccacagcgggagcaccuucaagugcugccacggcgaggagugcucccagauaggccugcacgcggccgcgccccaccuggacaaggucaacgggaucucggagaucgagaacaacaagguguacgacgacggcgcuccccagugcggggugaagugcugguucgucaaguccggcgaguggaucuccgguaucuucuccgggaacuggaucgugcucauaguccugugcguguuccuccuguucagccuggugcuguuguccguccugugccccguccgcaagcacaaaaagagcuga

SEQ ID NO: 15025 - RNA, 3408 nt, Artificial Sequence
  derived and/or modified CDS sequence (opt11) from HTNV(CGAa1011)__EF990927.1__GP
auggaaauauggaaguggcucgucauggccagccuagucuggcccgcacucgcucuccggaacguccacgacaugaaaaucgaaugcccacacacgguuuccuuugguaaaaacuccguuaucggauacgucgaacucccaccuaugccucucgcagacacaauccaaaugguccccgaauccucaugcucaauggacaaccaccagucgcuuuccaccguuaccaaauacacacaagugucauggcggggcaaagcagaccaagcacagucaaaccagacuagcuucgaaaccguuagcguagaagucgaccuuaaaggaaccugcgugcucaaacacaagcucgucgaagaauccuaccgcucccgcaaaagccucacgugcuacgaccucucuugcaacucgaccuacugcaaaccuacccucuacaugauagucccaauucacgccugcaauaugaugaaguccugcaucauugcgcucggaccccacagaguccaaguaguauaugaaaggaccuacugcaugaccggaguccucuuagaaggaaaaugcuucguaccugaucagagcguaguaggcauagucaaacacgguaucuucgacauugcguccguccacaucgccugcuucuucgucgccaucaccggcaacaccuacaaacucuucgagcaaguuaaaaagagcuuugguacuaccugcaacgacaccgaaaacaaaguccaaggauacuacauuugcauccuuggcggaaacucuccucccaucuacguucccacccuugacgacuuccgcucuauggaggccuuuucagguaucuucaaaagcccacacggcgaggaccacgaucuagcaggagaggagaucgcuucauauagcauagugggccccgccaaugccaaagucccacauucagccuccuccgacacccuaucucucaucgccuucuccggcauccccuccuauucaagccucuccauccucaccuccucaacagaagccaaacacgucuucucacccggacucuucccucaacuaaaccauacaaaaugcgacaaaaccgccauaccccucacauggaccggcauaaucgaccuccccggauauuaugaggcggugcacccaugcaccguguucuguguacuauccgguccgggcgcaagcugcgaagccuucagcgagggaggcauauucaacaucaccucacccaugugccuuguaucgaaacaaaaccguuuccgccuaaccgaacaacaagucaacuuuguaugucagcgaguugacauggacaucgucgucuacuguaacggacagcgcaaagucauccucacuaaaacgcuugugaucggucaaugcauauacaccaucacuucacucuucagccuccuaccaggcguugcccauuccauugccgucgaacuaugcgucccagguuuccacggcugggccaccgcagcucuuuuaaucaccuucugcuucggauggguccuaauccccgccuuaaccuucaucguacugacaguucucaaguucauagcgaacaucuuccacaccagcaaccaagagaaccgacuaaaaaugguccuaaagaaaaucaaagaagaguucgagcguacaaaagguuccaugguuugcgacaucugcaaauaugaaugcgaaacauacaaagaacucaaagcucacggcguaucaugcccucaaucccagugccccuauugcuucacgcauugcgaacccaccgaauccgcauuccaagcccacuaccgcguaugccaagucacacaccgauuccgagaugaccucaagaaaaccguaacaccccaaaacuucacccccggcugcuaccgaacccuuaaccuauuccguuacaaaucacgaugcuacaucuucaccauguggauuugcuugcugguccucgagagcauccucugggccgccucggccucugaaaucccccugucacccaccuggaacgauaacgcgcacggcguuggcagcauccccaugcacaccgaccucgaacucgacuucucgcuuaccucuagcucuaaauauaccuaccgucgaaaacugaccaacccucucgaagaaucccaagccgucaacuuccacguagaaauugaggagcaagccaucgggguagacguacaugcccucggccacugguuugacggccgccucaaucuaaagaccuccuuccacugcuacggugcaugcaccaaauacgaauacccuuggcacaccgcaaagugccacuacgaaagagauuaucaauacgaaaccuccuggggcugcaauccaucugauugcccuggagucggcaccgguugcaccgccugcggacucuaccucgaccaacucaaacccguaggguccgcauacaaaaucauuaccauucgauacucacgaagagucugcgugcaauucggcgaggaaaaccuaugcaaaguuaucgauaugaacgacuguuucgucagccggcacgucaaaguaugcaucaucggaacuguuuccaaauuuagucaaggagacacccuccuauucuucgguccacucgaaggagggggacucauauuuaaacacuggugcaccagcaccugucaauucggcgaccccggcgacaucaugagcccgcgcgacaaaggcuucuuaugccccgaguuccccgggucauuucgaaagaaaugcaacuucgccaccacaccagucugugaauacgacgggaacauggucagcggcuacaaaaaggucauggcaacaaucgauuccuuccaauccucaaacaccucuacaaugcacuucaccgacgaacggauagaauggaaagacccugacggaaugcuccgcgaccauaucaacauccuagucacgaaggacauagacuucgacaaccucggagaaaacccuugcaaaaucggucuacagacaagcuccaucgagggcgcauggggaucaggcgucggcuucacccuaaccugccucaucucccucacugagugcccaaccuuccucaccuccauuaaggccugcgacaaggcgauuugcuacggugccgagagugucacucucacacguggccaaaacacugucaaaguauccggaaaaggaggacacagcgguuccaccuucaagugcugccacggcgaagacuguucacaauccggccuccacgccgcggcuccccaccucgacaaaguaaacgguauauccgagauugaaaacuccaaaguauacgacgauggagcgccacaguguggcguaaaauguugguucgucaaaucuggugaauggaucucaggaaucuucagcggaaacuggaucguccuuauaguccuuuguguuuuccuccucuucucccucguucuccucucaauccuaugccccgucagaaaacacaaaaaguccuaa

SEQ ID NO: 15026 - RNA, 3408 nt, Artificial Sequence
  derived and/or modified CDS sequence (opt11) from HTNV(CGAa2)__EU092223.1__GP
auggagaucuggaaguggcuggugauggccagcuuggucuggcccgcccucgcccugcgcaacgugcacgacaugaagaucgaguguccgcacaccguguccuucggcaagaacagcgucaucggcuacguggagcucccacccaugccccuggccgacaccauccagaugguccccgaaucuucuugcuccauggacaaccaucaaagccugucaacggucaccaaguacacccaagugucuuggcggggcaaggccgaccaggcccagcccucccagaccagcuucgagacgguguccgucgagguggaccucaaggggaccugcgugcugaagcacaagcuggucgaggaaagcuaccgcucccggaagucccugaccugcuacgaccucucgugcaacagcaccuacugcaagccaacgcuguacaugaucgugcccauccaugccugcaacaugaugaaguccugcaucaucgcccucggcccgcaccgcgugcaggucguguacgagcggaccuacuguaugaccgggguguuacuggagggcaagugcuucgugcccgaccagagcgugguguccaucguccgccacggcaucuucgacaucgccagcgugcacaucgccugcuuuuucguggccaucaccgguaacacguacaaacucuucgagcaggucaaaaagagcuucggcacgaccugcaacgacaccgagaacaagguucagggguacuauaucugcauccugggcgggaacuccccgcccaucuacgucccgacccuggacgacuuccggagcauggaggcguucagcggcaucuucaagagcccccacggcgaagaccacgaccucgccggggaggagaucgccuccuacagcauugugggccccgcgaacgccaaggugccccacuccgcgagcuccgacacccugagccugaucgccuucuccgggaucccaagcuacagcagccucuccauccugaccagcucgaccgaggccaagcacgucuucagccccggccuguucccccagcucaaccauacgaagugcgacaagaccgccauuccccuuaccuggaccggcaucaucgaccugccgggguacuacgaagccgugcaccccuguacgguuuucugcguccuguccggccccggggcuagcugcgaggccuucagcgagggcgggaucuucaacauaaccucccccaugugccuggugagcaagcagaaccgcuuccggcugacagaacaacaggugaacuucgucugucagcggguggacauggacaucguggucuacugcaacggccagcggaaggugauccucacuaagacgcuggugaucggccagugcaucuacaccaucaccucccuguucucgcuccugccgggagucgcccacucuaucgccguggagcugugcguucccggcuuccacggcugggccaccgcggcccuccugaucacguucugcuucggcuggguccugauccccgcccucaccuucaucgugcucaccgugcugaaguucaucgccaacaucuuucacacaagcaaccaagagaaccgccucaagaugguccugaagaagaucaaggaggaguucgagcggacgaagggguccauggugugcgacaucugcaaguacgagugcgagaccuacaaggagcugaaggcccacggcgugagcugcccgcagucccagugcccguauugcuucacacacugugagcccaccgagucagcguuccaggcgcacuaccgcgucugccagguaacccaccgguuccgcgacgaucucaagaagacggugacgccccagaacuucaccccgggcugcuaccggacccugaaccuguuccgcuacaagucccggugcuacaucuucaccauguggaucugcuuacugguucuggagagcauccugugggccgcuuccgcgagcgagaucccccucagcccuaccuggaacgacaacgcccacggugucggcagcauccccaugcacacggaccuggagcuggacuucucccucaccagcagcuccaaguacacguaccgccggaaguugaccaacccgcuggaggaaagccaggcagugaacuuucacgucgaaaucgaggagcaggccaucggcguggacguacaugcccucggccacugguccgacggacgccugaaccugaagaccagcuuccacugcuacggcgcgugcaccaaguacgaguaccccuggcacacggccaagugccacuacgagcgcgacuaccaguacgagaccuccuggggcugcaaccccagcgacugccccggggucggcaccggaugcaccgccugcggccucuaccuggaccagcugaagccggugggcuccgccuacaagaucaucacgauacgguacagucgccgugugugcguucaguucggggaggagaaccucugcaaggugaucgacaugaacgacugcuucgugucccgccacgucaaggucugcaucaucggcaccgucucgaaguucucccagggggacacguugcuguucuucggcccccucgaagggggcggccugaucuucaagcacuggugcaccagcacgugccaguucggggaccccggugacaucaugagcccccgggacaagggguuucugugcccggaguuccccggcagcuuccgcaagaagugcaacuucgccaccacccccgucugcgaauacgacgggaacaugguguccggcuacaagaaggugauggcgaccaucgacagcuuccagaguagcaacacguccaccaugcacuuuaccgacgagcggaucgaauggaaggaccccgacggcaugcuccgcgaccauaucaacauccuggucaccaaggacaucgacuucgacaaccugggggagaauccaugcaagaucggccuccagaccagcucaaucgaaggggccuggggcucuggggugggcuucacccugaccugccugaucagccucaccgagugccccacguuccugaccucuaucaaggccugcgacaaggccaucugcuacggugcagagucugugacccugacccgggggcaaaacacggucaagguauccggcaagggagggcacagcggguccaccuucaaguguugucacggcgaggacugcagccaguccggcuuacacgcggccgcgccccaccucgauaaggugaacgggaucagcgagauagagaacuccaaggucuacgacgacggcgcgccccagugcggggugaagugcugguucgucaagagcggagaguggaucuccggcaucuucagcgggaacuggaucgugcugaucguccucugcgucuuccugcuguucucacucgugcugcugagcauccucugcccggugcgcaagcacaagaaguccuga

SEQ ID NO: 15027 - RNA, 3408 nt, Artificial Sequence
  derived and/or modified CDS sequence (opt11) from HTNV(CGAa31MP7)__EF990925.1__GP
augggcauauggaaguggcuggugauggccagccucgucuggcccgccuucgcccugcgaaacguguacgacaugaaaaucgaguguccgcacacugugucguucggggaaaauucagucaucggcuauguugagcugccgcccaugccccucgccgacaccacgcagaugguacccgaguccucgugcucgauggacaaccaccagagccugaacaccaucaccaaguacacccagaucaucuggcgggggaaggccgaccagucccagagcucccagaacagcuucgagacggucuccacgggcguugaccugaaggggacaugcgugcucaagcacaagaugaucgaggagagcuaccgcucccgcaagagcaucacgugcuaugaccuguccugcaacagcaccuauugcaagcccacccuguacaugaucguccccauccacgccugcaacaugaugaagaguugccucaucgcccuuggccccuaucgcguccaggugguguacgagcggaccuacugcaugacuggcguguugaucgaggggaagugcuucgugccggaccagagcgucguguccaucaucaagcacggcaucuucgacauugcgagugugcacaucguaugcuucuucguggccgugaaggggaacacguacaaaaucuucgagcaagucaagaaauccuucgagagcaacugcaacgacaccgagaacaaggugcagggauacuacaucugcaucaucgggggcaacagcucccccgucuacguccccacccuugacgacuuccgcagcauggaggccuuuucaggcaucuuccgaagcccccacggggaggaccaugaccuggccggcgaggagguggcguccuacagcaucgucgggccggccaacgccaaggugccccacuccgccagcuccgacaccuugggccucaucgccuacagcggcauccccucauacagcagucugagcauccugacguccagcaccgaggccaagcacguguucucccccggccuguucccgcagcugaaccacacgaagugcgacaagaccgccaucccccugacauggaccggcaugaucgaccuccccggguacuacgaggcaauucaccccugcaccgucuucugcguacugagcggcccgggcgccagcugcgaggcguucuccgaggguggcaucuuuaacaucaccagccccaugugucugguuuccaagcagaaucgcuuccggcucacggagcaacaggucaacuucgugugccagcgcguggacgucgacaucaucguguacugcaacgggcagcggaaagucauuuugaccaagacccuggucaucggccagugcaucuacaccaucacgagccucuucucccugcuucccgggguggcgcauagcaucgccguggaguugugcguccccggcuuccacgggugggccaccgccgcccugcuggugaccuucugcuucggcuggguucucaucccggcgaucaccuucaucauccugacgauccugaaguucaucgcuaauaucuuccacaccagcaaucaggagaaccgccucaagagcguauugcggaagaucaaggaagaguucgagcgcaccaagggcaguauggugugugacauaugcaaguacgagugcgagaccuacaaggagcugaaggcccacggagugagcugcccccagucccagugccccuacugcuucacgcacugcgagcccacggaggccgccuuccaagcgcacuaccgggucugccagguaacccaccgcuuccgagacgaccucaagaagaccgugaccccgcagaacuucacgcccggcugcuaccgcacccugaaccuguuccgguacaagagucgcugcuacauauucaccauguggaucugccuccugguccuggaguccauccucugggccgccagcgccuccgagaucccccucaacccgguguggaacgacaaugcgcacggggugggcagcauccccaugcacaccgaccuggagcucgacuucucgcugacgagcagcaguaagcacaccuaccggcgcaagcugaccaacccccuggaggaaagccaggcgaucgaccuacacgucgagaucgaggagcagacgaucgggguggacgugcacgcccugggccacugguucgacggcaggcugaaccucaagacguccuuccacugcuacggggccugcaccaaguaugaauacccauggcacaccgccaagugccacuacgagcgggacuaccaguacgagaccuccuggggcugcaacccguccgacugccccggggucggcacgggcugcaccgcgugcgggcuguaccuggaucagcucaagcccgugggcagcgccuacaagaucaucaccauacgcuacucccggcgcgugugcguccaguucggggaggagaaccugugcaaggugaucgauaugaacgacugcuucgugagcaggcacgucaaggugugcaucaucggcaccguguccaaguucagccaaggggacacacuccucuuuuucggcccacuggagggcgggggccugaucuucaagcacuggugcaccuccacgugccaguucggggacccgggcgacaucaugagcccccgcgauaagggguuccucugccccgaguuccccggcuccuuccgaaagaagugcaacuucgccacgacgccggucugcggcuacgacgggaacaugguaagcggcuacaagaaggugauggccaccaucgacuccuuccagagcuucaacaccuccaccaugcacuucacggacgagcgcaucgaguggaaggacccagacgggaugcugcgggaccacaucaacauccuggucaccaaggacaucgacuucgacaaccucggcgagaaucccugcaagaucgggcugcagaccagcuccaucgagggcgcauggggcagcggcgugggcuucaccuugacgugccucaucagccugaccgagugucccaccuuccugacauccaucaaggcgugcgacaaggccaucugcuauggggccgagagcgugacgcucacccgcggccagaacacggucaagguguccgggaagggcggacacagcggguccacuuucaagugcugccacggcgaggacugcagccaguccgggcuccacgccgccgcgccgcaccuggacaaagugaacggcaucagcgaaaucgagaacuccaaaguauacgacgacggcgcgccccagugcggaaucaaaugcugguuugucaaauccggcgaguggaucuccgggaucuucagcggcaacuggaucgugcucaucgugcugugcguguuccuucuguucucccugguccugcucagcauccugugccccguccggaagcacaagaagucauga

SEQ ID NO: 15028 - RNA, 3408 nt, Artificial Sequence
  derived and/or modified CDS sequence (opt11) from HTNV(CGAa4MP9)__EF990929.1__GP
auggagaucuggaaguggcuggugauggccagccucgucuggcccgcccuugcccuucgcaacguauacgacaugaagaucgagugcccccacaccguguccuucggcgagaacucgguccucggguacguggagcugcccccgaugccccuggccgacaccauccagauggugccggaguccagcugcuccauggauaaccaccagagcauguccacggccaccaaguauacccagguuagcuggcggggcaaggccgaucaggcccaguccagccaaaccuccuucgagacggucagcguggaagucgaccucaaggggaccugcguguugaagcacaagaugguggagaaguccuaccgcagccggaagucccuuaccugcuacgaccucagcugcaacuccaccuacugcaagcccacgcuguacaugaucguccccauccacgccugcaacaugaugaaguccugcaucaucgcccuggggcccuaucgcguccagguggucuacgagcggaccuacugcaugaccggggugcuccuggagggcaagugcuucgugccggaccaguccgucgugucaaucgugaagcauagcaucuucgacaucgccuccguccauaucgccugcuucuucguugcgaucacaggcaacacguacaagcugaucgaacaggugaagaccagcuucgggacaaccugcaacgacacggaggacaagguccagggcuacuacaucugcauccucgggggcaacuccccaccuaucuacgugcccacccuggacgacuuccgcagcauggaggccuuuuccgggaucuuccggagcccgcacggcgaggaucacgaccuggccggcgaggagaucgccuccuacagcaucgucgggcccgccaacgcgaagauaccccacuccgccucguccgacacccucagccugaucgccuucuccggcauccccagcuauuccucccuguccauccucaccagcuccacggaggccaagcacguguucagcccggggcuguucccacagcugaaccacaccaagugcgacaagaccgccaucccccucaccuggacgggcaucaucgaccugcccggcuauuacgaggcggugcauccuugcaccgucuucugcgugcuaagcggacccggcgccuccugcgaggccuucagcgaaggcggcaucuucaacaucaccucccccaugugccucgugagcaagcagaaccgcuuccggcugaccgagcagcagguaaacuuugugugccagcgcguggacauggacaucgucguguacugcaacgggcagcggaaagugauccugacgaagacccucgucaucggccagugcaucuacaccaucaccucccuguucagccugcuccccggcgucgcucacuccaucgccguggagcucugcgugccgggguuccacggcugggcgacggccgcccugcucguuacauucugcuucggguggguccugaucccugccaucaccuucgucgugcugaccguucucaaguucaucgcuaacaucuuucacacgagcaaccaggagaaccgccucaagaugguccuaaagaagaucaaggaggaguucgagaagaccaagggcuccauggugugcgacaucugcaaguacgagugcgagaccuacaaggagcuuaaggcgcacggggugagcugcccccagucucagugccccuauugcuucacccauugcgagccgaccgagagcgccuuccaggcgcacuaccgggucugccaggugacacaccguuuccgcgaggaccuaaagaagaccguaacgccccagaacuucaccccuggcugcuaccgcacccugaaccucuuccgguacaagucccgcugcuacaucuucaccauguggaucuuccugcugguccucgagagcauccugugggccgcguccgccagcgagaccccucugucccccaccuggaacgacaacgcccacggcgugggcucuauccccaugcauacggaccuggagcucgacuuuagccugaccuccagcucuaaguacaccuaccggcgcaagcugaccaacccgcucgaggaggcccaggccgugagcuuccacgucgagaucgaggagcagacgaucggcguggacgugcacgcgcuggggcacugguucgauggccgacugaaccucaagaccuccuuccacugcuacggggccugcaccaaguacgaguacccguggcacaccgcaaagugccacuacgagagagauuaccaguacgagacgagcuggggcugcaaccccuccgacugccccggcguagggaccggcugcaccgccugugggcuguaccuggaccagcucaagccggugggcagcgccuacaagaucaucacuauccgguacucccggcgcgugugcguacaauucggcgaggaaaaccugugcaaggugaucgacauggacgacugcuucguuagcaggcacgucaaggugugcaucaucgguacgguguccaaguucucccagggugacaccuugcucuuuuucgggccgcuggagggcgggggccugauauacaagcacuggugcacguccacgugccaguucggagaccccggggacaucaugagccccagagauaagggccuccugugccccgaauuuccuggguccuuccggaagaagugcaacuucgcgaccacccccgucugugaguacgacggcaacaugguaagcggguacaagaagguuauggccaccaucgauuccuuccagagcaucaauacuagcacgaugcacuucaccgacgagcgcaucgaguggaaggacccugacggcaugcugcgggaccacaucaacauccucgucaccaaggacaucgacuucgacaaccugggcgagaaccccugcaagaucgggcugcagaccagcagcaucgaaggcgccuggggguccggcguuggguuuacgcugaccugccucaucagccugaccgagugcccgaccuuccucacguccaucaaggccugcgacaaggccaucugcuacggcgcggagagcgugacacugacgcgcggacagaacaccgucaagguguccgggaaaggcgggcacagcggcuccacauucaagugcugccacggggaggacugcagccaguccggccugcacgccgccgccccgcaccuggacaaggucaacggcaucagcgagauggagaacuccaagguguacgacgacggggcgccccagugcggaaucaagugcugguuugucaagagcggggaguggaucuccggcaucuucagcggcaacuggaucgugcugaucgugcugugcguguuccuccuguucucccugguccuccucagcauacugugccccgugagaaagcacaagaaguccuga

SEQ ID NO: 15029 - RNA, 3408 nt, Artificial Sequence
  derived and/or modified CDS sequence (opt11) from HTNV(CGAa4P15)__EF990928.1__GP
auggaaaucuggaaauggcugguuauggccucgcuaguauggcccgcacucgcacuccgcaacguuuacgacaugaaaauagagugcccgcauaccguguccuucggcgaaaacuccguacuaggauacgucgaguugcccccuaugccccucgcggacacgauacagauggucccggaaagcuccugcaguauggacaaucaccaaagcaugucgaccgcaaccaaauacacccaaguguccuggcgcggcaaggccgaccaagcacagagcucgcaaaccucguucgaaaccgucucgguagaagucgaccucaaagguaccugcguucucaagcacaagauggucgaaaaaucauaccgcucgcgcaaaagccugacgugcuacgauuuaagcugcaacucaaccuacuguaaacccacuuuguacaugaucguacccauccacgcaugcaacaugaugaaguccugcauaaucgcacuaggccccuacagaguucagguagucuacgaaagaacguacugcaugaccggaguacugcucgaaggcaaauguuucgugccagaccagucagucgucuccaucgucaagcacuccauauucgacauagcaucgguacacaucgcuugcuucuuugucgcgaucaccgggaacaccuacaaacucuucgagcaaguaaaaaccagcuucgggacaaccugcaacgacacugaagacaaaguccaaggcuacuacauaugcauacucggaggaaacucgccacccauauacguucccacgcuagacgacuuucgcuccauggaggccuucuccggcaucuuucgcucaccccacggagaggaccacgaccuggcgggagaggagaucgcuuccuauucaaucgucggacccgcaaacgcgaaaauaccccacuccgcaucuuccgacacccucucgcucauagccuuuuccggcauaccuucuuauucaucccucucgauacucacauccagcacagaagcaaaacaugucuucagcccgggucucuucccacaacuaaaccacaccaaaugcgacaaaaccgccaucccccuaaccuggaccggcaucauagaccuccccggguacuacgaagcgguucauccuuguacaguguucugcguacuaagcggacccggcgccucaugcgaagccuucagcgagggcggcaucuucaacauaaccucccccaugugccuggucucaaaacaaaaccguuuccgacuaaccgaacaacaagucaacuuuguuugccagcgaguagacauggacaucgucgucuacuguaacggacaaagaaaggucauacuaacgaaaacccucguaaucgggcaaugcaucuacacaaucaccucacucuucucacuucugccuggugucgcgcacuccaucgcagucgaacuuugcguccccggcuuccaugggugggcaacagcugcccucuuagucaccuucuguuucggcuggguccuaauccccgccaucaccuucgucguccuaacaguacuuaaguucaucgccaacaucuuccacacuagcaaccaagagaaccgccugaagaugguucucaaaaagaucaaggaggaguucgagaaaaccaaaggaucgauggucugcgacauauguaaauacgaaugcgaaacuuacaaggaacucaaagcccacggaguaagcugcccacaaucccaaugcccauacuguuucacucacugcgaacccaccgaaucggccuuucaagcacacuaccgcguaugccaagugacgcaccgcuucagggaagaccucaagaaaaccguuacaccccagaacuucaccccgggcugcuaucgcacccugaaccuauuccgauacaaaagcagaugcuacauuuuuacgauguggauauuccuccucguacuagaauccauacucugggcagccagcgcaagcgaaacaccccuaagccccacauggaacgacaacgcccacggagucggguccauccccaugcacaccgaccuagaacuagacuucucacuuaccagcagcucuaaauacacuuacagacguaagcucacuaacccgcuugaagaggcacaagcaguauccuuccacguggagaucgaggaacagacaauaggcgucgacguccacgcacuaggccacugguucgacggacgccucaaccuaaagaccucauuccacuguuacggugccugcacaaaauaugaauaccccuggcacacggcgaaaugccacuacgaacgcgauuaucaauacgaaacgucguggggcugcaaucccucugacugcccaggagucggaaccggcugcaccgccugcggccuuuaccucgaccaauuaaagccaguuggauccgcguauaaaauaaucacgauuagauacucccgccgggucugcguccaauucggugaagaaaaucucugcaaagucauagacauggacgacugcuucguaucacgccacgucaaaguguguaucaucggcacagucucgaaauucagccaaggagacacacuccucuucuucgggccccuagaaggcggcggccuaaucuucaaacauuggugcaccagcacaugccaauucggcgaccccggcgacaucauguccccacgcgauaaaggguuccuaugccccgaguuccccgguagcuuccgcaagaaauguaacuuugcaaccacccccguuugcgaauacgacggcaacauggucuccggcuauaagaaaguuauggcaaccaucgauucauuucaaucgauaaacacaagcacuaugcacuucacugacgagaggauugaauggaaagaccccgauggaaugcuccgagaccacauaaacauccucguaacaaaagauaucgauuucgacaaccuuggcgaaaaccccugcaaaauaggcuuacagacauccucgauugaaggcgcguggggauccggggucgguuucacccugacgugccucaucucccuaacagagugcccaacguuccuaaccucuaucaaggcaugcgauaaagcgaucugcuacggugccgaaucggucacccucacacgcggacaaaacacggucaaaguaucaggcaaaggcggacacagcggaucuacguuuaaaugcugccacggagaagacugcucacagucgggccuccaugccgccgcgccccaccucgacaaagucaacgggaucuccgaaauggaaaacucaaaaguauacgacgauggagccccacaauguggcaucaaaugcugguucgucaaaagcggcgaauggauaagcggcauauucucaggaaacuggaucguguuaauugucuuaugcgucuuccuccucuucaguuugguccuccuaagcauacuaugccccguccgaaaacacaagaaauccuag

SEQ ID NO: 15030 - RNA, 3408 nt, Artificial Sequence
  derived and/or modified CDS sequence (opt11) from HTNV(CGAa75)__EU092224.1__GP
auggagaucuggaaguggcuggugauggccagccucgucuggcccgcccuagcccugcgaaacgugcacgacaugaagaucgagugcccgcacaccguguccuucggcaagaacagcgucaucggguacguggagcucccgcccaugccccuggccgacaccauacagauggugcccgaguccagcugcucaauggacaaccaccagucucuguccacggucaccaagcacacccaggugagcuggcggggcaaggccgaucaggcccaguccagccagaccuccuucgagacggugagcgucgagguggaccucaaggggacuugcguucugaagcacaagcuggucgaggaguccuaccgcagccggaagucccugaccugcuacgaccugagcugcaacuccaccuacugcaagcccacgcuguacaugaucguccccauccacgccugcaacaugaugaaaagcugcaucaucgcgcucggcccccaccgcgugcaggucguguacgagcggaccuacugcaugaccggggugcugcuggagggcaagugcuucgucccggaccaguccguggugagcaucguccgccacgguaucuucgacauugccagcgugcacaucgccugcuucuucguggccaucaccgggaacacguacaagcuguucgagcaggucaagaaguccuucggcacgaccugcaacgacaccgagaacaaggugcagggguacuacaucugcauccucggcgggaacagcccgcccaucuacguucccacccuggacgacuucagauccauggaggcguucagcggcaucuucaagaguccccacggcgaggaccacgaccucgcaggggaggagaucgccucguacuccaucgugggccccgccaacgccaaggugccccacagcgcgucuagcgacacccugucccugaucgccuucagcgggauccccuccuacagcucccucagcauccugaccuccagcaccgaagccaagcacgucuucuccccgggccuguucccccagcucaaucacacgaagugcgacaagaccgccaucccccugaccuggaccgguauaaucgaccugcccggguacuacgaggccgugcacccgugcacgguguucugcguccucagcggccccggggcgagcugcgaagccuucuccgaaggcgggaucuucaacaucaccagccccaugugccuggucuccaagcagaaccgcuuccggcugaccgagcaacaggugaacuucgucugccagcgcguggacauggacaucguggucuacuguaacggccagcggaaggugauccucaccaagacgcuggugaucggccagugcaucuacaccaucaccagccuguucucccuccugcccggagucgcccacagcaucgccguggagcucugcgugccgggcuuccaugggugggccaccgcggcccuccugaucacguucugcuucggcuggguccugauccccgcccucaccuucaucguguuaaccgugcugaaguucaucgccaacaucuuccacaccuccaaccaagagaaccgccucaagaugguccugaagaagaucaaggaggaguucgagcggacgaaggggagcauggugugcgacaucugcaaguacgagugcgagaccaacaaggagcugaaggcccacggcguguccugcccccagagccagugccccuacugcuucacccacugcgagccgaccgaguccgcgagucaggcccacuaccgcgucugccaggugacccaucgguuccgcgacgaccucaagaagacggugacgccccagaacuucacccccggcugcuaccggacccuuaaccuguuccgcuacaaguccaggugcuacaucuucaccauguggauaugccuccugguccuggagagcauccugugggccgccuccgcgagcgagaucccgcucucccccaccuggaacgacaacgcccacggggugggcagcauccccaugcacaccgaccuggagcuggacuucagccucaccuccagcuccaaguauacguaucgccggaagcugacuaacccccuggaggagagccaggccgugaacuuccacgucgagaucgaggagcaggccaucgggguugacgugcacgcccucggccacugguucgacgggcgccugaaccugaagaccuccuuccacugcuacggcgccugcaccaaguacgaguacccguggcacacggccaagugccacuacgagcgcgacuaccaguacgagaccagcuggggcugcaaccccuccgacugccccggggucggcaccgggugcaccgccugcggccucuaccuggaccagcugaagcccgugggcagcgccuacaagauuaucacuauccgguacucccgccgggugugcguccaguucggggaggagaaccucugcaucgugaucgauaugaacgacugcuucgugucacgccacgucaaggugugcaucaucggcaccguguccaaguucagccagggggacacccugcuguucuucggcccgcuggaagggggcggccugauccugaagcacuggugcaccuccacuugccaguucggggauccaggcgacaucaugagcccccgggacaagggguuccucugccccgaguucccgggcuccuuucgcaagaagugcaacuucgccaccacccccgucugcgaguaugggggcaacauggugagcggcuacaagaaggugauggcgaccaucgacuccuuccagagcuucaacacguccaccaugcacuucaccgacgagcggaucgaguggaaggaccccgacgggaugcugcgcgaccacaucaacauccuggucaccaaggacaucgacuucgacaaccuuggcgagaaccccugcaagaucgggcugcagacgucgagcauugagggcgccuggggguccggcgugggcuucacccugaccugccucaucagccugaccgagugcccgacguuccugacuuccaucaaggccugcgauaaggccaucugcuacggggccgagagcgugacccucacccggggccaaaacacggucaagguguccgggaagggcgggcacuccggcuccaccuucaagugcugccacggcgaggacugcagccaguccgggcugcacgcggccgcgccccaccuggacaaggugaacggcaucagcgagaucgagaacuccaaggucuacgacgacggggcuccccagugcggcauaaagugcugguucgugaaguccggcgaguggaucuccgggaucuucagcggcaacuggaucguccucaucgugcugugcguguuccuccucuucagccugguccugcucagcauccugugccccgugcgcaagcauaaggaguccuga

SEQ ID NO: 15031 - RNA, 3408 nt, Artificial Sequence
  derived and/or modified CDS sequence (opt11) from HTNV(CGHu2)__EU363819.1__GP
augggcaucuggaaguggcuggugauggccagccucgucuggcccgccuucgcccugcgcaacguguacgacaugaagaucgagugcccgcacacaguguccuucggggagaacagcgucaucggcuacguggagcugccgcccaugccccuggccgacaccacgcagauggugcccgaguccagcugcuccauggacaaccaccagagccugaacacuaucaccaaguacacccagaucaucuggcgggggaaggccgaccagagucagagcucccagaacagcuucgaaacggucuccaccggcguggaccugaaggggaccugcgugcucaagcacaagaugauagaggagagcuaccgcucccgcaagagcaucacgugcuacgaccuguccugcaacagcaccuacugcaagcccacccuguacaugaucguccccauccacgccugcaacaugaugaaguccugccucaucgcccugggccccuaccggguccaggugguguacgagcggaccuacugcaugaccggcgugcugaucgaggggaagugcuucgugccggaccagagcgugguguccaucaucaagcacggcaucuucgacaucgcgagcgugcacaucgucugcuucuacguggccgugaaggggaacacguacaagaucuucgagcaggucaagaaguccuucgagagcaacugcaacgacaccgagaacaaggugcagggcuacuacaucugcaucaucgggggcaacagcuccccaguguacguccccacccucgacgacuuccgcagcauggaggccuucuccggcaucauccggagcccccacggggaggaucacgaccuggccggcgaggagguggcguccuacucaauagucgggcccgccaacgccaaggugccccacuccgccagcuccgacacccugggucucaucgccuacagcggcauccccuccuacagcucccugagcauccugacguccaguaccgaggcgaagcacguguucuccccaggacuguucccgcagcugaaccacaccaagugcgacaagaccgccaucccccugacguggaccggcaugaucgaccucccaggguacuacgaggccauccaccccugcaccgucaucugcguacugagcggcccgggggccagcugcgaggcccuguccgagggcggcaucuucaacaucaccagccccaugugccucguguccaagcagaaccguuucaggcugacggagcagcaggucaacuucgugugccaacgcguggacgucgacaucaucguguacugcaacggccagcggaaggugauccugaccaagacccucgucaucggccaaugcaucuacaccaucacgagccuguucucccuccuccccgggguggcgcacagcaucgcgguggagcuguguguccccggcuuccacgggugggccacugccgcccugcucgugaccuucugcuucggcugggugcugaucccggcgaucaccuucaucauccugaccauccucaaguucaucgccaacauauuccacaccuccaaccaggagaaccgccucaagagcguccugcggaagaucaaggaggaguucgaacgcaccaagggauccauggugugcgacaucugcaaguacgaaugcgagaccuacaaggagcucaaggcccacggggugagcugcccccagucccagugccccuacugcuucacgcacugcgagcccaccgaggccgcauuccaggcgcacuaucgggucugccaggugacccaccgcuuccgggacgaccugaagaagaccgugaccccucagaacuucacgcccgggugcuaccgcacccugaaccucuuccgguacaaaagccgcugcuacaucuucaccauguggaucugccugcugguccucgaguccauucugugggccgccagcgccuccgagaucccccugaacccgguguggaacgacaacgcgcacgggguuggcagcauccccaugcacaccgaccucgagcuggacuucucccugaccagcagcuccaagcacaccuaccggagaaagcucaccaacccccucgaggagagccaggccaucgaccugcacgucgagaucgaggagcagaccaucgggguggacgugcacgcccugggccacugguucgacggccguuuaaaccugaagacguccuuucacugcuacggggccugcaccaaguacgaguaccccuggcacaccgccaagugccacuacgagcgggacuaccaguacgagaccagcugggggugcaacccguccgacugccccggggucggcacgggcugcaccgcgugcgggcuguaccucgaccagcugaagcccgucggcagcgccuacaagaucaucaccauccgcuacucccggcgcgugugcguccaguucggggaggagaaccuuugcaaggugaucgacaugaacgacugcuucgugagccggcacguaaaggugugcaucauaggcaccguguccaaguucagccagggggacacgcuccuguucuucggcccccuagagggcgggggccucaucuucaagcacuggugcaccuccacgugccaguucggggacccgggcgacaucaugagccccagggacaagggguuccugugccccgaguuccccggauccuuccggaagaagugcaacuucgccaccaccccggucugcggcuacgacgggaacauggugagcgguuacaagaaggugauggccaccaucgacuccuuccagagcuucaacaccuccaccaugcacuucacggacgagcgcaucgaguggaaggaccccgacgggaugcugcgggaccacaucaacauccucgucaccaaggacaucgacuucgacaaccugggcgagaauccgugcaagaucgggcugcagacgagcuccaucgagggcgccuggggcagcggggugggcuucacccucacgugccugaucagccugaccgagugccccacguuccucacauccaucaaggcgugcgacaaggccaucugcuacggggccgagagcgugacgcugacccgcggacagaacaccguuaagguguccgggaagggaggccacagcggguccaccuucaaaugcugccacggcgaggacugcagccaguccgggcugcacgccgccgcgccgcaccucgacaaggugaauggcaucagcgagauagagaacuccaaggucuacgacgacggcgcuccccagugcggcaucaaaugcugguucgucaagagcggcgaguggaucucugggaucuucucgggcaacuggaucgugcugaucgugcugugcguguuccuccuguucucccugguccuccuaagcauccugugcccagugcggaagcacaagaaguccuga

SEQ ID NO: 15032 - RNA, 3408 nt, Artificial Sequence
  derived and/or modified CDS sequence (opt11) from HTNV(CGHu3)__EU363818.1__GP
auggagaucuggaaguggcuggugauggccagccucguguggcccgcccuggcgcuacgcaacgugcacgacaugaagaucgagugcccccacaccguguccuucggcaagaacagcgucaucggguacguggagcugcccccgaugccccuggccgacaccauccagauggugccggaauccagcugcuccauggacaaccaccaaagccuguccacugccaccaaguacacccaggucagcuggcggggcaaggccgaucaggcccaguccagccagaccuccuucgagacggugagcguggaggucgaccucaaggggaccugcgugcugaagcacaagcugguggaggaguccuaccgcagccggaagucucucacaugcuacgaccugagcugcaacuccaccuacugcaagcccacgcuguacaugaucguccccauccacgcgugcaacaugaugaaguccugcaucaucgcccucggcccccaccgcguccaggugguguacgagcggaccuacugcaugaccggagugcugcuggagggcaagugcuucgugccggaccaguccgucgugagcaucgugcgccacggcaucuucgacaucgccagcguccacaucgccugcuucuucguggcgaucaccgggaauacguacaagcuguucgagcagguaaagaaguccuucggcacgaccugcaacgacaccgagaacaagguccagggguacuacaucugcauucugggcgggaacagcccgcccaucuacgugcccacccuggacgacuuccgauccauggaggccuucagcggcaucuucaagagcccccacggcgaggaccacgaccucgcgggggaggagaucgccuccuacuccaucgucggcccugccaacgcgaagguuccccacagcgccuccagcgacaccuugucccugaucgccuucagcgggauccccaguuacagcucccucucuauccugaccuccagcacagaggccaagcacguguucuccccgggccuuuucccccagcucaaccacacgaagugcgacaagaccgccaucccccugaccuggaccggcaucaucgaccugcccggguacuacgaggcgguccacccgugcacgguguucugcgugcucagcggccccggggccagcugcgaggccuucuccgagggcgggaucuucaacaucacuagccccaugugccuggucuccaagcagaaccgcuuccggcugaccgagcaacaggugaacuucgugugccagcgcguggacauggacaucguggucuacugcaacggccagcggaaggucauccucaccaagacgcuggugaucggccagugcauuuacacccugaccagccucuucucccugcugcccgggguggcgcacagcaucgccgucgagcucugcgugccgggcuuccacgggugggcaaccgccgcccugcugaucacguuuugcuucggcugggugcucauccccgccuuaaccuucaucguacugaccgugcucaaguucaucgccaacaucuuccacaccucuaaccaggaaaaccgccuuaagauggugcugaagaagaucaaggaggaguucgagcggacgaaggggagcauggucugcgacaucugcaaguaugagugcgagaccuacaaggagcucaaggcgcacggcguguccugcccccagagccagugcccuuacugcuucacccacugcgagccgaccgagucagccuuccaggcccacuaccgcgugugccaggucacccaccgguuccgcgacgaccugaagaagacggugacaccccagaacuucacccccggcugcuaccggacccugaaccucuucagguacaagagccggugcuacaucuucaccauguggaucugccugcuggugcuggaguccauccuuugggcggcgagcgccuccgagaucccgcuuucacccaccuggaacgacaacgcccacggggucggcuccaucccuaugcacaccgaccuggagcucgacuucagccucacuagcuccagcaaguacacguaucgccggaagcugaccaaccccuuggaggagucccaggccgugaacuuccauguggagaucgaggagcaggccaucggggucgacgugcacgcgcugggccacugguucgacgggcgucugaaccuuaagaccagcuuccacugcuacggcgccugcaccaaguacgaguacccguggcauacggccaagugccacuacgagcgcgacuaccaguacgagaccuccuggggcugcaacccgagcgacugccccggggugggcaccgggugcaccgccugcggccuguaccuggaccagcucaagcccgucggcuccgccuacaagaucaucacgauccgguacagccgccggguaugcgugcaguucggggaggagaaccugugcaaggucaucgacaugaacgacugcuucgugucccgccacgugaaggucugcaucaucggcaccgugagcaaguucucccagggggacacucuccucuucuucggaccgcuggaagggggcggccugaucuucaagcacuggugcaccagcacgugccaguucggggaccccggcgacaucaugagcccccgggacaagggguuccucugccccgaguucccgggcuccuuccgcaagaagugcaacuucgcgaccacccccgugugcgaguacgacgggaacauggucuccggcuacaagaaggugauggccaccaucgacagcuuccaguccuucaacaccagcaccaugcacuucaccgacgagcggaucgaguggaaggaccccgacggcaugcugcgcgaccacaucaacauccugguaaccaaggacaucgacuucgacaaccucggggagaaccccugcaaggucgggcugcggacguccagcaucgagggggccuggggcagcggugugggcuucacccugaccugccucaucucccugaccgagugcccgacguuccugaccagcaucaaggccugcgacaaggccauaugcuacggugcggaguccgugacccuuacccgcgggcagaacacggucaaggugagcggcaaagggggccacuccgggagcaccuucaaaugcugccacggcgaggacugcucccagagcggccuucacgccgccgccccgcaccuggacaaggugaacgggaucuccgagauugagaauagcaagguguacgacgacggcgcgccccagugcgggauaaagugcugguucgugaaguccggcgaguggaucuccggcaucuucuccgggaacuggaucguccucaucgugcugugcguguuccuccucuucagccuggucuuacucaguauccugugccccgugcggaagcacaaaaagagcuga

SEQ ID NO: 15033 - RNA, 3408 nt, Artificial Sequence; identical to SEQ ID NO: 11747
  derived and/or modified CDS sequence (opt11) from HTNV(CGHu3612)__EF990923.1__GP

SEQ ID NO: 15034 - RNA, 3408 nt, Artificial Sequence
  derived and/or modified CDS sequence (opt11) from HTNV(CGHu3614)__EF990922.1__GP
augggcaucuggaaguggcuggugauggccagccucgucuggcccgccuucgcccugcgcaaccuguacgacaugaagaucgagugcccgcacaccguguccuucggggaaaacagcgugaccggcuacgucgaacucccgcccaugccacuggccgauacgacccagauggugccggaguccagcugcuccauggacaaccaccagagccugaacaccaucaccaaguacacgcagaucaucuggcgggggaaggccgaccagucccagagcucccagaacagcuucgagaccguguccaccgaggucgaucucaaggggacgugcgugcugaagcacaagaugaucgaggagagcuaccgcucccgcaagagcaucacgugcuacgaccuguccugcaacagcaccuacugcaagcccacccucuacaugaucgugccaauccacgccugcaacaugaugaaguccugccugaucgcccuggggcccuaccgcguccaggugguguacgagcggaccuacugcaugacgggaguucucaucgagggcaagugcuucgugccggaccagagcgucgucuccaucaucaagcacgggaucuucgacaucgcgagcgugcacaucguguguuucuucguggccgugaagggcaacaccuacaagaucuucgagcaggucaagaagaccuucgaaagcaacugcaacgacaccgagaacaagguccagggguacuacaucugcaucaucggcggaaacuccagcccuguguaugugcccacgcuggacgacuuccgcuccauggaggcauucagcggcaucuuccggagcccccacggcgaggaccacgaccuggccggggaggaggucgcguccuacuccaucgugggcccggccaacgcuaaggucccccacagcgccuccagcgacacccucgggcugaucgccuacuccagcauccccuccuacagcucccugagcauccucacauccagcaccgaggcgaagcacgucuucucccccggcuuguucccgcagcugaaccauacgaagugcgacaagaccgccaucccccucaccuggaccggcaugaucgaccugcccggguacuacgaggccauccaccccugcacggucuucugcgugcugagcggcccgggcgccagcugcgaggccuucuccgagggcgggaucuucaacaucgcgagccccaugugccucguguccaagcagaacagauuccggcugaccgagcagcaggucaacuucgugugccagcgcguggacguggacaucaucgucuacugcaacggccagcggaaggugauccugaccaagacccucgugaucggccagugcaucuacacgaucacaagccuguucucccugcuccccggcgucgcccacagcaucgcaguggagcucugcgugccuggcuuccacgggugggccacugccgcgcugcucgucaccuucugcuucggcugggugcugauccccgccaucacguucaucauccugaccauccucaaguucaucgccaacaucuuccacaccuccaaccaggagaaccgccucaagagcgugcugcggaagaucaaggaggaguucgagcgcaccaagggguccauggucugcgacaucugcaaguacgagugugagacguacaaggagcucaaggcccacggcgugagcugcccccagucccagugccccuacugcuucacccacugcgagcccacggaggccgcguuccaggcccacuacaagguaugccaggucacccaccgguuccgcgacgaccugaagaagaccgugacgccgcagaacuucaccccgggcugcuaccggacccugaaccucuuccgcuacaagagccggugcuacaucuucaccauguggguguuccugcuaguccucgaguccauccugugggccgccagcgcauccgagaucccccugaacccgguguggaacgacaacgcccacgggguggggagcauccccaugcacacggaccucgagcuggauuucucccugaccagcagcuccaaguacaccuaccgucggaagcugaccaacccccucgaggagagccaggccaucgaccugcacgucgagaucgaggagcagacgaucgggguggacgugcacgcccugggccacugguucgacgggcgccucaaucugaagaccuccuuccacugcuacggcgccugcacaaaauacgaguaccccuggcacaccgcuaagugucacuacgagcgcgacuaccaauacgagacgagcuggggcugcaacccgucugacugccccggcgucggcaccgggugcaccgccugcggccuguaccucgaccagcugaagcccgugggcagcgccuacaagaucaucaccauccgguacucccgccgggugugcgugcaguuuggggaggagaaccugugcaagaucaucgacaugaacgacugcuucgugagccgccacgugaaggucugcaucaucggcacgguguccaaguucagccagggggacacccuucuuuucuucggcccccuggagggcgggggccucaucuucaagcacuggugcaccagcacgugccaguucggggacccgggcgauaucaugagcccccgggacaagggguuccugugccccgaguuccccggcucguuccgcaagaagugcaacuucgccaccaccccgguaugcgaguacgacgggaacauggucagcggcuacaagaaggugauggccaccaucgacuccuuccagagcuucaacaccuccacgaugcacuucaccgacgagcggaucgaguggaaggaccccgacggcaugcugcgcgaccacaucaacauccucgugaccaaggacaucgacuucgacaaccugggugagaaccccugcaagaucggccugcagaccagcuccaucgagggggcguggggcagcggggucggcuucacgcugaccugccugaucagccugacagaaugcuccaccuuccucacgagcaucaaggccugcgacaaggccaucugcuacggcgccgagagcgugacacuaacccgggggcagaauaccgugaaggucagcggcaagggcgggcacuccgggagcuccuucaagugcugccacggcgaggagugcagccagaucggccugcacgccgcagcgccccacuuggacaaggugaacgggaucuccgagauggagaacagcaagguuuucgacgacggcgccccgcagugcgggaucaagugcugguucgugaaguccggcgaauggaucagcggcaucuucuccgggaacuggaucgugcugaucgugcugugcgucuuccuccuguucagccuggugcuccuauccaucuuaugccccguccgcaagcacaagaaguccuga

SEQ ID NO: 15035 - RNA, 3408 nt, Artificial Sequence; identical to SEQ ID NO: 11749
  derived and/or modified CDS sequence (opt11) from HTNV(CGRn15)__EU363814.1__GP

SEQ ID NO: 15036 - RNA, 3408 nt, Artificial Sequence; identical to SEQ ID NO: 11750
  derived and/or modified CDS sequence (opt11) from HTNV(CGRn2616)__EU363816.1__GP

SEQ ID NO: 15037 - RNA, 3408 nt, Artificial Sequence; identical to SEQ ID NO: 11751
  derived and/or modified CDS sequence (opt11) from HTNV(CGRn2618)__EU363817.1__GP

SEQ ID NO: 15038 - RNA, 3408 nt, Artificial Sequence
  derived and/or modified CDS sequence (opt11) from HTNV(CGRn45)__EU092225.1__GP
auggagauuuggaagugguuggugauggccagccucgucuggcccgcccucgcacugcgcaacgugcacgacaugaagauagagugcccccacacagugagcuucggcaagaacagcgucaucggguacguugagcucccgcccaugccccuggccgacaccauccagauggugcccgaguccagcugcuccauggacaaccaccagucgcuguccacggucaccaaguacacccaggugagcuggcggggcaaggccgaccaggcccaguccucccagaccuccuucgaggccgugagcgucgagguggaccucaaggggaccugcguacugaagcacaagcuggucgaggaguccuaccgcagccggaagucccugaccugcuacgaccucagcugcaauuccaccuacugcaaacccacccuguacaugaucguucccauccacgcgugcaauaugaugaaguccugcaucaucgcccucggcccccaccgcgugcaggucguguaugagcggacguacugcaugacgggggugcugcuggagggcaagugcuucgucccggaccaauccguggugagcauaguacgccacggcauuuuugacaucgccagcgugcacaucgccugcuucuucguggcuauuaccgggaacaccuacaaguuauucgagcaggucaagaaguccuuuggcacgaccugcaacgacaccgagaacaaggugcagggguacuacauaugcauccuaggcgggaacagcccgcccaucuacguccccacccuggacgacuuccggucgauggaggccuucagcggcauauucaagucaccccacggcgaggaccacgaccucgccggagaagagaucgccuccuacuccauagugggucccgcuaacgcgaaggugccccacagcgccucuagcgacacgcugucccugaucgccuucagcgggauccccuccuacagcucccucagcauccugaccuccagcaccgaggccaagcacgucuucuccccgggccucuucccccagcucaaccacaccaaaugcgacaagacggccaucccccugaccuggaccggcauuaucgaccugccgggguacuacgaggcugugcauccgugcaccguguucugcgucuuaagcggcccuggggccuccugcgaggccuucuccgagggcgggaucuucaacaucacgagccccaugugccugguguccaagcagaaccgcuuccggcugaccgagcagcaggucaacuucgugugucagcgcguggacauggauaucguagucuacugcaauggccagcggaaggugauccucaccaagacccuagugaucggccagugcauauauacgauaaccagccucuucucccuccugcccggggucgcccacagcaucgccguggaacugugcgugccgggcuuccacgggugggcgacugccgcccuccugaucaccuucugcuuuggcuggguccucauccccgcccucacguucaucgugcugaccgugcugaaauucaucgccaacaucuuccacaccagcaaccaggagaaucgccucaagaugguccugaagaagaucaaggaggaguucgagcggacaaagggguccauggugugcgacaucugcaaguacgagugcgagacguacaaggagcugaaagcgcacggcguguccugcccccagagccaaugucccuacugcuucacucacugcgagccgacggagucggccuuccaggcccacuaccgcgucugccaggugacccaccgguuccgcgacgaccucaagaagaccgugacgccacagaacuucacgccgggcugcuaccggacccuuaaccuguuccgcuauaagagccggugcuacaucuucaccauguggaucugccuccugguccuggaguccauccucugggccgcgagcgccuccgagauaccgcucagccccacguggaacgacaacgcccacgggguuggcuccauccccaugcacaccgaccuggagcuggacuucagccucaccucaucuagcaaguacaccuaccgccggaagcugacgaacccccuggaagaaucccaggccgucaacuuccacgucgagaucgaggagcaggcgaucgggguggacgugcacgcgcucggccacugguucgacgggcgccugaaccugaagaccagcuuccacuguuacggcgccugcaccaaguacgaguacccguggcacacagccaagugccacuacgagcgcgaccaccaguacgagaccucauggggcugcaaccccagugacugccccggcguuggcaccgggugcaccgccugcggacucuacuuggaccagcugaagcccgugggcagugccuacaagaucauaaccauccgguacagccgccgggugugcguccaguucggcgaggaaaaccucugcaaggugaucgaucguaacgacugcuuugugucccggcacgucaaaguuugcauaaucggcacggugagcaaguucucccaaggcgacacccugcuguucuucggcccgcuugagggcgguggcuugaucuucaagcacuggugcaccuccacgugucaguucggggacccgggcgacaucaugagccccagagauaagggguuccuaugcccugaguucccgggcagcuuccggaagaagugcaacuucgccaccacccccgucugcgaguacgacgggaacaugguguccggcuacaagaagguuauggccacuaucgacagcuuucaguccuuuaacaccagcacgaugcacuucaccgacgagcgcaucgaguggaaggaccccgacggcaugcuccgggaccacaucaacauccuggucacgaaggacaucgauuucgacaaccugggggagaaccccugcaagaucggccuccagaccuccagcaucgagggggccuggggcagcgggguuggcuucacgcugaccugccugaucucccucaccgaguguccgacuuuccugacuagcaucaaggccugcgacaaggccaucugcuacggcgcggaguccgugacccugacccgcgggcagaacacagucaaggugagcggcaagggcgggcacuccgggucgacguucaagugcugccacggcgaggacugcucccagagcggacuccaugccgccgccccgcaccuggauaaggugaacgggaucuccgagaucgaaaacagcaaggucuaugacgacggcgcgccccagugcgggaucaagugcugguucguuaaguccggcgaguggaucucuggcaucuucuccgggaacuggaucguccugaucguauugugcguguuccugcuguucagccucguucugcuguccauccucugcccggugcggaagcacaagaaguccuga

SEQ ID NO: 15039 - RNA, 3408 nt, Artificial Sequence; identical to SEQ ID NO: 11753
  derived and/or modified CDS sequence (opt11) from HTNV(CGRn53)__EF990921.1__GP

SEQ ID NO: 15040 - RNA, 3408 nt, Artificial Sequence; identical to SEQ ID NO: 11754
  derived and/or modified CDS sequence (opt11) from HTNV(CGRn93MP8)__EF990919.1__GP

SEQ ID NO: 15041 - RNA, 3408 nt, Artificial Sequence
  derived and/or modified CDS sequence (opt11) from HTNV(CGRn93P8)__EF990918.1__GP
augggcaucuggaaguggcuggugauggccagccucgucuggcccgccuacacccugagaaacguguacgauaugaagaucgagugcccgcacaccgucagcuucggggagaacagcgucaucggcuacguggaacugccgcccauuccccucgccgacacgacccagauggugcccgagaguagcugcuccauggauaaccaccagagccugaacaccaucaccaaguacacacaggucuccuggcgggggaaggccgaccaggcccaggccagccagaacuccuucgaagccgugagcgcggagguggaccugaaggggaccugcguccucaagcacaagaugcuggaggaguccuaccgcagccgaaaguccaucgccugcuacgaccugagcugcaacuccaccuacugcaagcccacccucuacaugaucgugcccauccacgccugcaacaugaugaaguccugccugaucgcccuggggccccaccgcgugcaggucguguacgagcggacguacugcaugaccggugugcuaaucgagggcaagugcuucgucccggaccgcagcguggugagcaucaucaagcacgggaucuucgacaucgcguccguccacaucgugugcuucuucguugccgucaagggcaacaacuacaagaucuucgagcagaucaagaaguccuucgagagcacgugcaacgacaccaagaacaaggugcaaggguacuacaucugcaucgugggcgggaacagcgcccccaucuacguccccacccuggacgacuuccggagcauggaggccuucuccggcaucuuccgcagcccccacggcgaggaccacgaccuggcaggggaggagaucgcguccuacagcaucgugggcccggccaacgccaaggucccccacagcgccagcuccgacacgcucagccugaccgccuacuccgggauccccagcuacuccagccuguccauccucgcgggcagcgccgaggccaagcauguguucucccccggcuucuuuccgcagcugaaccacaccaagugcgacaagacggccaucccccugauguggaccgggaugaucgaccuccccggcuacuacgaggccauccaccccugcaccguguucugcguccugagcgggccgggcgcguccugugaggccuucagcgagggaggcauuuucaacaucacuagccccaugugccugguguccaagcagaaccgguuccgccucacggagcagcaggucaacuucgugugccagcggguggacauggacaucaucguguacugcaacggccagcgcaaggucauccugaccaagacccuggugaucgggcagugcaucuacaccaucacgagccucuucagccugcugcccgguguggcccacagcaucgccgucgagcucugcgugcccggguuccacggcugggccaccgcggcccugcuggugaccuucuguuucggguggguccucaucccggccaugaccuuuaucgugcugacgaucuuaaaguucaucgccaacaucuuccacaccuccaaccaggagaacaagcucaagagcgugcugcggaagaucaaggaggaguucgagaaaaccaagggcuccauggucugcgacgugugcaaguacgagugcgagaccuacaaggagcugaaggcgcacggcgugagcugcccccagucccagugccccuacugcuucacgcacugcgagcccaccgaggccgccuuucaggcccacuaccgugucugccagguuacccaccgguucagggacgaccucaagaagacggugacgccgcagaacuucacccccgucugcuaccggacccugaaccuguuccgcuacaagagccggugcuacaucuucaccauguggguguuccuccuagugcuggaguccauccucugggccgcgagcgccuccgagaucccccugaacccggucuggaacgacaacgcccacggggugggcagcgugcccaugcacaccgaccuggagcucgacuucucccugacgagcuccagcaaguacaccuaccgccggaagcugaccaacccccuggaggagagccaggccaucaaccuccacauugagaucgaggagcagaccaucggggucgacgugcacgcccugggccacugguucgacgggcgccugaaccucaagacguccuuccacugcuacggcgcgugcaccaaauacgaguaccccuggcacaccgccaagugccacuacgagcgcgacuaccaguacgagacgagcuggggcugcaaccccuccgacugccccggggugggcacgggcugcaccaucugcggccuguaccuggaccagcucaaacccgucggcagcgccuacaagaucaucaccauccgguacucccgccgggugugcgugcaguucggggaagagaaccugugcaaggucaucgacaugaacgacugcuucgugagccgccacgugaaggucugcaucaucggcaccguguccaaguucagccagggggacacgcugcuguucuucggcccccuggagggcgggggccugaucuucaagcacuggugcaccuccacgugccaguucggggauccgggcgacaucaugagcccccgggacaagggguuccucugccccgaguuccccggcuccuuccgcaagaaaugcaacuucgccaccaccccggugugcgaguacgacgggaacauggucagcggcuacaaaaaggugauggccaccaucgacucauuucagagcuucaacaccuccaccaugcacuucacggacgagcggaucgaguggaaggaucccgacggcaugcuucgcgaccacaucaacauucuggugaccaaggacaucgacuucgacaaccucggggagaaccccugcaaaaucggccugcagaccagcuccaucgagggagcgugggggucuggggucggcuucacccugacgugccucaucucccugaccgagugccccaccuuccugaccagcauuaaggccugcgacaaggccaucugcuacggcgccgagagcgugacgcugacccgggggcagaacaccgugaaggucuccggcaagggcgggcacagcggguccaccuucaagugcugccacggcgaggacugcagccaguccggccugcacgcggccgccccgcaccuggacaaggugaacgggaucagcgagaucgagaacuccaagguguacgacgacggggcgccccagugcgggauaaagugcugguucgucaagagcggcgaguggaucuccggcaucuucuccgggaacuggaucgugcucaucguccuguguguguuccuccucuucucccuggugcugcucagcauccugugccccgucagaaagcacaagaaguccuga

SEQ ID NO: 15042 - RNA, 3408 nt, Artificial Sequence
  derived and/or modified CDS sequence (opt11) from HTNV(CGRni1)__EU363815.1__GP
augggcaucuggaaguggcuggugauggccagccucguauggcccgccuucgcccugcgcaaccuguacgacaugaagaucgagugcccacacaccguguccuucggggagaacagcgugaccggcuacguugagcucccgcccaugccccuugccgacacgacccagauggugcccgaguccagcuguuccauggacaaccaucagagccugaacaccaucacuaaguacacgcaaaucaucuggagagggaaggccgaccagucccagagcucccagaacagcuucgagaccguauccaccgaggucgaccucaaggguaccugcgugcugaagcacaaaaugaucgaggagagcuaccgcucccgcaagagcauaacgugcuacgaccuguccugcaacucuaccuacugcaaacccacccucuacaugaucgugcccauccacgcgugcaacaugaugaaguccugccugaucgcccucggacccuaccgcguccaagugguguacgagcggaccuacugcaugacgggcguccucaucgagggcaagugcuucgugccggaccagagcgugguguccauaaucaagcacgggaucuucgacauugccagcgugcacaucguguguuucuacgucgccguuaaggguaauaccuauaagaucuucgagcaggucaagaaaaccuucgagagcaacugcaaugacaccgagaacaagguccagggguacuacaucugcaucaucggcgggaacuccagucccguguacguaccgacgcuggacgacuuccggagcauggaggcauucagcggcaucauccggagcccccacggcgaggaccacgaccuugcgggggaggagguugcgucauacaguauuguugggccggccaacgccaaggucccccacucagccuccagugacacccucgggcugaucgccuacaguucgaucccaaguuauagcucccugagcauccucacauccagcaccgaggccaagcacguguucucccccgggcuguucccgcagcuaaaccauacgaaaugcgacaagaccgccaucccccucaccuggaccggcaugaucgaccugcccggguacuacgaggccauccaccccuguaccguguucugcgugcugagcggcccgggcgccaguugcgaggcauucuccgagggcgggaucuucaacaucgcgagccccaugugccucgucaguaagcaaaaccgguuccggcugaccgagcagcaggucaacuucgugugccagcgaguggauguggacaucaucgucuacugcaacggccaacggaaggugauccugaccaagacccuggugauuggccagugcaucuacacgaucaccagccuguucucccugcuccccggagucgcccacagcaucgccguggagcugugcgugcccggcuuccacgggugggccacggccgcccugcucgucaccuucugcuucggaugggugcugaucccggcuaucaccuucaucauccugacuauccucaaguucaucgccaacaucuuccacaccuccaaccaggagaaucgccucaagagcgugcugagaaagauaaaggaggaguucgagcgcaccaugggcuccauggucugcgacauaugcaaguacgagugcgagacguacaaggagcucaaggcccauggaguuaguugcccacagucccaaugucccuacugcuucacccacugugagcccaccgaggcugcguuccaggcccacuacaaggugugccaggucacccaccgcuuccgcgacgaccugaagaagaccgugacucggcagaacuucacccccggcugcuaccgcacacugaaccucuuccgguacaagagccgcugcuacaucuucaccauguggguauuccugaucguccuggagucgauccucugggccgccucugcguccgagaucccacuuaaccccguguggaacgacaacgcccauggugugggcagcaucccaaugcacacggaccuggagcucgacuuuucgcugacuagcagcuccaaguacacguaccggcgcaagcugaccaacccacuggaggagagccaggccaucgaccuccaugucgagauagaggagcagacgaucgggguggacguccacgcacuaggccacugguucgaugggcguuuaaaccucaagaccuccuuccacugcuacggcgccugcaccaaguacgaguaccccuggcacaccgcuaaaugccacuaugagcgggacuaccaguacgagacaagcuggggcugcaaccccuccgacuguccaggggucgguaccgggugcaccgccugcggucuguaccuagaccagcucaagcccgucggcagugccuacaaaaucaucaccauccgcuacucccggcgugugugcguccaguucggggaggagaaccugugcaagaucaucgacaugaacgacugcuucgugagccggcacgugaaggucuguaucaucgggacuguguccaaguucagccagggggacacccucuuguucuuugguccccuggagggcgggggccugaucuucaagcacuggugcaccagcacgugccaguucggggacccaggcgauaucaugucaccgcgggacaagggauuccucugccccgaguuccccggcuccuuccggaagaagugcaacuuugccaccacccccguaugcgaguacgacgggaacauggugagcggcuacaagaaagucauggccaccaucgacuccuuccagagcuucaacaccuccacgaugcacuucaccgacgagcgcauagaguggaaagacccggacggcaugcugcgggaccauauuaacauccuggucacaaaggacaucgacuucgacaaccucggggagaaucccugcaagaucggacugcagaccagcucuaucgaaggugcuuggggcagcggggucggguuuacacugaccugccucaucagccugaccgagugcucaaccuuccugacaucgaucaaggccugugauaaggccaucugcuacggcgcugagucggugacccucacucgcgggcagaacaccgugaaggucagcggcaagggcgggcacuccggaagcagcuucaagugcugccacggcgaggaauguagccagaucggccugcacgccgcggcgccgcaccuggauaaggugaacgggaucuccgagauggagaacagcaaaguguucgacgacggcgcgccccagugcgggaucaagugcugguucgucaaguccggggaguggaucagcgggaucuucuccgggaacuggauugugcucauuguacugugcgucuuccuccuguucagcuuagugcugcucuccaucuuaugcccgguccggaagcauaagaaguccuga

SEQ ID NO: 15043 - RNA, 3408 nt, Artificial Sequence
  derived and/or modified CDS sequence (opt11) from HTNV(Aa10-434)__KU207160.1__GP
augggcaucuggaaguggcuggugauggccagccuagucuggcccgugcugacccugagaaauguguacgacaugaagaucgagugcccgcacaccgucuccuucgggggcaacagcgugaucggguacguggagcucccgcccaugcccuuagccgacaccgcgcagcugguccccgaguccagcuguucaauggacaaccaccagucucucaacaccaucaccaaguacacccagguguccuggcggggcaaagccgaccagagccaguccagccagauuuccuucgaaacggugagcacugagguagaccugaaggggaccugcgugcugaaacacaagauggucgaggaguccuaccgcagccggaagucaauaaccugcuacgaccucagcugcaacaguacguacugcaagcccacacucuacaugaucguccccauccacgcuuguaacaugaugaaaagcugccugaucgcacucggccccuaccgcguucagguggucuacgagagaaccuacugcaugaccggcgugcugaucgagggcaagugcuucgugccugaccaguccgucguuagcaucaucaagcauggcaucuucgauaucgccagcgugcacaucgucugcuucuucguggcggugaaggguaacacguacaagaucuucgagcaggucaagaaguccuucgagagcacaugcaacgacaccgagaacaagguacagggcuacuacaucugcaucgucgggggcaauuccgcccccaucuacgugcccacccuggacgacuuccgcagcauggaggccuucacgggcaucuuccggagcccccacggggaggaccaugaccucgccggcgaggagaccgcgaccuacuccauuguggggccggcaaacgccaaggucccccacuccgcuagcuccgacacccugagccugaucgcguucuccgggauucccagcuacuccagccucuccauccugacuagcuccaccgaggcgaagcacguguucagcccaggccuguucccgaaacucaaccacaccaacugugacaagggcgccaucccccugauguggaccggcaugaucgaccugcccggguacuacgaggccauccaccccugcaccguguucugcguccucuccggcccgggggccagcugcgaggccuuuagcgagggcggcaucuucaacaucaccuccccgaugugccugguuagcaagcagaaccgcuuccggcugaccgagcaacaggugaacuucguaugccagcgcguggacguggacaucgugguguacugcaacgggcagcggaaggugauacucaccaagacccuggucaucggccagugcauauacacgaucaccucgcuguuuagccuccugcccgggguggcgcacuccaucgcuguggagcugugcguccccgguuuccacgggugggccaccgccgcacuccuggugacguucuguuucggcugggugcugaucccggcaaucaccuucaucauccucacaauccugaaguucauugccaacaucuuccauaccagcaaccaggagaaccgccugaaguccguccuccgaaagaucaaggaggaguucgagaagacgaagggcagcauggugugcgacaucugcaaguacgagugcgagaccuacaaggagcugaaagcccaugggguguccugcccccagagccagugccccuacugcuucacccacugcgagcccaccgaagccgccuuccaggcgcacuacaaggucugccaagugacccaccgcuuccgggacgaccugaagaagacggugacuccgcagaacuucacccccggcugcuaccgcacccuaaaccuguuccgguacaaguccaggugcuacaucuucacgauguggaucuuccugcucguccuggagagcauccugugggccgccuccgccagcgagacuccccucaccccgguguggaacgacaacgcgcacggggugggcaguguccccaugcacaccgaccuggagcuggacuuuagccugacguccagcagcaaguacaccuaucggcgcaaguugaccaacccccuggaggaggcccaguccauugaccugcacaucgaaaucgaggagcagaccaucgggguggacgugcaugcccucggccacugguucgauggccggcugaaccugaagaccagcuuccacugcuacggagcgugcaccaaguacgaauaccccuggcacaccgccaagugccacuacgagagggacuaccaguacgagaccuccuggggcugcaacccgagcgacugccccggugucggcacgggcugcaccgcgugcgggcucuaccuggaccgcuuaaagccugugggcuccgccuacaagaucaucacgauccguuacagccggcgggugugcguccaguucggggaggagaaccucugcaagaucaucgacaugaacgacugcuucguguccaggcacgugaaggugugcaucaucggcaccaucagcaaauucucccagggggacacccugcuguucuucggcccccucgagggagggggccucaucuucaagcacuggugcaccucaaccugccaguucggggaccccggcgauauuaugagcccccgggauaagggguuccugugccccgaguuccccggcuccuuccgcaagaagugcaacuucgccacgacgccgaucugcgaauacgacggcaacaugguguccggguacaagaaggugauggccaccaucgacagcuuccaguccuucaacaccagcaccaugcacuucacugacgagcguaucgaguggaaggaccccgacggcaugcuccgugaccacaucaacauccugguaaccaaggacaucgacuucgacaacuugggggagaaccccugcaagauaggcuuacaggccucgagcaucgagggggcguggggcuccggcgucggguucacacugaccugccuggugagccucacggagugccccaccuuccugaccagcaucaaggccugcgacaaggcuaucugcuacggcgccgaguccgucacccugacgcgggggcaaaacaccgugaaggugagcggcaagggaggccacuccggcagcacauucaagugcugccacggggaggacugcucccagaucggcuuacacgccgcugccccgcaccuggacaaggucaacgggaucagcgaaauggagaacuccaagguguacgacgacggcgcuccccagugcggcaucaagugcugguucgugaagucuggggaguggauauccggcaucuucagcgggaacuggaucguccugaucgugcucugugucuucuuacuguucucccucgugcugcugagcauccucugccccgugcgcaagcacaagaaguccuaa

SEQ ID NO: 15044 - RNA, 3408 nt, Artificial Sequence
  derived and/or modified CDS sequence (opt11) from HTNV(Aa10-518)__KU207161.1__GP
augggcaucuggaaguggcuggugauggccagccucgucuggcccguucugacccugcguaacguguacgacaugaagaucgagugcccgcacaccgucucauucggggagaacucugugaucggcuacguggagcucccgcccaugccccuggccgacacggcccagcugguccccgaguccagcugcuccauggacaaccaccagagccucaacaccaucaccaaguacacccagguguccuggcgggggaaggccgaccagagccaguccucccagaacuccuucgagacggugagcaccgagguugaccugaaggguaccugcgugcugaagcacaagaugguggaggaguccuaccgcagccggaaguccauuaccugcuacgaccucagcugcaacuccacguacugcaagcccacccuguacaugaucguccccauccacgccugcaacaugaugaaguccugccugaucgcccucgggcccuaccgcguccaggugguguacgagcggaccuacugcaugaccggcguguugaucgagggcaagugcuucgugccggaccaguccgucgucucgaucaucaagcacgguaucuucgacaucgccagcgugcacaucgucugcuucuucguagcggugaagggcaacacguacaagaucuucgagcaggucaaaaaguccuucgagagcacgugcaacgacaccaagaacaaggugcagggguacuacaucugcaucgucggcgggaacuccgcccccaucuacgugcccacccuggacgacuuccguagcauggaggccuucaccggcaucuuccgcagcccccacggcgaggaccacgaccucgccggggaggagaccgcgaccuacagcaucgugggcccggccaacgccaaggucccccacuccgccagcuccgacacccugagccugaucgccuucuccgggaucccuagcuacuccagccucuccauccugacuagcuccacagaggcgaagcacguguucagccccggccuguucccgaagcucaaccacaccaacugcgacaagggcgccaucccccugauguggaccgggaugaucgaccugcccggcuacuacgaggccauccaccccugcacgguguucugcgucuuguccgggccgggcgccagcugugaggccuucuccgagggcgggaucuucaauaucaccucccccaugugccuggugagcaagcagaaccgcuuccggcugaccgagcagcaggucaacuucgugugucagcgcguggacguggacaucgucguguacugcaacggccagcggaaggugauccucaccaagacgcuggucaucggacagugcaucuacaccaucaccagucuguucagccuccugcccggcguagcgcacuccaucgccguggagcugugcguccccggguuccacggcugggccaccgccgcccuccuggugacguucugcuucgggugggugcugaucccggcgaucaccuucaucauccucaccauccugaaauucaucgcaaacaucuuccacaccagcaaccaggagaaccgccugaaguccguccuccggaagauaaaggaggaguucgagaagacgaagggcagcauggugugcgacaucugcaaguacgagugcgagaccuacaaggagcugaaagcccacggaguguccugcccccagagccagugccccuauugcuucacccacugcgagcccaccgaggccgccuuccaggcacacuacaaggucugccaggugacccaucgcuuccgggacgaccugaagaagacggugaccccacagaacuucacccccgggugcuaccgcacccucaaccuguuccgguacaagucccgcugcuacaucuucacgauguggaucuuccugcucguccuggagagcauccugugggccgccuccgccuccgagaccccucucaccccgguguggaacgacaacgcgcacggugugggguccguccccaugcacaccgaccuggagcuggacuucagccugacguccagcagcaaguacaccuaccggcgcaagcucaccaacccccuggaggaggcccaguccauagaccugcacauagagaucgaggagcagaccaucggcguggacgugcacgcccucggucacugguucgacggccggcugaaccugaagacgagcuuccacugcuacggcgccugcaccaaguacgaguaccccuggcacaccgccaagugccacuacgagcgcgacuaccaguacgagaccuccuggggguguaauccgagcgacugccccggcgucgggacgggcugcacugcgugcggccucuaccuggaccgccugaagcccgucgguuccgccuauaagauaauaaccauccgguacagccgccgggucugcguccaguucggcgaggagaaccucugcaagaucguggacaugaacgacugcuucgugucccgccacgucaaggugugcaucaucgggaccgucagcaaguucucccagggcgacacgcugcuguucuucgggccccucgagggcggcgggcugauuuucaagcacuggugcaccucgaccugccaguucggcgacccgggggacaucaugagcccccgggacaagggcuuccugugccccgaguuccccgggagcuuucgcaagaagugcaacuucgccaccacgccgaucugcgaguacgacggcaauauggucuccggcuacaagaaggugauggccaccaucgacagcuuccaguccuucaacaccagcacaaugcacuucacggacgagcggaucgaguggaaggaccccgacgggaugcuccgcgaccacaucaacauccuggugaccaaagacaucgauuucgacaaccugggcgagaaccccugcaagaucgggcuacagaccuccagcaucgagggcgccuggggguccggcgucggcuucacccugacgugccuggugagccucaccgagugccccaccuuccugaccagcaucaaggcgugcgacaaggccaucugcuacggggccgagucagugacgcugacccggggccagaacaccgucaaggugagcgggaagggcgggcacuccggcagcaccuucaagugcugccacggggaggacuguucccagaucgggcuccacgccgccgcgccgcaccuggacaaggugaacggcaucagcgagauggagaacuccaaggucuacgacgauggggcgccccaguguggcaucaagugcugguucgugaaguccggcgaguggaucuccgggaucuucagcggcaacuggaucguccugaucgugcucugcguguuccuucuuuucucccucguccugcugagcauccucugccccgugcgcaagcacaaaaaguccuga

SEQ ID NO: 15045 - RNA, 3408 nt, Artificial Sequence
  derived and/or modified CDS sequence (opt11) from HTNV(Aa13_3)__KX687227.1__GP
augggcaucuggaaguggcuggugauggccucccucgucuggcccgugcugacccugcgcaacguguacgacaugaagaucgagugcccgcacaccgucuccuucggggagaacagcgugaucggcuacguggagcucccgcccaugccccuggucgacacggugcaguuggugcccgaguccuccugcuccauggacaaccaccagagccucaacaccaucaccaaguacacccaggucuccuggcgggggaaggccgaccagagccaguccagccagaacuccuucgagacggugagcaccgagguggaccugaaggggaccugcguccugaagcacaagaugguggaggaguccuaccgaagcagaaaguccaucacuugcuacgaccucagcugcaacuccaccuacugcaagcccacccuguacaugaucgugcccauccacgccugcaauaugaugaaguccugccugaucgcccucgggcccuaccguguccaggugguguacgagcggaccuacugcaugaccggcguccugaucgagggcaagugcuucgucccggaccaaagcguggucagcaucaucaagcacgggaucuucgacaucgccagcguucacaucgugugcuucuucgucgccguaaagggcaacacguacaaaaucuucgagcaggucaagaaguccuucgagagcacgugcaacgacaccgagaacaaggugcagggguacuacaucugcaucgugggcggaaacuccgcucccaucuacguccccacccuggacgauuuccgcagcauggaggcguucaccggcaucuuccggagcccccacggcgaggaccacgaccucgccggggaggagaccgccaccuacagcaucgugggcccggccaacgcgaaggugccccacuccgccagcuccgacacccugagccugaucgccuucucugggauccccagcuacucaagccucuccauccuaacgagcuccaccgaggccaagcacgucuucagccccggccuguucccgaagcucaaccacaccaacugcgacaagggcgccaucccccugauguggaccgggaugaucgaccugccaggcuacuacgaggcgauccaccccugcacgguguucugcgugcucuccgggccgggcgccagcugcgaggccuucagcgagggcggcaucuucaacaucaccucccccaugugucuggucagcaagcagaaccgcuuccggcugaccgagcagcaggucaacuucgucugccagcgcguggacguggacaucguggucuacugcaacggccagcggaaggugauacucaccaagacgcuggugaucgggcagugcaucuacaccaucaccucucuguucagccuccugcccggcgucgcccacuccaucgccguggagcugugcgugcccggguuccacggcugggcgaccgccgcccuccuggucacguucugcuucggguggguacugaucccggccaucaccuucaucauccucaccauccugaaguucaucgccaauaucuuccacacgagcaaccaggagaaccgcuugaaguccgugcuccggaagaucaaggaggaguucgagaagacgaagggcucgauggucugcgacaucugcaaguacgagugcgagaccuacaaggagcugaaggcgcacggcgucuccugcccccagagccagugccccuacugcuucacccacugcgagcccaccgaggccgccuuccaggcccacuacaagguaugccaggucacccaccgcuuccgggacgaccugaagaagacggugaccccgcagaauuucacccccggguguuaccgcacgcucaaccuguuccgguacaagucccgcugcuacaucuucacgauguggaucuuccugcucgugcuggagucuaucuuaugggccgccucugccagcgagacgccccucaccccggucuggaacgacaacgcccacggcgugggguccgugcccaugcacacugaccuggagcuggacuucucacugaccuccagcagcaaguacaccuacaggcgcaagcucaccaacccccuggaggaggcccagucaaucgaccugcacaucgagauugaggagcagaccaucggcgucgacgugcacgcgcucgggcacugguucgacggccggcugaaccugaagacgagcuuccacugcuacggcgccugcaccaaauacgaauaccccuggcacaccgccaagugccacuacgagcgcgacuaccaguaugagaccuccugggggugcaacccgagcgacugccccggcguggggacgggcuguaccgcuugcggccucuaccuggaccgccugaagcccgucggguccgccuacaagaucauuaccauccgguacagccgccggguaugcgugcaguucggcgaggagaaccucugcaagaucaucgacaugaacgacugcuucgucucccgccacgugaagguguguaucaucgggaccguuagcaaguucucccagggcgacacgcugcuguucuucgggccccucgagggcggcgggcugaucuucaagcacuggugcaccagcacgugccaguucggcgacccaggggauaucaugagcccccgggacaagggcuuccugugccccgaguuccccggguccuuccgcaagaagugcaacuucgcgaccaccccgaucugcgaguacgacggcaacaugguguccggcuacaagaaggugauggccaccauagacagcuuccaguccuucaacaccagcaccaugcacuucacggacgagaggaucgaguggaaggaccccgaugggaugcuccgcgaccacaucaacauccuggucaccaaggacaucgacuucgacaaccugggcgagaaccccuguaagaucgggcuccagaccuccagcaucgagggcgcauggggguccggcgugggcuucacccugacuugccuggugagccucaccgagugccccaccuuccugaccagcaucaaggccugcgacaaggccaucugcuacggggcggaguccgucacgcugacccguggccagaacaccgugaaggugagcgggaagggcgggcacuccggcagcaccuucaagugcugccacggcgaggacugcucccagaucgggcuccacgccgccgccccgcaccuggacaaggucaacggcaucucagagauggagaacuccaagguguacgacgacggggcgccccagugcggcauaaagugcugguucgucaagagcggcgaguggaucuccggaaucuucagcggcaauuggaucguccugaucgugcucugcgucuuccuccuguucucccucgugcugcugagcauccucugccccgugcgcaagcauaagaaguccuga

SEQ ID NO: 15046 - RNA, 3408 nt, Artificial Sequence
  derived and/or modified CDS sequence (opt11) from HTNV(Aa14_186)__KX687228.1__GP
augggcaucuggaaauggcuggugauggccagccucgucuggcccguacuuacccugcgcaacguguacgacaugaagaucgagugcccgcacaccgucuccuucggggagaacagcgugaucggcuacguggagcucccuccgaugccccuggccgacacggcccagcuggucccagaauccagcugcuccauggauaaccaccagagcuuaaacacgaucaccaaguacacucaaguuuccuggcgggggaaggccgaccagucccaguccagccaaaauuccuucgagacggugagcaccgaggucgaccugaagggcacaugcgugcugaagcacaagaugaucgaggaguccuaccgcucccggaaaagcauaaccugcuacgaccucagcugcaacaacacguacugcaagcccacccuguacaugaucguucccauccaugccuguaacaugaugaaguccugccuaaucgcccucgggcccuaccgcguccaggugguguacgagcgaaccuacugcaugaccgguguccugaucgagggcaaaugcuucgugccggaccagagcguuguuuccaucaucaaacaugggaucuucgacaucgccagcgugcacaucgucugcuucuucgucgcggugaagggcaacacguauaaaaucuucgaacaggugaagaaguccuucgaauccacgugcaacgacaccgagaacaagguucagggguacuacauuugcaucgugggcgggaacagcgcccccaucuauguccccacccucgacgacuuccgcuccauggaggccuucaccggcaucuuccggagcccccacggcgaggaccacgaucuugccggggaggagaccgcgaccuacuccaucgugggcccggccaacgcuaagguaccccacagcgccuccagcgacacauuaucccugauugccuucagcgggauacccuccuacagcucccucagcauccugacguccagcacugaggcgaagcacgucuuuucucccggccuguucccgaagcucaaccacaccaacugcgacaagggcgccaucccucugauguggaccgggaugaucgaccugccuggcuacuacgaggccauccaccccugcacgguguucugcguacucucagggccgggcgccuccugcgaggccuucagcgaagggggcaucuucaacaucacaagccccaugugccuagucuccaagcagaaccgcuuccggcugacugagcaacaggugaacuucgugugccagcgcgucgauguggacaucguggucuauugcaacggucagcggaaggugauccucaccaagacucuggugaucggacagugcauauacaccaucaccucauuguucucccuucugcccggcgucgcgcacagcaucgccguggagcugugcguucccggguuccacggcugggccaccgccgcccuccuggucacguucugcuucgggugggugcugaucccggcgaucaccuucaucauccugaccaucuuaaaguuuaucgccaacaucuuccacaccuccaaucaggagaaccgccugaagucagugcuccguaagaucaaggaggaguucgagaagacgaaaggcagcauggugugugacaucugcaaguacgagugcgagaccuacaaggagcugaaggcccacggcgugagcugcccccagucacagugccccuacugcuucacacacugcgagcccaccgaggccgccuuccaagcgcauuacaaagugugccaggucacccaccgcuuccgggacgaccugaagaagacggugaccccacagaauuuuacucccgggugcuaccgcacccuuaaccuguuucgguacaagagccgcugcuauaucuucacgauguggauuuuucugcucguacuggaguccauccugugggcggccagcgccuccgaaacgccccucaccccggucuggaacgacaacgcgcacggcguggggagcgugcccaugcacaccgaccuggagcuggacuucucccugaccagcuccucuaaguauacuuaccggcgcaagcucaccaacccccuggaagaagcacagucuaucgaccugcacaucgagaucgaggagcagaccaucggcgucgaugugcacgcccucgggcacugguucgacggacggcugaaccugaagacguccuuccacugcuacggcgcgugcacgaaguacgaauacccguggcacaccgccaagugccacuacgagagggacuaccaauacgagaccuccuggggcugcaacccguccgacugccccggcguggggacgggcugcacggcgugcggccucuaccuagaccgccugaagcccgucgguagcgcuuacaagaucaucaccauccgguacucccgccggguuugcgugcaguucggcgaggagaaccucugcaagauaaucgacaugaacgacugcuucgucagccgccacgugaagguguguaucaucgggaccgucucaaaguuuagccagggcgauacccugcuguucuucgggccccuagaaggcggcgggcugaucuuuaagcauuggugcaccucuaccugccaguuuggcgacccgggggacaucaugagcccccgggacaagggcuuccugugucccgaguuccccggguccuuccgcaagaagugcaauuucgccacgacaccgauuugcgaauacgacggcaacaugguuuccggcuacaagaaggugauggccaccauugacuccuuccagagcuucaacacauccaccaugcauuucacggacgagcggaucgaguggaaggaccccgacgggaugcuccgcgaccauaucaacauccuagucaccaaagacaucgacuucgacaaccugggcgagaacccuugcaagaucggacuacagaccucuagcaucgagggugccuggggcagcggcgugggguucacccugaccugccuggugucccucaccgagugccccaccuuccugacaaguaucaaggcuugcgacaaggccaucugcuacggugccgaguccgucacgcugacccgaggccagaacaccgugaagguguccggaaagggcgggcacagcggcuccaccuucaagugcugccacggcgaggacugcagccagauugggcuccacgccgccgcgccgcaccucgacaaagucaacggcauaagugaaguggagaacucuaagguguacgacgacggggcgccccagugcggcaucaagugcugguucguuaaguccggagaguggaucagcgggaucuucuccgggaacuggaucgugcugaucguccucugcgucuuucugcuguucagccucgugcugcuuuccauucucugccccguccgcaagcacaagaaaagcuga

SEQ ID NO: 15047 - RNA, 3408 nt, Artificial Sequence
  derived and/or modified CDS sequence (opt11) from HTNV(Aa14_234)__KX687230.1__GP
augggcaucuggaaguggcuagugauggccagccuugucuggcccgugcugacccugcgcaacgucuaugacaugaagaucgaaugcccgcacaccgucuccuucggugagaacagcgugaucggcuacguggaauugcccccgaugccccuggccgacaccgcgcaguuggucccggaguccaguugcagcauggacaaccaccagagcuuaaauaccaucacaaaguacacccaaguguccuggcgggggaaggccgaccagagccagucgagccagacguccuucgagaccgugagcaccgaggucgaccuuaaggggaccugcgugcugaaacacaaaauggucgaggagaguuaccgcagccgcaaauccaucacaugcuaugacuuaagcugcaacagcaccuacugcaagcccacccuguacaugaucguccccauccacgccuguaacaugaugaagucaugccugaucgcucucggccccuaccgcguucaggugguuuacgagcggaccuacugcaugacgggcgugcugaucgagggcaagugcuucguuccugaccaguccguaguuucgaucaucaagcacgggaucuucgacaucgccagcgugcauaucguaugcuuuuucguggcggucaagggaaacaccuacaagaucuucgagcaggucaagaaguccuuugaguccaccuguaacgacaccgagaacaaggugcagggguacuacauuugcaucgucggcgggaacagcgcgcccauuuacgugcccacgcuugacgacuuccgcagcauggaggccuucaccggcauauucagaagcccgcauggcgaagaccacgaucucgccggggaggagaccgcuaccuacagcaucguggguccggccaacgccaaggucccccauuccgccagcuccgacacucugagccugaucgccuucuccgggauccccagcuauuccagccucuccauccugaccagcuccaccgaagcuaagcacguguucagccccggacuuuucccgaaacugaaccacaccuccugcgacaagggggccauaccccugauguggacggggaugaucgaccugcccggcuacuacgaagccauccacccgugcaccguguucugcguacucucgggcccgggagccagcugcgaggccuucuccgaagggggcaucuucaacauaaccagccccaugugccuaguguccaaacagaaccgcuuccgacugaccgagcaacaggugaacuucgugugccagcgcguggacguggauaucgucguguacugcaauggccagcgaaaggugauccucacgaagacccuggugauugggcaguguauuuacaccaucaccagccuuuucucccuccugcccggcguggcgcauagcaucgccgucgaacugugcguccccggguuccacggcugggccacggccgcccuccucgugaccuucugcuucgggugggugcugaucccggcgauuaccuucauuauccucacuguccuuaaguucaucgccaacaucuuccacacguccaaccaggagaaccgccucaagagcgugcuccggaagaucaaggaggaguucgaaaagacaaagggcuccauggugugcgacaucugcaaguacgagugugagaccuacaaggagcugaaggcucacggcgucagcugcccgcagucccagugccccuacugcuucacccacugcgagcccaccgaggccgccuuccaggcgcacuauaaggugugccaggugacgcaucgcuuccgggacgaccucaagaagacugucaccccgcagaacuucacccccgggugcuaccgcacucucaacuuguuccgguacaagagccgcugcuauaucuucaccauguggauauuccugcucgugcuggaguccauuuuaugggccgccagcgccuccgaaacgccccucaccccgguauggaacgacaacgcccacggcguggggagcguuccaaugcacaccgaccuugagcuggacuucucccugaccagcagcuccaaguacaccuaccggcgcaaacucacgaauccccuggaggaggcccagagcauagaccugcacauagagauagacgagcagacuauaggcguggacguccacgcccucgggcacugguucgacggccggcugaaccugaagaccucauuccacugcuauggcgccugcaccaaguacgaguaccccuggcacaccgccaagugucacuacgagcgcgacuaccaguaugagacgagcuggggaugcaacccguccgauugccccggcguagggaccggaugcaccgccugcggccucuaccuggaccgacugaagccagugggguccgccuacaagaucaucaccauccgguacucucgccgggucugugugcaguucggcgaggagaaucucugcaagaucaucgacaugaaugacugcuucgugagccgccacgucaaggugugcaucaucgggacgguguccaaguucagccagggugacacccuacuguucuucgggccccucgagggcggcggacugauauucaagcauuggugcaccuccacgugccaguucggcgaccccggagacaucaugagcccccgggacaagggauuccugugccccgaguuccccggguccuuccgcaagaagugcaacuucgcuaccaccccgaucugcgaguacgacggcaacauggucagcggcuacaagaaggugauggcgacgaucgacuccuuccagagcuucaacaccuccacgaugcacuuuaccgaugagcggaucgaauggaaggacccggacgggaugcuccgagaccacaucaacauccuggugaccaaggacaucgacuucgacaaccugggcgagaaccccugcaagaucgggcuccagaccagcucaaucgagggcgccugggggagcggcgucggcuucacgcugaccugccuggugagccucaccgagugccccaccuuccugacguccaucaaggcgugcgacaaggccauaugcuacggggccgaaagcgugacccugaccagaggacagaacaccguuaagguguccgggaaaggcgggcacagcggcuccaccuuuaagugcugccauggcgaggacugcagccaaaucgggcuccacgcggccgcgccgcacuuagacaaagugaacgggauuuccgagauggagaacagcaaaguguaugacgacggggcaccccaguguggcaucaagugcugguucgugaaguccggcgaguggaucagcgggaucuucuccggcaacuggaucguccugaucguauuaugcguauuccuacucuucagccucguccuguuauccauacucugcccagugcgcaagcacaaaaagagcuga

SEQ ID NO: 15048 - RNA, 3408 nt, Artificial Sequence
  derived and/or modified CDS sequence (opt11) from HTNV(Aa14_239)__KX687231.1__GP
augggcaucuggaaguggcuggugauggccagccucgucuggcccgugcugacccugcgcaacguguacgacaugaagaucgagugcccgcacaccgucuccuucggggagaacagcgugaucggcuacguggagcucccgcccaugccccuggccgauacggcgcagcugguccccgaguccagcugcuccauggacaaccaccagagccuaaauaccaucaccaaguacacccagguguccuggcgcgggaaggccgaccagagucaguccagccagaacuccuucgagacggugagcaccgagguggaccugaaggggaccugcgugcugaagcacaagaugguggaggaguccuaccgcucacggaaguccauuaccugcuacgaccucagcugcaacucaacguacugcaagcccacccuguacaugaucguccccauccacgccugcaacaugaugaaaagcugccugaucgcccucgggcccuaccgcguccaggugguguacgagcgcaccuacugcaugaccggcgugcuaaucgagggcaagugcuucgugccggaccaguccgucgugagcaucaucaagcaugggaucuucgacaucgccagcgugcauaucgucugcuucuucguggcggucaagggcaacacguacaagaucuucgagcaggucaagaaguccuucgagagcacgugcaacgacaccgagaacaaggugcagggauacuacauuugcaucgucggcgggaacuccgcgcccaucuacgugcccacccuggacgacuuccgcagcauggaggccuucaccggcaucuuccgguccccgcacggcgaggaccacgaccucgccggggaggagaccgcgaccuacagcaucgugggccccgccaacgccaaggucccccauuccgccagcuccgacacccugagccugaucgcuuucuccgggauccccagcuacuccagccucuccauccugacgagcaguaccgaggcuaagcacguguucagccccggccuguucccgaagcucaaccacaccaacugcgacaagggcgccaucccccugauguggaccgggaugaucgaccuacccggcuacuacgaggccauccaccccugcacgguguucugcguccucuccggcccgggcgccagcugcgaggccuucagcgagggcggcaucuucaauaucaccucccccaugugccuggugagcaagcagaaccgcuuccggcugaccgagcaacaggugaacuucgucugccagcgcguggacguggacaucgucguguacugcaacggccagcggaagguuauccucaccaagacgcuagucaucgggcagugcaucuacaccaucaccucccuguucagccuccugcccggcguggcgcacuccaucgcaguggagcugugcguccccggcuuccacggcugggccaccgccgcccuccuggugacguucugcuucgggugggugcugaucccggcgaucaccuucaucauccucacaguccugaaguucaucgccaacaucuuccacaccagcaaccaggagaaccgccugaagucugugcuccggaagaucaaggaggaguucgagaagacgaagggcagcauggugugcgacaucugcaaguacgagugcgagaccuacaaggaguuaaaggcccacggcgucuccugcccccagagccagugccccuacugcuucacccacugcgagcccaccgaggccgccuuccaggcgcacuacaagguuugccaggugacccaccgcuuccgggacgaccugaagaagacggucaccccgcagaacuucacccccgggugcuaccgcacccucaaccuguuccgguacaagucccgcugcuacaucuucacgauguggaucuuccugcucgugcuggagagcauacugugggccgccucagccagcgagacgccccucaccccgguguggaaugacaaugcgcacggcgucggguccgugccgaugcacaccgaccuggagcuggacuuuagccuaaccuccagcagcaaguacaccuaccggcgcaagcuaaccaacccccuggaggaggcccaguccaucgaccugcauaucgagaucgacgagcagaccaucggcguggacguccacgcccucgggcacugguuugacggccggcuaaaccugaaaacgagcuuccacugcuacggcgccugcaccaaguacgaguaccccuggcacaccgccaagugccacuaugagagagacuaccaguacgagaccuccugggggugcaacccgagcgacugccccggcguggggacaggcuguaccgcgugcggccucuaccuggaccgccugaaacccguggggucagccuacaagaucaucaccauccgguacagccgccgggucugcgugcaguucggcgaggagaaccucuguaagaucaucgacaugaacgacuguuucgugucccgccacgucaaggugugcaucaucgggaccgugagcaaguucucccagggcgacacgcugcuguucuucgggccccucgagggcggcgggcugaucuucaagcacuggugcaccucgaccugccaguucggggacccgggggauaucaugagcccccgggauaagggcuuccugugccccgaguuccccgggagcuuccgcaagaagugcaacuucgccaccacgccgaucugcgaguacgacggcaacauggucuccggcuacaagaaggugauggccacaaucgacagcuuccaguccuucaacaccagcaccaugcacuucaccgaugagcggaucgaguggaaggaccccgacgggaugcuccgcgaccacaucaacauccucguuaccaaggacaucgacuucgacaaccugggcgagaaccccugcaagaucgggcuccagaccuccagcaucgagggcgccuggggguccggcgucggcuucacgcugacgugccuugugagccucaccgagugccccaccuuccugaccagcaucaaggcgugcgacaaggccaucugcuacggggccgaguccgugacgcugacccgaggccagaacaccgucaaagugagcgggaagggcgggcacuccggcagcaccuucaagugcugccacggcgaggacugcucccaaaucgggcuccacgccgccgcgccgcaccuggacaaggugaacggcaucagcgagauggagaacuccaaggucuacgacgacggggcgccccagugcggcaucaagugcugguucgucaagagcggcgaguggaucuccgggaucuucagcggcaacuggaucgugcugaucgugcucugcguguuccugcuguucuccuugguccugcugagcauccucugccccgugcgcaagcacaagaaguccuga

SEQ ID NO: 15049 - RNA, 3408 nt, Artificial Sequence; identical to SEQ ID NO: 11763
  derived and/or modified CDS sequence (opt11) from HTNV(Aa14-172)__KU207162.1__GP

SEQ ID NO: 15050 - RNA, 3408 nt, Artificial Sequence; identical to SEQ ID NO: 11764
  derived and/or modified CDS sequence (opt11) from HTNV(Aa14-175)__KU207163.1__GP

SEQ ID NO: 15051 - RNA, 3408 nt, Artificial Sequence
  derived and/or modified CDS sequence (opt11) from HTNV(Aa14-184)__KU207164.1__GP
augggcaucuggaaauggcuggugauggccagccucgucuggcccgugcugacccugcgcaacgucuacgauaugaagaucgaaugcccgcacaccguguccuucggggagaacagcguaauaggcuacguggagcucccgcccaugccccuggccgacacggcgcagcugguccccgaguccagcuguuccauggacaaucaccagagccucaacacaaucaccaaguacacucagguguccuggcgggggaaagccgaccaaagccaguccagccagaacucuuucgagacggugaguaccgaggucgaccugaaggggaccugcgugcugaagcacaagaugaucgaggaauccuaucgaagccggaaauccauuaccugcuaugaccucagcugcaacaacacguacugcaagcccacccuguacaugaucguuccaauccaugccugcaacaugaugaaguccugccugaucgcccucgggcccuaccgcguccaagucguuuacgagcggaccuacugcaugacuggcguccugaucgaggggaagugcuucguuccggaccagagcguagucuccaucaucaagcacgggaucuucgacaucgcaagcgugcauauagugugcuucuucgucgcggugaaggguaacacguacaaaaucuucgaacaggugaagaagucauucgaguccaccuguaacgacaccgagaacaagguacagggguacuacaucugcaucgucggagggaacucggcccccaucuacguccccacccuggacgauuuccgcagcauggaggccuucacgggcaucuuccgguccccgcauggcgaggaccacgaccucgccggggaggagaccgcgacauacucuaucgugggcccggccaacgccaaggugccccacagcgccuccagcgacacccugucccugaucgccuucagugguauacccuccuacagcucccucagcauacugacguccagcaccgaggcgaagcacguguucucgcccggucuguucccgaagcucaaccacacgaacugcgacaagggcgccaucccccugauguggaccgggaugaucgaccugcccggcuacuacgaagccauccacccgugcacgguguuuugcgugcucagcggcccgggcgccaguugcgaggccuuuagcgagggcggcaucuucaauaucacgagccccaugugccugguguccaagcagaaccgcuuccggcugaccgagcaacaggucaacuucguaugccagcgcguggacguggacaucguggucuacugcaacgggcagcggaaggugauccucaccaagacgcuggugauugggcaguguaucuacaccaucaccagccuguucucgcuacugccgggggucgcccauagcauugccguugagcugugcguacccggguuccauggcugggccaccgccgcccuccuggucaccuucuguuucgggugggugcugaucccggcgaucaccuuuaucauccucaccauuuuaaaguucaucgcaaacaucuuccacaccuccaaccaagaaaaucgccugaagucgguucugcggaagaucaaagaggaguucgaaaagacgaagggcuccauggucugcgacguaugcaaguacgagugcgagaccuacaaagagcuuaaggcgcauggcgugagcugcccccagucccaaugcccguacugcuucacccacugcgagcccaccgaggccgccuuccaggcgcacuacaaggucugccaggugacccaccgcuuccgggacgaccucaagaaaacagugaccccucagaacuucacccccggaugcuaccgcacucucaaccuuuuccgguacaaaagccgaugcuacaucuucacgauguggaucuuucugcucguuuuggagagcauccuaugggccgccagcgccuccgagacaccccucaccccuguguggaacgacaacgcgcacggcguggggagcgugcccaugcacaccgaccuugagcuugacuucucccugacuagcuccaguaaguacaccuaccggcgcaagcucaccaacccacuggaggaagcccagucaaucgacuuacauaucgagaucgaggagcagacaauaggcguggacgugcacgcgcucgggcacugguucgacggccggcugaaccugaaaacguccuuccacugcuacggcgccugcaccaaguacgaguaccccuggcauaccgccaaaugccacuacgagcgggacuaccaguacgagacaucuugggggugcaacccgucggauugccccggugucggaaccggcugcaccgcgugcggacucuaccuggaccgccugaagcccguugggucggccuauaagauaaucaccauccgguacucccgccgugugugcguccaauucggcgaggagaaccucugcaagaucauagacaugaacgacugcuucgugagucgccaugugaaaguaugcauaaucgggacaguguccaaguucagccagggcgacacgcugcuguucuucgggcccuuagagggaggcgggcugaucuuuaaacacuggugcacauccaccugucaguucggcgacccgggggacaucaugagccccagagacaagggcuuccugugcccugaguucccggggagcuuccgcaagaaguguaacuucgccacgacgccuaucugcgaguacgacggcaacauggugagcggguacaagaaggucauggcgaccaucgacuccuuccagagcuucaacaccuccaccaugcacuuuaccgacgagcgcaucgaguggaaagacccagacgggaugcuccgcgaccauauaaacauccucguaaccaaggacauagacuucgacaaccugggcgagaacccgugcaagaucggacuccagaccagcuccaucgagggcgccugggggagcggcgugggcuucacccugacgugccuagucucccucacugagugccccacauuccugacgagcauaaaggcgugcgauaaggccauuugcuacggagcugagagcguaacgcugacgagaggacagaacaccgugaaagucuccgggaagggcgggcacagcggcucgaccuucaaguguugccauggcgaggacugcucgcagaucgggcuccacgcugccgcgccgcacuuggacaaggugaacggcaucuccgagguggagaauagcaaggucuaugacgacggggcuccccagugcggcaucaaaugcugguucgugaaguccggcgaguggaucagcgggaucuucuccggcaacuggaucguccugaucgugcucugcguauuccuccuguucagccucguccugcuguccauccugugccccgugcgcaaacauaagaaguccuga

SEQ ID NO: 15052 - RNA, 3408 nt, Artificial Sequence
  derived and/or modified CDS sequence (opt11) from HTNV(LR1)__AF288293.1__GP
augggcaucuggaaguggcuggugauggccagccucgucuggccagugcugacgcugcgcaacguguacgacaugaagaucgagugcccgcacaccgucuccuucgggggcaacagcgugauuggguacguggagcucccgcccgucccccuggccgacacggcgcagauggugcccgaguccagcugcuccauggacaaccaccagagccugaacaccaucaccaaguacacccagguguccuggcggggcaaggccgaccagagccaguccagccagaacuccuucgagacggucagcaccgagguugaccucaaggggaccugcgugcugaagcacaagauggucgaggaguccuaccgcagccggaaguccgugaccugcuacgaccugagcugcaacuccacguacugcaagcccacccucuacaugaucgugcccauccacgccugcaacaugaugaaguccugccugaucgcccugggccccuaccgcguccaggugguguacgagcggaccuauugcaugaccggcgugcucaucgaggggaagugcuucgugccggaccaguccguggucagcaucauuaagcauggcauauucgacaucgccagcgugcacaucgugugcuuuuucgucgcggugaaggggaacacguacaagaucuucgaacaggugaagaaguccuucgagagcacgugcaacgacaccgagaacaaggugcagggcuacuacaucugcaucgucgggggcaacuccgcccccaucuacgugcccacccuggacgacuuccgcagcauggaggccuucaccggcaucuuccggagcccccacggggaggaccgcgaccuggccggcgaggagaucgcgagcuacuccaucgugggaccggccaacgccaaggucccccauagcgccuccagcgacacccuccgacugaucgcauacuccggcauccccagcuacuccagccuguccauccucaccagcuccaccgaggcgaagcacgucuucucgcccggccuguucccgaagcugaaccacacgaacugcgacaaauccgccaucccccuuaucuggaccgggaugaucgaccugcccggcuacuacgaggccgugcaccccugcaccguguucugcguccugagcgggccgggcgccagcugugaggccuucucggagggcgggaucuucaacaucaccagcuccaugugccucgugagcaagcagaaccgcuuccggcucacggagcagcaggucaacuucgugugccagcgcguggacauggacaucguggucuacugcaacggccagcggaaggugauccugacuaagacccucgugaucgggcagugcaucuacaccaucacgucccuuuucagccugcuccccggcgucgcgcacuccaucgccguggagcugugcgugcccggguuccacggcugggcaaccgccgcccugcucguuaccuuccgcuucgggugggugcugauccccgcuaucaccuucaucauccugacggugcucaaguucaucgccaacaucuuccacaccagcaaccaggagaaccggcugaaguccguccugcgcaagaucaaggaggaauuugagaagaccaagggcagcauggugugcgacgugugcaaguacgaaugcgagaccuacaaggagcucaaggcccacggcgucuccugcccgcaaagccagugccccuacugcuucacgcacugcgagcccaccgaggccgccuuccaggcgcacuacaaggugugccaggugacccaccgguuccgcgacggucugaagaagaccgucacgccccagaacuucaccccgggcugcuaucggacccugaaccucuuccgcuauaagucccggugcuacaucuucaccauguggaucuuccugcuggugcucgagagcauccugugggccgccuccgccagcgagacgccccugacccccguguggaacgacaacgcgcacggcgucggcucggugccgaugcacaccgaccucgagcuggacuucagccugaccaguuccucaaaguacaccuaccgccgcaagcugacgaacccgcucgaggaggcccaguccaucgaccugcacaucgagaucgaggaacagaccaucgggguggacguccacgcccugggccacugguucgauggccggcucaaccugaagaccagcuuccacugcuacggggccugcaccaaguacgaguaccccuggcacacggccaagugccacuacgagcgcgacuaccaguacgagaccuccuggggcugcaaccccagcgacugcccgggggugggcaccggcugcaccgcgugcgggcucuaccucgaucagcugaagcccgugggcuccgccuacaagaucaucaccauccgguacagccgccgggucugcguucaguucggggaggagaaccucugcaagaucaucgacaugaacgacugcuucgugucccgccacgucaaggugugcaucaucggcaccgugagcaaguuuucccagggggacacccuccuguuuuucggcccucuggagggagggggccucaucuucaagcacuggugcaccagcacgugccaguuuggggaccccggcgacaucauguccccucgagacaagggguuccugugccccgaguuccccggcagcuuccgcaagaagugcaacuucgccaccacccccaucugcgaguacgacggcaacauggucuccggguacaagaaggugauggcaaccaucgauagcuuccaguccuucaauacgagcaccaugcacuucaccgacgagcggaucgaguggaaggacccggacggcaugcugcgcgaccacaucaauauccucgugaccaaggacaucgacuucgacaaccugggggagaaucccugcaagaucggccugcagacguccagcauagagggugcguggggcagcggcgucggguucacccugaccugccucguuucccugaccgagugucccacguuccucaccagcaucaaggcgugcgacaaggccaucugcuacggcgccgaguccgggacccugacccggggccagaacacggugaaggucagcgggaagggcggccacuccgggagcaccuucaagugcugccacggcgaggacugcucccagauagggcugcacgccgccgcgccccaccucgacaaggugaacggcaucagcgagaucgagaacuccaaggucuacgacgacggcgccccgcagugcgggaucaagugcugguucgucaagagcggcgaguggaucuccgggaucuucagcgguaauuggaucgugcugaucgugcugugcguguuccuccuguucucccucgugcuccugagcauccccugccccguccgcaagcacaagaaguccuga

SEQ ID NO: 15053 - RNA, 3408 nt, Artificial Sequence; identical to SEQ ID NO: 11767
  derived and/or modified CDS sequence (opt11) from HTNV(SN7)__AF288656.1__GP

SEQ ID NO: 15054 - RNA, 3408 nt, Artificial Sequence
  derived and/or modified CDS sequence (opt11) from HTNV(84FLi)__AF366569.1__GP
augggcguguggaaguggcuggucauggccagcuugguguggcccgccugcacccuacgcaacguguacgacaugaagaucgagugcccgcacaccgucagcuucggggagaacagcguaauaggcuacguggagcugccgccgaugccccucgccgacacgacccagcuggugcccgaauccagcuguaguauggacaaccaccagagccugaacaccaucaccaaguacacccagguguccuggcggaagaaagccgaucaggcccagagcagucagaacagcuucgagacgguguccgucgaaguggaccucaagggaaccugcgugcugaagcacaagaugaucgaggagagcuaccgcucccgcaagagcaucacguguuacgaccugagcuguaauagcacguacugcaagcccacccucuacaugaucgucccgauccaugccugcaauaugaugaaguccugccucaucgcccugggccccuaccggguccaggugguguacgaacggaccuacuguaugacagguguacucaucgaggggaagugcuucgugccggaccagagcgucguguccaucaucaagcacggcaucuucgacaucgcgagcgugaagaucgucugcuucuucgucgccgugaaggggaacacguacaagcuguucgagcaggucaagaaguccuucgacucuacgugcaacgacaccgagaacaaggugcagggcuacuacaucuguaucgucggaggcaacagcgcccccaucuacgugcccacccuggacgacuuccgcaguauggaggccuuuagcgggaucuuucggagcccccacggcgaggaccacgaccucgcgggcgaggaggucgccagcuacuccaucgucgggccggccaacgccaaggugccccacaacgccagcuccgacacccugagccugaucgcguacuccggcauaccgagcuacuccagccucuccauccugaccucguccaccgaggccaagcacgucuucucacccggguucuucccgcagcugaaccacaccaagugcgacaagacggcaaucccccuuacguggacaggcaugaucgacuuacccggcuacuacgaggccauccaccccugcaccgucuucugcgugcuguccgggccaggcgccagcugcgaggcguucagcgagggcgggaucuucaacaucacgucccccaugugccucguaaguaagcaaaaccgcuuccggcugaccaagcaacagguaaacuucgugugccaacggguggacauggacaucguaguguacugcaacggccagcggaaggugauccugacaaagaccauggucaucggccagugcaucuacacgaucaccucccucuucagccugcugcccggcguggcacacuccaucgccguggagcucugcguccccggguuccacggaugggccaccgcugcgcugcuggugaccuucugcuucgggugggugcucaucccggccgucacauucaucauccugaccgugcugaaguucguggccaauaucuuccacaccagcaaccaggagaaccgccucaaguccguccugcggaagaucaaggaagaguucgagaagaccaagggcagcauggugugcgacguguguaaguacgaaugcgagacguacaaggaacugaaggcccauggggucuccugcccccagucacagugccccuauugcuucacccacugcgagcccaccgaggccgcguuccaggcccacuaccgcgugugucaagugacccaccgcuuccgcgacgaccucaagaagaccguaaccccgcaaaauuucacccccggcugcuaccggacccugaaccuguuccgcuauaaguccagaugcuacauuuuuaccauguggguguucuuguuagugcuggagagcaucuuaugggccgccuccgcgagcgaggucccacuaaauccgaucuggaacgacaaugcacacggaguaggguccgugcccaugcacacugaccuggagcuagacuucagccugaccuccagcagcaaguauaccuaccgccggaagcugaccaaccccuuagaggagacgcaggccauagaccugcacaucgagaucgaggagcagacuaucggcgucgacguacacgcccuggggcacugguucgacggacgccugaaccucaagaccagcuuccacugcuacggggccugcaccaaguacgaguaccccuggcacacggcgaagugccauuacgagcgcgacuaccaguacgagaccagcuggggcugcaaccccuccgacugccccggcguggggaccggcugcaccgcuugcgggcuguaccuggaccagcucaagcccgucggcagcgccuacaaaaucaucacgauccgguacucccgccgcgugugcgugcaguucggggaggagaacuugugcaaggugaucgacaugaacgacugcuucgugagccgccacgucaaggucugcaucaucgggacaguguccaaguucucucaaggcgacacccuccucuucuucggaccccucgagggugggggcuugaucuucaagcacuggugcacuucuacgugucaguuuggcgacccgggggacaucaugagcccccgggauaagggcuuccucugccccgaguuccccggcaguuuccgcaagaaguguaacuucgccaccaccccgcugugugaguacgacggcaacaugaucagcggauacaagaagguuauggccacuaucgacuccuuccagagcuucaacacgagcaccaugcacuucaccgacgagcggaucgaguggaaggacccggacgguaugcugcgcgaccacaucaauauccucgucaccaaggacaucgacuucgacaaucugggcgagaaucccugcaaaaucggguuacaaacgagcagcaucgagggcgcguggggguccggcgugggguucaccuugaccugccuggugucccugaccgagugccccacauuucucaccagcaucaaggccugcgacaaggccaucugcuacggcgcggaaagcgucacccugaccaggggccagaauacggugaaggucuccggcaagggcgggcacagcggaagcaccuucaaaugcugccauggggaggauugcagccagaccggccugcaugccgcggcuccucaccucgacaaggugaacggcaucuccgagauugaaaacagcaagguguacgacgacggggcgccccaaugcggcaucaagugcugguucgugaaaucgggggaguggaucagcgggaucuucuccggcaacuggaucguucugaucgugcugugcgucuuucugcuuuucucuuuggugcuccuguccguguuaugccccguccgcaagcacaagaaguccuga

SEQ ID NO: 15055 - RNA, 3408 nt, Artificial Sequence
  derived and/or modified CDS sequence (opt11) from HTNV(Aa08-1111)__KY594715.1__GP
augggcauauggaaguggcuggugauggccagccucgucuggcccguuuucacccugcguaacguguacgacaugaagaucgaguguccgcacaccgucuccuucggggagaacagcgugaucggguacguugagcugccacccaugccccucgccgacacggcccaaauggucccggaguccagcugcuccauggacaaccaccagagccuaaacaccaucaccaaguacacccaggugucuuggcgggggaaggcagaccagagccaauccagccagaacuccuucgaaacggugagcaccgaggucgaccugaaggggaccugcgugcuaaagcacaagaugguggaggaauccuaccgaucccggaaguccauaaccuguuacgaccugagcugcaacagcacguacugcaagccgacccuuuacaugaucguccccauacacgccugcaacaugaugaagucgugccucauugcccuggggcccuaccgcguccagguggucuacgagcggaccuacugcaugaccggcguccuuauugagggcaagugcuucgugccagaccagagcgucguaagcaucaucaagcacgggaucuucgacauugccagcgugcacaucgucugcuucuuuguggcggugaagggcaacacguacaagaucuuugagcaggucaagaaguccuucgagagcacgugcaaugacaccgagaacaaagugcagggguacuacaucugcaucgucggcgggaacuccgcccccaucuacgcccccacccucgacgauuuccgcagcauggaggccuuuaccggcaucuucaggagcccccacggcgaggaccacgaccuggcgggggaggagaucgccuccuacucuaucguggguccggcuaacgccaaggucccgcacagcgccuccagcgacacccugucccucaucgcguacagcgggauccccuccuacagcucgcugagcaucaucaccuccagcaccgaggccaagcacgucuucucccccggucuguucccgaagcucaaccacacgaacugcaacaagggcgccaucccccugaucuggaccgggaugaucgaccuucccggcuacuacgaggccgugcaccccugcaccguguucugcguccucagcgggccgggcgccagcugcgaggcguucuccgaagggggcaucuuuaacaucaccagccccaugugccucguguccaagcagaaccgcuuccggcuaacggagcaacaggugaacuucgucugccagcgcguugacauggacaucgugguguacuguaacggccagcggaaggugauccucaccaagacucuggugaucgggcagugcaucuacaccaucacgagccuguucucccuccugcccggggucgcccacagcaucgccguggaacugugcgugcccggauuucacggcugggccaccgccgcgcugcuggucacguucugcuucgggugggugcugaucccggccauuacauucaucauccucacgguguugaaguucaucgccaacaucuuccauaccuccaaccaggagaaccgccucaagagcguccugcggaagaucaaggaggaguucgaaaagaccaagggcuccauggugugcgacaucugcaaguacgagugcgagaccuacaaggagcugaaggcccacggcgugagcugcccccagucccagugccccuacugcuucacgcacugcgagcccaccgaggccgcguuucaggcccacuacaaggucugccaggugacccaucgcuuccgggacgaccugaagaagaccgugaccccgcagaacuucacgcccgggugcuaccgcacccucaaccuguuccgguacaagagccgcugcuacaucuucaccauguggaucuuccugcucguccuggaguccauccugugggccgccagcgcgucagagacgccccucaccccgguuuggaacgauaacgcgcacggcguggggagcguccccaugcacaccgaccuggagcuggacuuuucccucaccagcagcuccaaguacaccuaccggcgcaagcugacgaauccccuggaggaagcacagagcaucggccuacacaucgagauagaggagcagaccaucgggguggacgugcacgcccucggccacugguucgacggccggcugaaccugaaaaccuccuuccacugcuacggggccugcaccaaguacgaguaccccuggcacacggcgaagugccacuacgagcgcgacuaccaguacgagaccagcuggggcugcaacccguccgacugccccggggucggcaccggcugcaccgccugcgggcucuaccuggaccaacugaagcccgucggcagcgcuuacaagaucaucacgauccgauacucccggcgcguguguguccaguucggggaggaacaccucugcaagauaauagacaugaaugacugcuucguuagccggcaugugaaggucugcaucaucgguaccguguccaaauuuagccagggggacacccugcuguucuucggcccccucgagggcgggggccugaucuucaagcacuggugcaccuccacgugccaguucggagacccgggcgacaucaugagcccccgcgacaaggguuuccugugcccggaguuccccggcuccuuccggaaaaagugcaacuucgccaccaccccgaucugcgaguacgacggaaacauggugagcggguacaagaaggugauggccaccaucgacuccuuccagagcuuuaauacguccaccaugcacuucaccgacgagcgcauugaguggaaggaccccgacggcaugcuccgggaucacauuaacaucuuggugaccaaggacaucgacuucgacaaucugggggagaaccccugcaagauuggccuccagacgagcuccaucgaaggggcguggggcagcggcgugggguucacccugaccugccugguaagccucaccgagugucccacguuccugaccuccaucaaggccugcgacaaggccaucugcuacggcgccgagagcgugacccugacccgcggucagaacacggugaaggucuccggcaagggcggccacagcggcuccacguuuaagugcugccacggggaggagugcagccagaucggccuccacgccgcggccccgcaucuggacaaggugaacgggaucuccgagaucgagaacagcaagguguacgacgacggcgcgccccagugcgguaucaagugcugguucgucaaguccggcgaguggaucagcggcaucuucuccggaaacuggaucgugcugaucguccucugcguguuccuccuguucagccucgugcugcucuccauccucugcccgguccggaaacacaaaaagagcuaa

SEQ ID NO: 15056 - RNA, 3408 nt, Artificial Sequence
  derived and/or modified CDS sequence (opt11) from HTNV(Aa09-189)__KY594716.1__GP
augggcaucuggaaguggcuggugauggccagcuuggucuggcccgucuucacccugcgcaacguguacgauaugaagaucgagugcccgcacacagucuccuucggggagaacagcgugaucggcuacguggagcugccacccaugccccucgccgacacggcccagauggucccggaguccagcugcuccauggacaaccaccagucgcuuaacacaaucaccaaguacacacagguguccuggcggggaaaggccgaucagagccaguccagccagaacuccuucgagacggugagcaccgaagucgaccugaagggaaccugcgugcucaagcacaaaaugguggaggaguccuaccgcagccgcaaguccauuaccugcuacgacuugagcugcaacuccacguacugcaagcccacccuguacaugaucguccccauccacgcuugcaacaugaugaagucuugccucaucgcccugggacccuaccgcguucaggugguguacgagcggaccuacugcaugaccggcgugcugaucgaggggaagugcuucgugccggaccaguccgucgugagcaucaucaagcacgggaucuucgacaucgccagcguccauaucgucugcuucuucguagcggucaagggcaacacguacaagaucuucgagcaggucaaaaagaguuucgagagcacuugcaacgacaccgagaacaaggugcagggguacuacaucugcaucgucgggggaaacuccgcacccauauacgcccccacccucgacgacuuccgcagcauggaggccuucacgggcaucuuccggagcccccacggcgaggaccacgaccuggcgggggaggagaucgccuccuacucuaucgugggccccgccaacgccaaggugccccacagugccuccagcgacacucugucccucaucgcguacucggggauccccuccuacagcuccuuaagcaucauaacguccagcaccgaggccaagcacguguucucccccggccuguucccgaagcucaaccauacgaacugcgacaagggcgccaucccccugaucuggaccggaaugauugaccugcccggcuacuacgaggcagugcaccccuguaccgucuucugcguccucagcgggccgggcgccagcugcgaggcguucuccgagggcgggaucuucaacaucaccucacccaugugccugguauccaagcagaaccgauuccggcuaacggagcaacaggugaacuucgucugccagcgcguggacauggacaucguggucuacugcaaugggcagcggaaggugauccucaccaaaacccuggugaucgggcaguguaucuacaccaucacaagccuuuucucccuccugcccggcgucgcccacagcaucgcagucgagcugugcgugccaggguuccacggaugggccaccgccgcguugcuggucaccuucuguuucggguggguccugaucccggcuaucaccuuuaucauccucacggugcugaaguuuaucgccaacaucuuucacaccuccaaccaagagaaccgccugaaaagcguccuccggaagaucaaggaggaguucgagaagaccaagggcuccauggugugcgacauaugcaaguacgagugcgagaccuacaaggagcuaaaggcccacggcgugagcugcccccagucccagugcccuuacugcuucacgcauugcgagcccacugaggccgcguuccaggcccacuacaagguaugccaggugacccaccgcuuccgggacgaccugaagaagaccgugacgccccagaacuucaccccugggugcuaccgcaccuuaaaccuguuccgguacaagagccgcugcuacaucuucaccauguggaucuuccuacucguucuggagucaauccugugggccgccuccgcguccgagacgccccucaccccuguguggaacgacaacgcccacggcguggggagcgugcccaugcacaccgaccuggagcuggacuucuccuuaaccagcagcuccaaguacaccuaccggcgcaagcugaccaacccgcuggaggaagcccagagcaucggccugcacaucgagaucgaggagcaaaccaucgggguggacgugcacgcgcucggccacugguucgacggccggcugaaccugaagacguccuuccacugcuacggggccugcaccaaauacgaguaccccuggcacacggcgaagugccacuacgagagggacuaccaguacgagacuagcuggggcugcaacccguccgacugccccggggucggcaccgguugcaccgccugcgggcuuuauuuagaccagcuuaagccagugggcagcgccuacaaaaucauuacgauccgguacuccaggcgcguguguguccaguucggggaggagcaccucugcaagaucaucgacaugaacgacugcuucgugagccggcacgugaaggucugcaucaucggcaccgugucuaaguucagccaaggcgacacccugcuguucuucggcccccucgagggcgggggccugaucuucaagcacuggugcaccuccacgugccaguucggggacccgggcgacaucaugagcccccgcgacaaaggguuccugugccccgaguuccccggcuccuuccggaagaagugcaacuucgccaccaccccgaucugcgaguacgacggcaacauggugagcggguacaagaaggucauggccaccaucgacuccuuccagagcuucaacacguccaccaugcacuucaccgacgagaggaucgaguggaaggaccccgauggcauguuaagagaccacaucaacauccuggugaccaaggauaucgacuucgacaaccugggggagaaccccugcaagaucggccuccagacaagcuccaucgagggggcgugggguagcggggugggguucacccugaccugccugguuagccucaccgagugccccaccuuccugaccuccaucaaggccugcgacaaggccaucugcuacggcgccgagagcgugacccuuacccgagggcagaacacggugaaggucucaggcaaagggggccacagcggcuccaccuucaagugcugucacggggaggagugcagccagauuggccuccacgccgcggccccgcacuuggacaaggugaacgggaucuccgagaucgagaacagcaagguguacgacgacggugcgccccaguguggcaucaagugcugguucgucaaguccggggaauggaucagcggcaucuucuccgggaacuggaucgugcugaucguccucugcguguuccugcuguucagccucguacugcuguccauccucugccccguccggaagcacaaaaagagcuga

SEQ ID NO: 15057 - RNA, 3408 nt, Artificial Sequence
  derived and/or modified CDS sequence (opt11) from HTNV(CJilin93)__AY748307.1__GP
auggguauguggaaguggcuggugaucgccagccucguguggcccgcccuggcgcugcgcaacguguacgacaugaagaucgagugcccccacaccguguccuucggugagaacagugucauaggguacguggagcucccgccgaugcccuuagcagacaccgcacaaauggugccggagaguagcugcuccauggacaaccaccagagcauaaacacgaucaccaaguacacccaagucaccuggcgggggaaggccgaccccggccaguccagccagaacuccuuugaaacgcugucugccgaagucgaccucaaggggaccugcguacugaagcacaagauggucgaggaguccuaucgcagccggaaguccaucacgugcuacgaccugagcugcaacagcaccuacugcaaacccacacucuacaugauagugccaauccacgcgugcaacaugaugaaaagcugcuuaaucgcccugggaccguaccgcgugcaggucguguacgagcggaccuacugcaugaccggggugcucaucgaggggaagugcuucguccccgaccaguccguggugagcaucaucaagcacggaaucuucgacaucgccuccguccacaucguguguuucuucguggccgucaaggggaacaccuacaagcuauucgagcaggucaagaaguccuuugagagcacgugcaacgacaccgagaacaaagugcagggcuacuauaucugcaucgucgggggcaacagcgcgccaaucuacgugcccacccuggaugacuuccgcagcauggaggccuucaccggcaucuucaaguccccgcacggggaggaucacgaccucgccggcgaggagaucgccagcuacaguaucguggggcccgccaacgcgaaagugccccauagcgccucaagcgacacgcugucacugaucgccuacagcggcauccccuccuauagcucccucagcaucuuaaccuccagcaccgacgccaagcacguauuuucaccgggcuuguuccccaagcucaaccacaccaacugcgacaagucagccaucccccugacguggaccgguaugaucgaccugccaggguacuacgaggcgauccacccgugcacagucuucugcgugcucuccgggccaggcgccagcugcgaggcauucagcgagggagggaucuucaacauuaccucccccaugugccuggugagcaagcagaaccgguuccgccugacggagcagcagguuaacuucgugugccagagaguggacauggacaucgucgucuacuguaacggccagcgcaaggugauccucaccaagacccuagucaucgggcagugcaucuacaccaucacgucccuguucagccuccugcccggcguggcccacuccaucgccguggagcuaugcgucccgggguuccacggcugggcgaccgcugcccuccuggugaccuacugcuucgggugggugcugaucccggccaucaccuuuaucauccucacaguccugaaauucaucgccaacaucuuccacaccagcaaccaggagaaccggcuaaagagcguacugcgcaagaucaaggaggaguucgagaagacgaaggggagcauggugugcgacgucugcaaguacgagugcgaaaccuauaaggagcugaaggcccacggcguguccugcccccagagccaaugccccuacugcuucacgcacugcgagccgacggaggccgcuuuccaagcccacuacaaggugugccaggucacccaccgguuccgugacgaccucaagaaaaccgugacaccucagaacuucacucccggcugcuaucggacccucaaccuguuccgcuacaaaucccggugcuacaucuucaccauguggguguuccugcucauccuggagagcguccugugggcggccuccgcuagcgagacuccgcucacgcccguguggaacgauaacgcucauggcgugggguccguccccaugcacacagaccuggaguuagacuucagccuaacgucaagcagcaaguacaccuaccgccggaagcucacgaacccccuggaggaggcccaguccauagaucugcacaucgagaucgaggagcagacgaucgggguggacguacacgcgcucggacacugguucgacggccgccugaacaucaagaccagcuuccacugcuacggcgccugcacaaaguacgaguacccguggcacacggccaagugccacuaugagcgggacuaccaauacgagaccagcugggggugcaaccccagcgacugccccggcgucgggacgggcugcaccgccugcggccuguaucucgaccagcugaagcccgugggguccgccuacaagaucaucacgauccgguacagccgccgugugugcguucaguucggcgaggagaaccugugcaaaauaauugacaugaacgacugcuucguuucccgccacgugaaggucugcaucaucgggaccgugagcaaguucucccagggcgacacccuccuguucuuuggcccguuagagggcggcgguuugaucuuuaagcacuggugcaccagcacgugccaguucggcgaccccggggacauaaugagcccccgggacaaaggcuuccugugccccgaguucccggguucauuccgcaagaagugcaacuuugcgaccacacccaucugcgaauacgacggcaacaugguguccggcuacaagaaggucauggccaccaucgacagcuuccaguccuuuaacacguccacuaugcacuucaccgacgagcggaucgaguggaaggaucccgacgggaugcugcgcgaccacaucaacauccuugugaccaaggacauugacuucgacaaccuaggcgagaaccccugcaagaucggccugcagacguccagcauagagggcgcguggggguccgguguuggcuucacccugacgugccuggucagccugaccgagugcccgacguuccucaccagcaucaaagcgugcgacaaggccaucugcuacggggcggaaucugugacccugacccguggccagaacacggugaaggucagcgggaagggcgggcacuccggcagcaccuucaaguguugucacggcgaggacugcuccaaaaucgggcuccacgcggccgccccgcaccucgacaaggugaacggcauaagcgagaucgaaaacuccaagguguacgaugacggagcgccucaguguggcaucaaaugcugguucgucaagagcggcgaguggaucuccgggauuuucagcggcaacuggaucgugcugaucguccuguguguguuccucuuauucucccuggugcuacucuccauacugugccccguccgcaagcauaagaaguccuga

SEQ ID NO: 15058 - RNA, 3408 nt, Artificial Sequence
  derived and/or modified CDS sequence (opt11) from HTNV(KHF,clone:4)__LC209208.1__GP
augggcaucuggaaauggcuggugauggccagccucgucuggcccgugcugacccugcgcaacguguacgacaugaagaucgagugcccgcacaccgucuccuucggggagaacagcguuaucggcuacguggagcucccgcccaugccccuggccgacacggcccagcugguccccgaguccucuugcuccauggacaaccaccagagccucaacaccaucaccaaguacacccagguguccuggcggggaaaggccgaccagagccaguccagucagaacuccuucgagacgguguccaccgaggucgaccuaaaggggaccugcgugcugaagcacaagaugguggaggaguccuaccgcagccggaaauccauuaccugcuacgaccucagcugcaacuccacguacugcaagcccacccuguacaugaucguccccauccacgccugcaacaugaugaaaagcugccugaucgcccucgggcccuaccgcguucaggugguguacgagcggaccuacugcaugaccggcgugcugaucgagggcaagugcuucgugccggaccaguccgucgugagcaucaucaagcacgggaucuucgacaucgccagcgugcacaucgucugcuucuucguggccgugaagggcaacacguacaagaucuucgagcaggucaagaaguccuuugagagcacaugcaacgacaccgagaacaaggugcagggguacuacaucugcaucgucggcgggaacuccgcccccaucuacgugcccacccuggacgacuuccgcagcauggaggccuucaccggcaucuuccguagcccccacggcgaggaccacgaccucgcuggggaggagaccgcgaccuacuccaucgugggccccgcuaacgccaaggucccccacuccgcgagcucagacacccugagccugaucgccuucucggggauccccucguacuccagccucuccauccugaccagcuccaccgaggcgaagcacguguucagccccggccuguucccgaagcucaaccacaccaacugcgacaagggcgccaucccccugauguggaccgggaugaucgaccugcccggcuacuacgaggccauccaccccugcacgguguucugcguccucuccgggccgggcgccagcugcgaggccuucagcgagggcgggaucuucaacaucaccucccccaugugccuggugagcaagcagaaccgcuuccggcuuaccaagcagcaagugaacuucgucugccagcgcguugacguggacaucgucguguacugcaacggccagcggaaggugauccucaccaagacgcuggucaucgggcagugcaucuacaccaucacgucccuguucagccuccugcccggcguggcccacuccaucgccguggagcugugcguccccggguuucacggcugggcgaccgccgcccuccuggugacguucugcuucgggugggugcugaucccggcggucaccuucaucauccucgcuauccugaaguucaucgccaacaucuuccacaccagcaaucaggagaaccgccugaaguccgugcuccggaagaucaaggaggaguucgagaagacgaagggcagcauggugugcgacgucugcaaguacgagugcgagacauacaaggagcugaaggcccacggcguguccugcccccagagccagugccccuauugcuucacccacugcgagcccaccgaggccgcguuccaggcccacuacaaggugugccaggucacccaccgcuuccgggacgaccugaagaagaccgugacgccgcagaacuucacccccgggugcuaccgcacccucaaccuguuccgguacaagucccgcugcuacaucuucaccauguggaucuuccugcucgugcuggagagcauccugugggccgccuccgcgagcgagacaccccucaccccgguuuggaacgacaacgcccacggcguggguuccauccccaugcacaccgaccuggagcuggacuucagccugaccuccagcagcaaguacacguaccggcgcaagcucaccaacccccuggaggaggcccaguccaucgaccugcacaucgagaucgaggaacagaccaucggcguggacguccacgcccuugggcacugguucgacggccggcugaaccugaagaccagcuuccacugcuacggagccugcacgaaguacgaguaccccuggcacaccgcgaagugccacuacgagcgcgacuaccaguacgagaccuccugggggugcaacccgagcgauugccccggcguggggaccggcugcacggccugcggccucuaccuagaccgccugaagcccgugggguccgccuacaagaucaucaccauacgguacagccgccgggucugcgugcaguucggcgaggagaaccucugcaagaucaucgacaugaacgacugcuucgugucccgccacgucaaggugugcaucaucgggaccgucagcaaguucucccaaggcgacaccuugcuguucuuugggccccucgagggcggcgggcugaucuucaagcacuggugcacgagcaccugucaguucggcgacccgggggacaucaugagcccccgggacaagggcuuccugugccccgaguucccgggguccuuccgcaagaagugcaacuucgccaccaccccgaucugcgaguacgacggcaacauggucuccggcuacaagaaggugauggccacgaucgacagcuuccaguccuucaauaccagcaccaugcacuucaccgacgagcggaucgaguggaaggaccccgacgggaugcuccgcgaccauaucaacauccuggugacgaaggacaucgacuucgacaaccugggcgagaaccccugcaagaucgggcuccagaccuccagcaucgaaggcgcguggggguccggcgucggcuucacccugaccugccuggugagccucacggagugccccaccuuccugaccaguaucaaggccugcgacaaggccaucugcuacggugccgagucagugacccugacgcggggccagaacaccgucaaggugagcgggaagggcggucacuccggcagcaccuucaaguguugccacggcgaggacugcuccccgaacgggcuccacgccgcggcuccccaucuggacaaggugaacggcaucagcgagaucgagaacuccaaggucuacgacgacggggcgccccagugcggcauuaagugcugguucgucaagagcggcgaguggaucuccgggaucuucagcggcaacuggaucgugcuaaucgugcucugcguguuccugcuguucucccucguccugcugagcauacucugccccgugcgcaagcacaagaaguccuga

SEQ ID NO: 15059 - RNA, 3408 nt, Artificial Sequence
  derived and/or modified CDS sequence (opt11) from HTNV(KHF,clone:5)__LC209209.1__GP
augggcaucuggaaauggcuggucauggccucccuuguuuggcccgugcuaacccuacgcaacgucuacgacaugaagauagagugcccacacacgguuuccuucggcgagaacuccgucaucggauacgucgaacuacccccaaugccccucgcagacacagcccaacuuguccccgagagcagcugcucuauggacaaccaucagucgcugaacacaauaaccaaauacacccaagucagcuggcgcggaaaagcagaccaaagucagucaagccaaaacagcuucgaaaccgucuccaccgagguagaccucaaaggcacuugcguccuaaagcauaaaaugguagaagaaagcuaccgcagucgcaaauccaucacaugcuacgaccucagcugcaacuccaccuacugcaaaccaacucuauacaugaucguacccauccaugcaugcaacaugaugaaaagcugccucaucgcacucggaccauacaggguacaagucgucuacgaacguacauauuguaugaccggaguucugaucgaaggcaaaugcuucguacccgaccaguccguagucuccauaaucaaacacggaaucuucgacauagcaagcguccauauaguaugcuucuucgucgcggucaaagguaacacauacaaaauauucgaacagguuaagaaaucguucgaaucuaccugcaacgacaccgagaauaaaguucaaggguacuauaucuguaucgugggcggcaacagcgcccccauuuacguaccaacccuugacgacuuccgcagcauggaagcauucaccgguaucuuccgcuccccacacggcgaagaccacgaccuagcgggagaagaaacggccacauacucgauaguagggcccgcgaacgccaaagucccccacuccgcgucaucggacacacuaucacugauagcauucuccggcauccccuccuacucuagccuaucaauccucaccagcuccacagaagcaaaacacguguucucaccaggucuauucccuaagcuaaaccacaccaacugcgacaagggcgcaaucccccuaauguggaccggcaugaucgaccuucccggcuacuacgaagccauccacccaugcacagucuucugcguccucuccggcccaggcgccuccugugaagccuucuccgaaggcggcauuuucaacaucacaucaccaaugugccuugucucuaagcagaaccguuuccgccuuaccgaacagcaagucaauuucgucugccaacgagucgaugucgauauugucgucuacuguaauggccaaagaaaagucauccucacgaaaacccuagucauaggacagugcauuuacaccaucacuucgcuuuuuagcuuacucccggguguugcccacagcauugccgucgaacucugcguaccaggcuuccacggcugggcaaccgcugcccuacucgucacauuuuguuucggauggguacucauuccugcuguuaccuuuaucauccuagccauacucaaguucauugccaacauauuccauacgagcaaccaggagaaccgccucaaaucaguccugagaaaaaucaaagaagaguucgagaaaacuaaaggcuccauggucugcgacgucugcaaguacgaaugcgaaacuuacaaagaacuaaaagcccauggagucuccugcccacaaucacaaugcccuuauuguuucacccauugcgaaccaaccgaagccgcauuucaagcgcacuacaagguaugccaagucacccaccgauuccgcgacgaccucaagaaaaccguuacuccccagaacuuuacccccggaugcuaccgcacacucaaccuuuucagauacaaaucccgaugcuacauauuuaccauguggaucuuccuccuaguccuagaauccauccuaugggcagccucagcgucagaaacaccccuaaccccagucuggaacgacaacgcucauggcguuggcaguauucccaugcacacagaccuugaacucgacuuuagccuuaccuccucuucuaaauacaccuauagacgcaaacucacgaacccccuugaagaagcacaguccaucgaucuacauaucgaaaucgaggaacaaacaaucgggguagacguccacgcccugggacacugguucgacggacgccucaacuuaaagacgagcuuccacugcuacggagccuguaccaaauacgaauacccauggcacacugcaaaaugccauuacgaacgcgacuaccaauaugaaacuagcuggggcugcaaucccagcgauugccccggcguagggacgggcugcaccgccugcggccucuaucucgaccgccucaagccggucggaucagcauacaaaauaauaaccauccgcuauucgaggagagucugcguucaauucggcgaagaaaaucucugcaagaucauugacaugaacgauugcuucguaagccgucacgucaagguaugcauaauaggaacuguaagcaaguucucacaaggcgacacacuccucuucuuuggaccccuagaaggaggcggucuuauauucaaacacuggugcaccuccacgugccaguucggcgaccccggcgacauuaugucgccccgggauaaaggcuuccucugcccagaguucccagggagcuuccgcaagaaaugcaacuucgccaccaccccaaucugugaauaugacggaaauauggucucaggauacaagaaagucauggccacaaucgauuccuuucaauccuucaacacuagcacaaugcacuucaccgacgaacgaaucgaauggaaagaccccgacggaaugcuuagagaccacaucaacauccucguaacgaaagacaucgacuucgacaacuuaggcgaaaaccccugcaaaauuggccuccaaaccuccuccaucgaaggcgcuugggggagcggagucggcuucacccuuacaugccuuguaucccuaacagaaugcccaaccuuucugaccuccaucaaggcaugcgauaaggccaucugcuacggagccgaaaguguuacccucacccgcggacagaacaccguuaaagucucugguaaaggaggccacuccggcagcacuuucaaaugcugccacggagaagacugcagccccaauggccuccacgcugcagcaccucaccuagacaagguuaacggaauaucagaaaucgaaaauuccaaaguuuaugacgacggggcaccacagugcgguaucaaaugcugguucgucaaaucaggcgaguggauuuccggcaucuucuccggaaauuggauaguccucauagucuuaugcguguuucugcuauucucccuaguacuacugucaauccucugcccuguacgcaaacacaagaaauccuga

SEQ ID NO: 15060 - RNA, 3405 nt, Artificial Sequence
  derived and/or modified CDS sequence (opt11) from HTNV__D00376.1__GP
augggcaucuggaaguggcuggugauggccagccucgucuggcccgugcugacccugcgcaacguguacgacaugaagaucgagugcccgcacaccgucuccuucggggagaacagcgugaucggcuacguggagcuaccgcccaugccccuggccgacacggcccagcugguccccgagucuagcugcuccauggacaaccaccagagccucaacaccaucaccaaguacacccagguguccuggcgggggaaagccgaccagagccaguccagccagaacuccuucgagacggugagcaccgaggucgacuugaaggggaccugcgugcugaagcacaagaugguggaggaguccuaccgcagccggaaguccaucacgugcuacgaccucagcugcaacuccaccuacugcaagcccacccuguacaugaucguccccauccacgccugcaacaugaugaaguccugccugaucgcucucgggcccuaccgcguccaggugguguacgagcggaccuacuguaugaccggcgugcugaucgagggcaagugcuucgugccggaccaguccgucgugagcaucaucaagcacgggaucuucgacaucgccagcgugcacaucgucugcuucuucguggcggugaagggcaacacguacaagaucuucgagcaggucaagaaauccuucgaaagcacgugcaacgacaccgagaacaaggugcagggguacuacauaugcaucgucggcgggaacuccgcccccaucuacguacccacccuggacgacuuccgcucaauggaggccuucaccggcaucuuccggagcccccacggcgaggaccacgaccucgccggggaggagaccgcgaccuacagcaucguaggcccggccaacgccaaggucccccacuccgccagcucggacacucugagccugauugccuucuccgggauccccagcuacuccagccucuccauccugacaucguccaccgaggcgaagcacguguucagccccggccuguucccgaagcucaaccacaccaacugcgacaagggcgccaucccccugauguggaccgggaugaucgacgugccccguuacuacgacggcauccaccccuucacggucuucugcgugcuguccgggccgggcgccagcugcgaggccuucagcgagggcggcaucuucaacaucaccucccccaugugccucgucagcaagcagaaccgguuucgccugaccgagcagcaggucaacuucgugugccagcggguggacguagacaucgugguauacugcaacggucagcgcaaggucauccugaccaagacgcucgugaucgggcagugcaucuacaccaucaccucccuguucagccugcuccccggcguggcccacuccaucgcgguugagcugugcguucccggauuccacggcugggccaccgccgcccugcucgugacguucugcuucggguggguccuuaucccggccgugaccuucaucauccuggcgauccucaaguucauugccaacaucuuucacaccagcaaccaggagaaccggcugaaguccgugcugcgcaagaucaaggaagaguucgagaagaccaagggcagcauggucugcgacgugugcaaauacgaaugcgagacguacaaggaguuaaaggcccacggcguguccugcccccagagccaaugccccuacugcuucacccacugugagcccaccgaggccgccuuccaggcgcacuacaaggucugccaggugacccaccgguuccgcgacgaccuaaagaagaccgugaccccgcagaacuuuacccccgggugcuaucggacccugaaccucuuccgcuacaagucccgcugcuacaucuucaccauguggauuuuccugcugguccucgagagcauccugugggccgcguccgccagcgagacuccccugaccccgguguggaacgacaacgcgcacggcgugggguccauccccaugcacaccgaccucgaguuggacuucagccugacauccagcagcaaguacacguaccgccggaagcugaccaauccccucgaggcacaguccaucgaccugcacaucgagaucgaggagcagaccaucggcgucgacgugcacgcccuggggcacugguucgacggccgccucaaccugaagaccagcuuccacugcuacggcgccugcacgaaguacgaguaccccuggcacaccgccaagugccacuacgagcgcgacuaccaguacgagaccuccuggggcugcaacccgucggauugccccggcugcgggaccgggugcacggcgugcggccuguaccucgaccggcugaagcccgugggguccgccuacaagaucaucaccauccgcuacagccggcgcgucugcgugcaguucggcgaggagaaccugugcaagaucaucgacaugaacgacugcuucgugucccggcacgucaagguuugcaucaucgggaccgucagcaaguucucccagggcgacacccuccuguucuucgggccccuggagggcggcgggcucaucuucaagcacuggcgcacgucaacgugccaguucggcgacccgggggacaucaugagcccccgggacaagggcuuccugugucccgaguuccccggguccuuccgcaagaagugcaacuucgccaccaccccgaucugcgaguacgacggcaauauggucuccggcuacaagaaggugauggccaccaucgacagcuuccaguccuucaacaccagcaccaugcacuucaccgacgagcggaucgaguggaaagacccugacgggaugcugcgcgaccacauaaacauccucgugacgaaggacaucgacuucgacaaccugggcgagaaccccugcaagaucgggcugcagaccuccagcaucgagggcgccuggggguccggggucggcuucacccugacaugccucgugagccugacggagugccccaccuuccucaccagcaucaaggcgugcgacaaggccaucugcuacggggccgaguccgugacccugacgcggggccagaacaccgucaagguguccgggaagggcgggcauuccggcagcaccuucaagugcugccacggcgaggacugcuccccgaacgggcugcaugccgccgcgccccaccucgacaaggugaacggcaucagcgagaucgagaacagcaaggaguacgacgacggggcgccccagugcggcaucaagugcugguucgucaagagcggcgaguggaucuccgggaucuucagcggcaacuggaucgugcugaucguccugugcguguuccuccuguucucccuggugcuucugaguauacugugccccguccgcaagcacaagaaguccuag

SEQ ID NO: 15061 - RNA, 3417 nt, Artificial Sequence
  derived and/or modified CDS sequence (opt11) from LANV(510B)__AF005728.1__GP
auggaaggauggcucuuuacaauacucggcguauguuauauaaugaccacgguucuacccaaaaccaucuacgaauuaaaaauggaaugcccacacacaguaggccucggucaaggauacaucaucggcuccgcggaacuagggcucauagacaucgccacaguccccgaaaucaaacuugaauccuccugcaacuucgaccugcacaccaccagcucaacccagaaaucauucacccagcucgaauggcgcaagaaagcagagaccaccgauaccacacaagcugcuagcacaacauucgaagcccaaaccaaaacuguaaacauaaggggcaccuguauacuagcguccgaccuuuacgacacccuuaaacgcguuaagaaaacaguucucugcuacgaccugacaugcaaccaaacccagugucagcccacagucuaccucaucacccccgucggaacuugcauguccauacgcagcuguauggccaaucuccuauccaacagaauccagaucacguucgagaaaacacacugcgucaccggacaacucguggaaggacaauguuucaacccgagucacucgcuuacccucucccagcccccgcacacauacgacgucgucacccuccccaccacaugcuuuuucacagccaagaaagccgaccaauacaaaauagucaaaaccuucgaaggcauuaucuccaaaacaggcugcacagaaaacagcauccaaggguacuacgucugcuucauaggaucacacuccgaaccccucaucauacccacacuugaggacauccgguccgcagagcucgccucacgcaugcuccuacacccucgaggcgaggaucacgacccccuacaaaacgcacaagcuguccuccgaaucgucgguccuauaaccgccaaaguacccucuuccagcagcaccgaaacacugcaaggaaucgcauuugccggagugccgauguacuccuccuucuccacacucguacggaacgccgacccugaguauguauucagcccuggcauaauuccagaauccaaccaaagcgugugcgacaagaaaacccuaccacugaccuggaccggauaccuaccaaucucaggcgagauggaaaaagucaccggaugcacagucuucugcacccucgcaggucccggagcgaauugugaagccuauucagagucuggaauauucaacaucucuucaccuacuugccuaguaaacaaaguccaacgguucagaggcucggaacagaaaaucaacuucaugugccaacgaaucgacaacaacgucgucgucuauugcaacggccagaagaaaguaauucucacuaaaacacucgucaucggacaaugcauauauacuuucaccucccucuucucucucaugcccgacgucgcccacucgcuagcaguggaacuaugcguaccuggccugcacgguugggccaccauugcccuacuauccacuuucugcuucggcuggcugcucauaccaggcaucacacuaaucguccucaaaauacucaaaauacucaccuauucauguucccacuacagcagcgaaagcaaauucaaaaugauccuagaaaaaguuaaaguagaauaccagaaaacaaugggcucuauggucugugacaucugucaucaugaaugcgaaacugucaaagaacucgagucccacaaacaaagcugcgucgaaggccaaugcccguacuguaugacagucacugaagccacccaaagcgcccugcaagcccacuucaguauaugcaaacucaccggacgauuucacgaagcccuaaagaaaucccuuaagaaacccgaaguacaccgaggaugcuaccgaacccucggagucuuucgcuaucgaaguagaugcuacgucggccucguuuggggaugccuccugacaauagaacuuguucucugggccgcaagcgccgaaacacccuuacuagaaccaggauggagcgacaccgcccacggcguaggcgaacucccacucaaaaccgaccuggaacuagacuucagccuucccuccucaagcuccuacagcuaccgccgccgccucacuaacccugccaacaaagaagaaucacuuccauuccacuuucaaauggaaaaacaagucauacacgccgaaauacaaucacucgggcacuggauggaugcaacuuucaacauuaaaacugcauuccacugcuacggggccugcaaacaauacagcuacccauggcagacagcaaaaugcuuuuucgagaaagauuaccaauacgaaaccggauggggcugcaaccccggggacugccccggggucggcacaggaugcacagccugcggaaucuacuuagacaaacuaaaaucggucggaaaagcauacaaagucaucucucucaaauacacacgaaaagucugcauccaacucggcaccgagcaaguauguaaacauaucgacgcaaacgacugucucguaacccccuccgucaaaguaugcaucaucgggacagucuccaaaauucagccaucagacacccuacucuuccuaggcccccucgaacaagggggagucauccugaaacaauggugcacaaccucuugcacauucggcgacccaggcgacaucauguccaccacaucaggaaugaggugccccgagcacacgggauccuuccguaaaaucugcggauuugcaaccacgcccgugugcgaauaccaaggcaauacaauuuccgguuaccagcgacuuauggccaccaaggacuccuuccaauccuucaaccucaccgauccccacauaaccagcuccaaacuugaauggaucgaccccgacggcaacacucgugaccacgucaaccucauccuaaaccgagaugugucguuccaagacuuauccgacaacccuugcaaggucgaccuacauacccaguccauagacggcgccuggggaucgggcgucggcuucacccucacuugugucguaggucucacagagugccccucauucaucaccucaaucaaagcgugugaccucgcuaugugcuacggcucaaccguagcgacacuugcucgcggauccaacaccgucaaggucguaggcaaggguggacacucaggcucguccuucaaauguugccacgacucagacugcucgucagaagggcuuauggcaucggcgccacaccuagagcgagugacaggcuuuaaucagauugacuccgacaaaguuuacgacgacggcgcaccgcccugcucauucaaaugcugguucacuaaauccggcgaauggcuccucggcauacuuaaugggaacuggaucgucauagcagugcucgucauaauacucauaaucuccauuauacucuuuuccuuccugugcccccggcgcucacauaagaaaaacgucuaa

SEQ ID NO: 15062 - RNA, 3402 nt, Artificial Sequence; identical to SEQ ID NO: 11776
  derived and/or modified CDS sequence (opt11) from LQUV(Longquan-Rs-32)__JX465402.1__GP

SEQ ID NO: 15063 - RNA, 3402 nt, Artificial Sequence
  derived and/or modified CDS sequence (opt11) from LQUV(Longquan-Ra-25)__JX465397.1__GP
augaaguccauccugcuuauccugcugcucggccaggugcgcagcaaggccaccaacgagaucaagcuggagugcccccacgaccagcgggucgaaacaggguucagccauggcuucaccgaccuguccccgauccucuacacuaaaggccuguucaccaagcaccuggagaacaacugccccuucgacaucuccaucaucaaccgccucguucgggacgugcgcaucuccaccuggcaggccaaaaguacgaacaccgacgcgaccgucgccuccgccaccagcuucgagacgaaggacacggacgacaagcuggcaggcgucugcggcuuuuucgacgacaucaccaagcccaagcagggccagcguaaggccaucaucugcuacgaccuguccugcaaccagacccacugccuucccacccugcaccugauuuucccgcaacaguucugccagucacucaagcagugcuccaucaacgcguacgaccauaagauccucaucaccaucucccugucauucugucccgagggccucaucaucgggggcaacugcaucgugccaguccuggcacagagucagcugcuccacaaccacaugaccuacaacaucaaggugaccugcuucuucgaguacuccauggcccgcgagagccuggacaacaaauuccuggaggagaugaaccggcucgugcuggggcgcaacugcgagaaaacugaauaccugggcggguacgucugcuuccuugccggcuacggcaccgcgauccacgugcccuacgacaacaccuaccuguccggggccguggucaacagcaugaaggccaaccugcacggcgaggaccacgaccggcucaaacugggggauaccagcgccgugaucgccggcaaccugaaguucguaaucgacagcacggcgccggaaaaguccuaucagggcgaaugcuucaccgggcacauggguuacaccagccucuauuucuaccccguccgcuccaaggggaaguacgugaccauccugacgaagggcguaauccccgucaucaacaagacgaccuguaugcccaagauugugccgcuaguguggaccgggauggucgagaugcggggcaucgaggagaagcucgaagccugcaccaugcacugcaucauggugggcaacggggcgaccugcgaggccuucuccgccaccggcaucuucgacaucaaaagcacaacgugccagaucgggaagacgcacaaguaccgccggaccgaggaccagaucacguucacgugccaggaucugaacaaggacaucuccgugaucuguaacggcgaaaacaucaccguccccgucaagagccugaucguggggcaauguaucuacaccaucaccuccaucuucagcaucuuccccgccaccgcccacuccaucgccacggaaaugugcgugcagggcauacacggcuggcucaccaucaucauuuucuucaccuuuugcuuuggguggcugcugauccccauucuaaccugccucaucauaaacacgaucgccuauagcuugaucacccucgccuacuucaagaauggcgcgcgccuugggaaccugaucaagcggaugaaguccgaguuccagcgcaccauuggcaacaccacgugcaacaucugccuccgggagugcgagagcgaguccgaguacaagagccacgaggaacugugcaagaacgguuccugcccguacugcaugaaggacaucggcgugagccagguccugcugaacgagcauuacaacgcguguaugcucaucgaccgcuaugagaagcggcugacccacacccugaaccagacgccccuuuacucccgcaaggugcggaaaauccagagcuuccgcuaccgcaaccggugcuucauccugaccguguggaucauccugcucacggucgagucccugaucugggccagcagcgccgaggacaucaagccugcccccaaguggcagaacaccgcccacggcaucgggaccaucaagcugaacuccgacuacgagcucgacuucagcgugguggcuggcuccgaguucacgcacaagcgcaugcugcagagcccggagucggggaagaagaacauccccuucaccgucuaccuaagcgagcagcugaucaccuccaccgugcagauccugggcaacuggauggacgccgagaucaacgucaagagcguguuccacugcuacggcacauguaagaaguacuccuaccccuggcagagcaguccaugccacaaagagguggacuucgaguuccagagcuccugggggugcaacccgauaagcugccccggcaucaacuccgggugcaccgccugcggcaccuacguggacaaguugaagaccaucgcgaaggccuaccgcaucaucacugucaaguacagccgcaaagucugcuaccagaucgggaccaagaaggccugcaagacccucgaguccaacgacugcuuagugagcaacggcgucaagaucugcgccaucggcaccaucagcacgcugcagacagggaugacccucguguucuuuggcccccugaacgggggagcccuacucaucaaggauuggugcaucuccagcuguaaauucggggaccccggcgacaucaugcagaucuccaacaacaucacgugcccgagcuucgauggcaccaugcagcgggugugccgcuucgggcuggagccgaugugcuccuacagcggcaacaagauuuccgggguaaagcgggugcuggagaccaaagauagcuaccucuccgugaaccugacuaagcccaaacuggucggaagcacccuccuguggaacuccuuggauagcuccaucaaggaccacaucaacaucguggugagcaacgauaucgacuucgaagaucucgcggagacgccgugcaaggucaccaucaagaaccugaagaucgagggggccuggggcucaggcaucggaaucaaacugcacugcgaggugagccucucugaguguucugaguaccugaccaccaucaaggugugcgacaacgccaucugcuacggcgggaacgucgcccaccugucccgcggccucaacaccgugaucaucaagggggccggcggccacagcgggagcuccuucaagugcugccaugaaacgagcugcucagauaucggcuucaaggcggaggcgccccaccuggcccggaucguugacgacgggaucaccaccagcauguccuacagcgacggcgcccccgaagccggcauuaucuccuggaucuacaaggucgccgaguggaucaaggggauguucaacggcaacugguucgugcugaucaucaugauccucuuccugaucaucagcauugugcugcuaaucuuccugugccccguuaagaaguacaaguga

SEQ ID NO: 15064 - RNA, 3402 nt, Artificial Sequence; identical to SEQ ID NO: 11778
  derived and/or modified CDS sequence (opt11) from LQUV(Longquan-Ra-5)__JX465398.1__GP

SEQ ID NO: 15065 - RNA, 3402 nt, Artificial Sequence; identical to SEQ ID NO: 11779
  derived and/or modified CDS sequence (opt11) from LQUV(Longquan-Ra-56)__JX465399.1__GP

SEQ ID NO: 15066 - RNA, 3402 nt, Artificial Sequence
  derived and/or modified CDS sequence (opt11) from LQUV(Longquan-Ra-90)__JX465400.1__GP
augaaguccauccugcucauccugcugcucggccaggugcgcagcaaggccaccaacgagaucaagcuggagugcccccacgaccagcgggucgagaccggguucagccacggcuucacggaccuguccccgauccucuacaccaaggggcuauucacuaagcaccuggagaacaacugccccuucgacaucagcaucaucaaccgccucguccgggacgugcgcaucuccaccuggcaggccaagagcacgaacaccgaugcgaccgucgccuccgccaccagcuucgagacgaaggacaccgacgacaagcuggccggcgugugcggguucuucgacgacaucaccaagcccaagcagggccagcggaaggccaucaucugcuacgaucuguccugcaaccagacccacugccuccccacgcugcaccugaucuucccgcagcaguucugccagagccucaagcagugcuccaucaaugcguacgaccacaagauccugaucaccaucagccuguccuucugucccgagggccucauaaucgggggcaauugcaucgugcccguccuggcccagagucagcugcuccacaaccacaugacauacaauaucaaggugaccugcuucuucgaguacuccauggcccgcgagagcuuggacaacaaguuccuggaggagaugaaccggcucgugcuggggcgcaauugcgagaagacggaguaccugggcggguacgucugcuuccucgcaggcuacggcaccgcgauccacgugcccuacgacaacaccuaucucuccggugccguggucaacagcaugaaggccaaccugcacggcgaggaccacgaccggcucaagcugggggacaccuccgccgugaucgccggcaaccugaaauucgugaucgacagcacggcgccggagaaguccuaucagggcgagugcuucaccgggcacaugggcuacaccagccucuacuucuaccccguccgcucuaaggggaaguacgugaccauccugacgaagggcgugauccccgucaucaacaagacgaccugcaugcccaagaucgugccgcugguguggaccgggauggucgagaugcggggcaucgaggagaagcucgaggccugcaccaugcacugcaucauggugggcaacggagcgaccugcgaagccuucuccgccaccggcaucuucgacaucaagagcaccacgugccagauugggaagacccacaaguacagacggaccgaggaccagaucaccuucacgugccaggaccugaacaaggacaucuccgugaucugcaacggcgaaaauaucaccguccccgucaagucccugaucguggggcagugcaucuacaccaucaccucuaucuucagcaucuuccccgccaccgcccacuccaucgccacagagaugugcgugcagggcauccacggcuggcucaccaucaucaucuucuucaccuucugcuucggguggcugcuaauccccauccugaccugccucaucaucaacacgaucgccuacagccugaucacccucgccuacuucaagaacggcgcgcgccuggggaaccugaucaagcggaugaaguccgaguuccagcgcaccaucggcaacaccacaugcaacaucugccuccgggagugcgagagcgaguccgaguacaagagccacgaggagcugugcaagaacggguccugcccguacugcaugaaggauaucggcgugagccagguccugcugaacgagcacuacaacgccugcaugcucaucgaccgcuacgagaagcggcugacccacacccugaaccagacaccccucuacucccgcaaggugcggaaaauccagagcuuccgcuaccguaaccggugcuucauccuaaccguguggaucauccugcucaccgucgagucccugaucugggccagcagcgccgaggacaucaagcccgcccccaaguggcagaauaccgcgcacggcaucgggaccaucaagcugaacuccgacuacgagcucgacuucagcgugguggccggcuccgaguucacgcacaagcgcaugcugcagagcccggagucuggaaagaagaacauccccuucaccguauaccugagcgagcagcucaucaccuccaccgugcagauacugggcaacuggauggacgcugagaucaacgucaagagcguguuccacugcuacggcacgugcaagaaguacuccuaccccuggcagagcucccccugccauaaggagguggacuucgaguuccaaagcuccugggggugcaaccccaucuccugccccggcaucaacuccgggugcaccgccugcggcaccuacguggacaagcugaagaccaucgcgaaggccuaccggaucaucacggucaaauacagccgcaagguguguuaccagaucgggaccaagaaggccugcaagacccucgagucuaaugacugccucgugagcaacggcgucaagaucugcgccaucggcacgaucagcacgcugcagaccgggaugacccucguguucuucgguccccugaacgggggcgcccugcucaucaaggacuggugcauuuccagcugcaaauucggggaccccggcgacaucaugcagaucuccaauaacaucacgugcccgagcuucgacggcaccaugcagcgaguaugccgcuucgggcuagagcccaugugcuccuacagcggcaacaagaucuccggggucaagagagugcuggagacgaaggacagcuaccucuccgugaaccugaccaagcccaagcuggucggcagcacccuccuguggaacucccuggacagcuccaucaaggaccacaucaacaucguggugagcaacgacaucgacuucgaggaccucgcggagacgccgugcaaggucaccaucaagaaccugaagaucgagggggccuggggcuccggcaucgggaucaaguugcacugcgaggugagccuauccgagugcagcgaguaccugacaaccauuaaggugugcgacaacgccaucugcuacggcgggaacgucgcccaccugucccgcggcuuaaacaccgugaucaucaagggggccggcggccacagugggagcucuuucaagugcugccacgagacgagcugcuccgacaucggcuucaaggcggaagcgccccaccuggcccggaucguggaugacgggaucaccaccagcauguccuacagcgacggcgcccccgaggccggcaucgucuccuggauuuacaagguggccgaguggaucaaggggauguucaacggcaacugguucgugcugaucaucaugauccucuuccugaucaucagcaucguccugcucaucuuccugugccccgugaagaaguacaaauga

SEQ ID NO: 15067 - RNA, 3423 nt, Artificial Sequence; identical to SEQ ID NO: 11781
  derived and/or modified CDS sequence (opt11) from NYV(Rhode Island-1 (RI-1))__U36801.1__GP

SEQ ID NO: 15068 - RNA, 3423 nt, Artificial Sequence; identical to SEQ ID NO: 11782
  derived and/or modified CDS sequence (opt11) from NYV(New York-1 (NY-1))__U36802.1__GP

SEQ ID NO: 15069 - RNA, 3423 nt, Artificial Sequence; identical to SEQ ID NO: 11783
  derived and/or modified CDS sequence (opt11) from NYV(New York-2 (NY-2))__U36803.1__GP

SEQ ID NO: 15070 - RNA, 3447 nt, Artificial Sequence
  derived and/or modified CDS sequence (opt11) from PUUV(K27)__L08754.1__GP
augggugagcucucaccggucugccuauaucuccuccuccagggccugcugcuuugcaacaccggagccgcccgcaaucuaaacgaacucaaaauggaaugcccccacacaauccgacucggacaaggccuagucgucggauccguagaacuacccagccuccccauccaacaagucgagacacucaaacucgaauccaguugcaauuucgaccuccauaccagcaccgccggccagcaauccuucacaaaauggaccugggaaauaaaaggcgaccucgcggagaacacacaagccucuagcacaucuuuccaaaccaaaagcagcgaaguuaaccuccgaggccugugccuuauccccacccucguugucgaaaccgcagcacgcaugcgcaaaaccauagcaugcuacgaccucagcugcaaccaaacagucugccaaccaacagucuaccuaaugggcccuauucaaacaugcaucacaaccaaaagcugccuccucagccucggcgaccaaagaauacaaguaaacuacgagaaaacguacugcguaucuggucagcucgucgaaggcaucugcuucaaccccauacacacaauggcacuuucacaacccucacacacuuacgacaucaugaccaugaugguccgaugcuuccuggugaucaagaaaguuaccucaggugacagcaugaaaauagagaaaaacuucgaaacacucguccagaaaaacggcugcaccgccaacaacuuccaaggauacuauaucugccugauaggaucaucaucagaaccgcuguacgucccggcccuagacgacuaccgaucugccgaaguucuuucucgcauggccuucgcaccacacggcgaagaucacgacauagagaaaaacgcagucagcgcaaugaggaucgcaggcaaaguaacgggcaaagcucccagcacagaaagcucugauaccguacaggggaucgcauucagcggcagcccacuuuacaccuccacuggcguauuaacaagcaaggacgaccccguguacaucugggccccaggcauuaucauggaagguaaccacuccauaugugaaaagaaaaccuugccgcucacuuggaccggauuuaucucucuccccggcgaaaucgagaaaacgacccaaugcacagucuuuuguacccuagcaggaccaggcgccgacugcgaagcauacagcgaaaccggcaucuucaacauuagcagcccuacuugcuccaucaaccgcguucaacgguuccgaggcucggaacagcaaauaaaauucgucugccaacgcguagacauggacauaaccgucuacugcaacgggaugaagaaagucauucuuaccaaaacccuagugauagggcaauguauauauaccuucacaucuaucuucucacucaucccaggaguugcacauucccucgccgucgaacucuguguacccggccuacauggcugggccaccaugcuccuacuacucacccuaugcuucggcuggguccuaauacccaccauaaccaugauccuucuaaaaauacucauagcuuucgccuaccuaugcuccaaauacaacaccgacucaaaauuccgaauccucauagaaaaagucaaacgagaguaccagaaaaccaugggauccauggucugugagguaugccaauaugaaugugagaccgcaaaagaacuugagucccaucgcaaaucaugcucaaucggcucaugccccuacugccugaacccaucggaggcaaccacaagugcccuccaggcacacuucaaaguaugcaagcucacuucacgcuuccaagaaaaucugcgcaaaagccuaacagucuacgaacccaugcagggcugcuaccgaacacuaucccucuuccgauaccgcucgcguuucuucguaggccucgucuggugcguccuccucgugcuagagcuaauaguaugggccgcaucagccgaaacccaaaaucuuaacgccggcuggacagacacugcgcacggguccggcaucauaccgaugaagaccgaccuugaacuugauuucagccugccgagcucugccucauacacuuaccgacgccaauuacaaaaccccgcaaacgagcaggagaaaaucccauuccaccuccaauuauccaaacaagucauacacgccgaaauacaacaccugggccacuggauggacgcgaccuuuaaccucaaaacggcuuuccacugcuacggaagcugcgaaaaguacgcauacccguggcaaaccgccgggugcuucaucgagaaagacuacgaauacgaaacagguuggggcuguaacccgcccgacugccccggcguagggacaggcugcaccgccugcggaguauaccuggacaaacucaaaucugucggaaaaguauucaaaaucguaagccuuagauacacgcgcaaaguuugcauccaacucgguacagaacaaacaugcaaaacagucgauucuaaugacugccuuaucaccaccucaguaaaaguaugucucaucggcaccauuucaaaguuccagcccuccgauacccuacuuuucuuaggcccgcuacaacaaggagggcuaaucuuuaaacaaugguguaccacaacuugccaauucggggacccuggugauaucaugucuacuccaaccggaaugaaaugcccagaacuaaacggaucauuccgcaagaaaugcgcauuugcuaccacgcccguaugccaauucgacgggaacaccauauccggcuacaaacgcaugaucgcaacaaaagacucauuccaguccuucaacguaacggaaccccacaucagcacaagugcccucgaauggauagaccccgacucuagucucagagaccacaucaacgucauagucucacgagaucuaucauuccaggaucucucggaaacgccaugccagauagaccuagcuacggccaguauagacggagcauggggcucuggcguuggauucaaccuagucugcaccguaucucugacagaaugcuccgcauuccugacuuccaucaaagcaugcgacgcugccaugugcuauggcuccaccaccgcaaaccuaguccggggucagaauaccauacacaucgucggaaaaggaggucacuccggaucuaaauucauguguugccacgauacgaaaugcucguccacagggcuaguggcagcagcaccccacuuggaccgagucaccggcuacaaccaggccgacuccgacaaaauauucgacgacggcgcccccgaaugcgggaugagcugcugguuuaagaaguccggcgaauggauucuuggcguccugaacggaaacuggaugguaguugcagucuuagucguccuccucauacucucaauacuacucuucacccuuugcuguccccgccgaccaucguaccgaaaagagcauaagcccuga

SEQ ID NO: 15071 - RNA, 3447 nt, Artificial Sequence
  derived and/or modified CDS sequence (opt11) from PUUV(13891)__U22418.1__GP
auggguaagaucauacccgucugucucuaccuccuauuucuaugccuccuccuuuggaaucgcggggacgcccguaaccuuaacgaacucaagauggaaugcccgcacacaauaggccucgggcaaggguuaguuaucggcuccgucgaacuacccccagucccgcucacccaaguggaaucccucaaacuagaauccaguugcaauuucgaccuacauaccucgaccucuagccagcaaucuuucaccaaguggacaugggaaaucaaaaaugaccuugccgaaaacacacaagcgaguucgaccucguuccaaaccaaaagcucagaaauaaaccucagaggacuaugucucauaccgccccucguaaucgaaacggccgccagaacaagaaaaacgaucgccugcuucgaccucagcugcaaccaaaccgcaugccaaccuacagucuuucucauaggcccaauccaaaccugcauaaccaccaaaagcugccuucuaggucugggcgaccagcggauucaaguaaacuacgagaaaacguauugugugucaggacaacucgucgaaggcguuugcuucaaccccgugcacaccauggcccuuucccaaccgucacacaccuaugacauagugacggucaugguacguugcuucuuaauagucaaaaagguaagcaccggagacuccaugaaguuggaaaagagcuucgaaacccuaguacagaaaacaggaugcaccggaaacgguuuccaaggauacuauguuugccucguagguagcagcuccgaaccgcuuuacauacccacccuagacgacuaccgcucagcugaaauacucucccgaauggccuucgccccgcacggagaagaccacgacgucgaaaagaaugccaucuccgccaugcgcaucguuggcaaggucaccggaaaggcccccuccacggaauccucggacaccauccaaggaaucgcguucucgggaaacccccuuuacacgagcaccggcguccucacggcuaaggacgacccuguauauaucugggcccccggaauaaucauggaaggcaaccacucaguaugcgacaagaaaacccuaccccuaaccuggaccgguuuuaucccccuaccaggcgaaauagagaaaacgacccaaugcacggucuucugcacacucgccggaccgggcgccgacugugaagcauauuccgaaaccggcaucuucaacauaaguaguccuaccugccuaauaaaccggguucaacgauuucgcggcgcugaacaacaaaucaaauucaucugccaacgaguagauauggacauaaccgucuauuguaacggccuuaagaaagugauucucaccaaaacucucgucauaggccaauguauuuacaccuucacaucaauauucucccugauccccggcguugcacacucccuugcggucgaacucuguguucccggucuccacggaugggccaccaugcuacuccuauugaccuucuguuuuggauggauccuaauucccuucuuuuccaugaucuugcucaaaauauuaauagccuucgcauaccuuugcuccaaauacaauaccgauucaaaauucaaaauucuaauugaaaaagucaagcgagaauaucagaaaaccaugggguccauggucugcgaagugugccaauacgaaugcgaaaccgcaaaagaacuagagucccaccguaaaucaugcccaaucggcucaugccccuacugccuaaacccagcagaagccacaacaucagcgcugcaagcgcauuucaaaguauguaaacugaccagccguuuccaagacaaccuaagaaaaagccugggagcauacgaacccaaacaaggcugcuaccgcacacucagccucuuccgcuaccgcucgcgcuucuucgugggcuucaacuggugucuucuccucguccuugaacuaauagucugggcggccucagccgaaacucaaucccucaauuccggcuggaccgacaccgcacacggaagugggauaaucccgaugcgcacagaccuagaacuagacuuuucgcuacccagcagcgccagcuacacuuaucgccgccaacuacagaacccugccaacgaacaagagaaaauccccuuccaucugcaaaucuccaaacaggugauccacgccgaaauccaacacuuaggccauuggauggacgggacuuucaaccuaaaaaccgccuuccacugcuacggaucuugcgaaaaauacgcauacccauggcagaccgccggcugcuucaucgaaaaggacuacgaguaugaaucggguuggggcugcaauccacccgacugcccaggcguaggcaccggcugcaccgcuugcggugucuaccuagacaaacugaaaucagucggcaaagccuuuaaaauaguaagccuacguuauacgcgcaaagccugcauacaacuugguaccgaacagaccugcaaauccguagacuccaacgacugccuuguaacuaccuccgucaaagugugccucaucggcaccguaagcaaguuucaaccaucggacacgcuccucuucuuaggcccccuugaacaagggggccucauuuucaagcaaugguguaccacgaccugccaguucggagacccgggcgauauuaugucaacacccgucgggaugaaaugcccagaacuaucaggauccuuucgcaagaaaugcgccuuugccaccaccccagucugucaauucgacgguaacacucucuccggauauaaacgcaugaucgccaccaaagacuccuuucagucauucaacgucacagaaccccacauaagcgcaucuagccucgaauggaucgacccagacuccucacuacgcgaccacaucaacgucauuguaggccgugaucuguccuuucaagaccuaucggaaacaccuugucaagucgaccuugcuacuaccucaaucgauggcgccuggggcucagggguuggcuucaaccucguaugcuccgucucacucaccgaaugcucaaccuuccuuaccucgaucaaagcaugcgacagcgcaaugugcuacggcucgaccacagccaaccuacuucgcggucaaaacaccguucacauaguaggaaagggcggacacagcgggaguaaguucaugugcugccacgacacaaaaugcucauccaccggccuugucgcagccgcaccccaucuugaccgugugaccggcuacaaccaagcggacuccgacaaaauuuuugaugacggagcucccgaaugcggaaucucgugcugguucaccaaaaguggcgaauggauccucggcguccucaacggcaacuggauggucgucgcaguccucaucgcacucuucaucuucucaaucuuccuguucacacuuugcugcccacgacggcccuccuacgcaaaggaacacaaaccauag

SEQ ID NO: 15072 - RNA, 3447 nt, Artificial Sequence
  derived and/or modified CDS sequence (opt11) from PUUV(CG17/Baskiria-2001)__AF442614.1__GP
augggagagcuaucaccugugugccucuaccugcugcuccaaggccuccuccucugcaacacuggagccgccagaaaccugaacgaacucaaaauggagugcccccacaccaucggccuaggacaaggccuagucgucggaagcguagaacugccaucacuccccauucagcaagucgagacacucaaacucgaauccucaugcaacuucgaucuccacaccucaacugcuggacagcaaucauucacuaaauggacaugggaaauaaaaggagacuuagccgaaaacacgcaagccagcuccaccucuuuucaaaccaaaucauccgaagucaaccugcgcggguuaugucuaauaccaacauuagucgucgaaacagcagcccgaaugcgcaaaaccauugcauguuacgaccucucuugcaaucaaacaguaugucagcccacagucuaucuaaugggccccauacaaaccugcaucacaacuaaaucaugccuacucagccugggagaccaacgaauacaagucaacuacgaaaagaccuauugcguuucaggccagcuuguggaaggcauaugcuucaaccccauacacacgauggcgcucucccaacccagccacacuuacgauauuaugaccaugaugguaagaugcuuccucgucaucaagaaagucaccucaggggacucaaugaaaauugagaaaaacuuugaaacacucguacagaaaaacggcugcacugccaacaacuuccaaggauauuauaucugccuaauuggcagcagcagcgaaccccucuacgucccagcccuagacgacuacaggagcgccgaagugcucucaagaauggcuuuugcuccccacggagaagaccacgacaucgaaaagaaugccgugagcgccaugcguauagccggcaaagucacuggcaaagccccaagcaccgaaucaagcgacaccguacaaggcaucgccuuuucgggaucgccgcucuacaccuccacggggguacucacauccaaagacgaccccgucuauaucugggcacccggcaucaucauggaagguaaccacuccauaugcgagaaaaagacacucccccuuaccuggaccggcuucauaagccuaccaggcgaaaucgagaaaacaacccaaugcacuguguuuugcacccucgccggacccggggccgacugcgaagcguacagcgaaaccggcaucuucaacaucagcucaccaaccugucucaucaaccgcguccagcgauuccgcggagccgaacagcaaaucaaauucguaugucaacgaguagacauggacaucaccguauacuguaauggaaugaagaaaguaaucuuaaccaaaacccuaguaauaggccaaugcaucuacacauuuacaucuaucuucucacucaucccgggaguugcacacucgcuugcagucgaacucugcgugccaggccugcacggaugggccacuaugcuccuacuacuaaccuuuugcuucggcuggguccugauccccacuaucacgaugauccuacuaaaaauauugaucgccuucgccuacuuauguaguaaauacaacacggauagcaaauuccgcauacuaaucgaaaaagucaagagggaauaccagaaaacgaugggcucaaugguuugugagguaugccaguacgaaugcgaaacagccaaagaauuagaaucccaccgcaaguccuguucaaucgguuccugccccuacugccuuaaccccuccgaggccaccaccagcgccuuacaagcccacuucaaaguuugcaagcuaaccucacgcuuucaagagaaccuacgaaaaagccuaacugucuacgagcccaugcaggguugcuaucgaacccucucccucuuuagauaccgcuccagauuuuucguaggccuagucuggugcguccuguuaguccuagagcugaucgucugggcagcaagcgccgaaacccaaaaccuaaaugccggcuggacggacacagcccacggcuccgguaucauucccaugaaaaccgaccuggaacuagacuucucguuaccaagcuccgcauccuacacuuaccgacgacagcugcaaaacccagcaaacgagcaagagaaaauuccauuccaccuccaacucagcaaacaaguaauccacgccgagauccaacaccucggacacuggauggacgcaaccuucaaccuuaaaaccgccuuccacugcuauggauccugcgaaaaauacgcuuacccauggcaaacugcgggaugcuucauugaaaaagauuacgaauacgaaaccggguggggaugcaacccacccgacugcccuggcgucggcacaggauguacagcaugcggcgucuacuuagauaagcuaaaauccguagggaaagucuucaagaucgucucccuuagauacacgcggaaggucuguauccagcucggaacagaacaaaccugcaaaacagucgacucaaacgacuguuuaaucacuaccaguguaaaagugugcuuaaucggcacgauaagcaaauuucagcccuccgacacccuucuguuccucggaccccuccaacagggaggacuaauauuuaaacaguggugcacaaccacaugccaguuuggagacccuggggacauaaugucgacccccaccggcaugaaaugccccgagcuaaacggauccuuucgaaagaaaugugcguucgcaaccacacccguaugccaguucgauggcaacacaaucucuggcuacaaaagaaugaucgccacaaaagacuccuuccagucauucaacgucaccgaaccacacaucuccacgagcgcacuugaguggaucgacccagauuccucacuccgcgaccacauaaacguaaucguuucccgcgaccuaucauuucaagaucuaucagaaacccccugccaaauugaccuggccaccgcuucuaucgacggagccuggggcagcggagucggcuucaaccuugucugcaccgucucacuaacggaauguagcgcuuuccucaccuccaucaaggcuugcgacgcugcaauguguuauggcucgacaaccgccaaccucguucgcggccagaauaccauccacaucgucggcaaaggaggccacuccggcuccaaauucaugugcugucaugacacaaaaugcucauccaccgggcucguagccgccgccccacaccucgaccacgucacaggcuauaaccaagccgacagcgacaaaaucuucgacgacggcgcccccgagugcggcaugucaugcugguuuaagaaaucgggagaauggauucuaggcguacuuaauggaaacuggauggucgucgccguacuugucguccuccucauccuguccauccuccucuuuacacuuugcugcccccgccgaccaucauaccgaaaagaacacaaacccuaa

SEQ ID NO: 15073 - RNA, 3447 nt, Artificial Sequence
  derived and/or modified CDS sequence (opt11) from PUUV(CG215/Omsk)__AF442615.1__GP
auggguaaacucuccccagugugccuguaccuacuucuccaaugccuccuccucggugacaggggagacgcucgcaaccucaaugaacugaaaauggaaugcccccacacgauaggguuaggccaaggacucgucguaggaucaguugaacuucccccugucccaauccaacaaguagaaucacuaaaacuugaauccucaugcaacuuugaccuucacacaagcacugccggucaacagagcuucaccaaauggacuugggaaauuaaaaaugaccuagcagaaaauacccaagcaucauccacauccuuccaaaccaaaagcucagaaguuaaccuccgcgguuugugccucauacccacucucguugucgaaaccgcagccaggacacggaagacaauugcuugcuacgaccuaaccugcaaccaaaccgugugccaaccaaccguguaccucauggguccgauccaaacaugcgucacaaccaaaucuugccucuuaggccucggagaucaacggauccaggugaacuacgaaaagaccuacugcguuuccggucaacucguagaaggcgucugcuucaauccaauacacaccauggcgcucucacaacccucacacaccuacgaugucaugacacucauggucagauguuuccucauuaucaagaaggucaccagcggugacuccaugaaaauagaaaagaacuucgaaacccucguccagaaaacaggcugcaccggcaacaauuuucaaggauacuacaucugccucauaggcucgucuucagaaccauuauauguaccaacccuugacgacuaccgaagcgcagaaguacuaucgaggauggccuucgccccucacggggaggaucacgacaucgagaaaaacgccgucucaacgaugcggaucgccggcaaagucaccggccgagcgccuucaacugaagccagcgacacaguacaaggaaucgcauucuccggaucaccccucuacaccuccacgggcguacucacagcgaaagacgacccggucuauauaugggcccccggcaucaucauggaaggcaaccacuccaguugcgacaaaaagacccugccccucacuuggacaggauuuauuucccugccaggcgaaauagagaagacaacccaaugcacgguauucugcacgcuagcgggaccuggcgcagacugcgaagccuacucagagaccggaauauucaacaucucaagccccacgugccucauaaacaggguccaacgcuuccgcggagccgaacagcaaaucaaauucgugugucaacggguggacauggacauuaucguauacugcaauggaaucaaaaaggugauacuaacaaaaacccuaguaauaggacagugcaucuauaccuuuacaagcauauucucgcuaaucccgggggucgcccacucccucgcuguagaacucugcguaccuggccuccacggcuggaccaccaugcuacuccuacuuaccuucugcuucggcuggguacucauccccuuuauaacaaugauccuucucaaaauucucauagccuucgcauaccuaugcuccaaauacaacaccgacagcaaauuucgcaucuuaguagaaaaagucaagaaagaauaccagaaaacgaugggaucaaugguuugcgaaguuugccaauacgaaugcgaaaccgccaaagaacucgaaagccacagaaaaagcugcuccauaggcucaugucccuacugucuaaaccccuccgaagcgacuaccuccgcccugcaagcccacuucaaaguaugcaaacuaacgucgcgguuucaagagaaucuacggaaaucucugacugucuaugaacccaugcaaggaugcuaccgcacgcuuucccucuuccgcuaccggucgaaauucuuugucggccuagucuggugccuacuacucgucauggaacuaaucguaugggccgcaucagccgaaacccaaaacuuaaacuccggcuggacugacaccgcacacggcuccgguaucauaccaaugaaaacagaccuagaacucgacuucagcuugccuuccagcgcgucauauaccuaccgccgccaacuccaaaacccagcuaacgagcaagagaagauccccuuccaccuccagaucuccaaacaagucauccacgcagaaauccaacaucuaggacacuggauggacgccacauucaaccugaaaacggcguuccacugcuacggcucaugcgaaaaauacgcauaccccuggcagaccgcuggcugcuucauugaaaaagacuacgaauacgaaaccggauggggaugcaacccgcccgacugccccggcguagguacuggcugcaccgccugcggagucuaccuggacaaacucaaaucaguuggcaaagucuucaagaucgucagccucaaauacacccgcaaagucugcauccaacucggcacagaacaaacaugcaaaaccguugacucaaacgacugucucauaacuaccucuguaaaagucuguaugauaggcacaauauccaaguuccaaccauccgacacacuacucuuucuuggcccccuccaacaaggcggauugauauuuaaacaauggugcaccacgaccugccaauucggggaucccggcgacaucauguccacccccaccggaaugaagugcccagagcuaaacggcucguuccgcaagaaaugugcuuucgccacaaccccagucugccaauucgacggaaacaccaucucaggauacaaaagaaugaucgccaccaaagacagcuuccagagcuuuaacguaaccgaaccacacaucuccgcgagcgcgcucgaauggaucgacccggacucuagcuuacgcgaccacaucaacguugucgucggccgagaccuguccuuccaagaccucucagagacccccugccaaguggaccuaaugaccucuacaaucgacggcgccuggggauccggcguagguuucaaccucguauguacgguaucccugacugaaugcuccccauuccucacgucaauaaaagcaugugacucagccaugugcuacggcuccacgaccgucaaccucguacggggccaaaacaccguccacaucguuggcaaaggcggccacagcggcagcaaauuuaugugcugucacgacacaaaaugcuccaguacgggccuugucgcagccgcuccucaccucgaccguguuacaggauacaaccaagccgacuccgauaaaauauucgacgacggagcuccugaaugcggaaugucgugcugguucaagaaauccggcgaauggauccuaggcguccuaaacgguaacuggaugguuguagccguccucauagcacuccucauccucuccauucucauguucacccuuugcugcccacgaagaccauccuaccggaaagaacacaaaccuuaa

SEQ ID NO: 15074 - RNA, 3447 nt, Artificial Sequence
  derived and/or modified CDS sequence (opt11) from PUUV(CG222/Omsk)__AF442616.1__GP
augggcaagcugagccccgugugccucuaccugcugcuccagugccugcugcucggggaccgcggcgacgcucggaaccugaacgagcugaagauggaaugcccgcauaccaucgggcucggccaggggcuggucgugggcucaguagagcugccgcccguccccauccagcaggucgagagccucaagcuggaguccagcugcaacuucgaccugcacaccuccacagccggccagcagagcuucaccaaguggaccugggagaucaagaacgaccucgcggagaacacccaggccuccagcacguccuuccagaccaaaagcuccgaggugaaucugcgcggacugugccuaauccccacccuggugguggagaccgccgcccggacgcgcaagaccaucgccugcuacgaccugaccugcaaccagaccgugugccagcccacgguuuaccucauggggcccauccagaccugcgugaccaccaagagcugucugcuggggcucggcgaccagcggauccaggugaacuacgagaagacguacugcgucuccgggcagcugguggagggcgugugcuucaaccccauccacaccauggcgcuaagccagccgucccacaccuacgacgucaugacccucauggugcgcugcuuccugaucaucaagaaggugacgagcggcgacuccaugaagaucgagaagaacuucgagaccuuaguccagaagaccgggugcaccggcaacaacuuccaaggguacuacauaugccucaucggcucguccagcgagccccucuacgugcccacgcuggacgacuaccggagcgccgaggugcucucccgcauggccuucgcgccccauggcgaggaccaugacaucgagaagaacgccgucagcaccaugcggauugccgggaaggucaccggccgcgccccguccaccgaggccagcgacacagugcaggggaucgccuucuccggcagcccccuguacaccuccaccgggguccugaccgcaaaggacgaccccguguacaucugggcccccggcaucaucauggagggcaaccacagcucuugcgacaagaagacgcucccgcugaccuggaccggguucaucagccugcccggcgagaucgagaagaccacccagugcaccgucuucugcacccucgccgggccccgggccgacugcgaggccuacuccgagaccggcaucuucaacaucagcuccccgaccugccugaucaaccgcgugcagcgguuccgcggggcggagcaacagaucaaguucgugugccagcgggucgacauggacaucaucguguacugcaacggcaucaagaaggugauccugacgaagacccucgucaucggccagugcaucuacaccuucaccagcaucuucucccugauccccgggguggcccacagccuggccguggagcucugcguccccggccugcacggcuggacgaccaugcugcuccuucugaccuucugcuucggcugggugcugauccccuucaucaccaugaucuugcugaagauccugaucgccuucgcauaccucuguuccaaguacaacacggacagcaaguuccgcauccugguggagaaggucaagaaggaauaccagaagaccaugggguccauggugugcgaggugugccaguacgagugcgagaccgcgaaggagcuggagagccaccgcaagagcugcuccaucggcagcugccccuacugccucaacccguccgaggccaccacgagcgcccugcaggcccacuucaaagucuguaagcugacgucccgguuccaggagaaccuccgcaagagccugaccguguaugagccgaugcagggcugcuaccggacccugucucucuuccgguaccgcagcaaguucuucguggggcuggucuggugccugcuccucgugauggagcugaucgugugggccgcguccgccgagacgcagaaccucaacagcggcuggacagauaccgcccacggguccggcaucaucccaaugaagaccgaccuggagcuggacuucagccucccuuccagcgccuccuacacguaccgccggcagcugcagaacccggcgaacgagcaggagaagauccccuuccaccuccagaucagcaagcaggucauccacgccgagauccaacaccugggccacuggauggacgccaccuucaaccugaagaccgccuuccacugcuacggguccugcgagaaguacgccuaccccuggcagaccgcgggcugcuucaucgagaaggacuacgaguacgagacgggguggggcuguaacccgcccgacugccccggggugggcaccggcugcacggccugcgggguguaccuggacaagcucaagagcgucggcaagguguucaagaucgugagccugaaguacacucgcaagguaugcauccagcuggggacggagcagaccugcaagaccguggacuccaacgacugccucaucaccacgagcgugaaggucugcaugaucggcaccaucuccaaguuccagcccagcgacacccuucuguuccucgggccacugcagcagggaggccugaucuucaagcaguggugcaccacgaccugccaguucggggaccccggcgacauaaugaguacccccaccggcaugaagugccccgagcucaacggcagcuuccggaagaagugcgcguucgccaccacgccggugugccaguucgacgggaacaccaucuccggcuacaagcgcaugaucgccaccaaggacagcuuccaguccuucaacgugaccgagccccacaucagcgccuccgcccuggaguggaucgaccccgacagcucccugcgagaucacaucaacgugguggugggccgcgaccucagcuuccaggaccuguccgagacgcccugccaggucgaccugaugaccagcaccaucgacggggcguggggcucgggggugggcuucaaccucgugugcaccgucagccugacggaaugcuccgccuuccugaccagcaucaaggccugcgacagcgcgaugugcuacggguccaccaccgugaaccucgugcggggccagaacacggugcacaucgugggaaagggcgggcacagcggguccaaguucaugugcugccacgacaccaaguguagcuccaccggccugguggccgccgccccgccccuggaccgcgucaccggcuacaaccaggcggacagcgacaagaucuucgaugacggggcccccgagugcggcauguccugcugguucaagaaguccggggaguggauccucggcguccuuaacgggaacuggaugguggucgccgugcugaucgcccuccugauccugagcauccucauguucacgcugugcugcccccggcgcccgagcuaccggaaggagcacaagcccuga

SEQ ID NO: 15075 - RNA, 3447 nt, Artificial Sequence
  derived and/or modified CDS sequence (opt11) from PUUV(CRF161)__AF367061.1__GP
augggaaaauuaucucccguaugccucuaucuauuacugcaaugucuccuccucggagaccgcggcgacgcccgcaaccucaacgaacugaaaauggaaugcccgcacaccaucggucucggccagggauuaguaguaggauccgucgagcucccacccguccccauacaacaaguugaaucacugaaacuagaaagcuccugcaacuuugaccuacacaccuccacagcaggucaacaauccuucacaaaauggaccugggaaaucaaaaacgaccuaguggaaaauacacaagcauccuccacauccuuccagaccaaaucauccgaggucaaucuccgcggacucugcuuaauacccacccugguaguagaaaccgcggcacgaacccgcaaaaccauagcaugcuacgaucuaaccugcaaccagacugucugccaacccacaguauaucucaugggccccauccaaaccuguaucacuacaaagagcugccuccugggacugggagaccaaagaauccaaguaaacuacgagaaaacuuacugcgucuccggccaacucgucgaaggagugugcuuuaaccccauacauaccauggcacucagucaacccucccacacauacgacgucaugacauuaaugguaagauguuuucuaauuaucaagaaagucaccagcggcgauagcaugaagauagagaaaaacuucgaaacgcucguccagaaaacagguugcacaggcaacaauuuccaaggcuacuauauaugccuaauaggcuccucaucggaaccacucuaugugccaaccuuagacgacuaucgcagcgccgaaguacucagccgcauggcuuucgcgccccauggcgaagaccacgacaucgagaaaaacgccgucucaacgaugcgcaucgccgguaaggucgccggccgcgcccccuccaccgaagccuccgauacgguccagggcaucgcguucuccggcucaccccuguacaccuccaccggcguacucacugcuaaagacgacccgguguacauaugggcgcccggcaucauuauggaaggaaaccacagcagcugcgacaagaaaacacuaccacuuaccuggacaggcuucaucucgcucccuggagaaauccagaaaacaacacaaugcacuguguuuugcacacuugcuggcccccgcgccgacugucaagcauacucagaaacaggcaucuucaauaucagcagcccaacaugccuaaucaaccgcguacaacgcuuccgcggugccgaacaacaaauaaaguucgucugccagcguguagacauggacaucauugucuacugcaauggaaucaagaaagucauacucaccaaaacccuugucauaggucaaugcaucuacacuuucaccuccauauucucucucaucccgggagucgcccauagucucgcuguagaacucugcguacccggccuccacggcuggacgaccaugcuacuacuacucacguucuguuucggcuggguacucaucccguucaucaccaugauccuucuuaaaauccuaaucgccuucgccuaccuuugcagcaaauacaauaccgacagcaaauuccgcauccuagucgagaaggucaaaaaggaauaccagaaaacaaugggauccaugguaugcgaaguaugccaauacgaaugcgaaacggcaaaagaacucgaaucccacagaaaguccugcucaaucgguuccugcccauauugucucaaccccuccgaagccacuaccagcgcccuucaagcacacuucaaaguaugcaagcucacauccagauuccaagaaaaccugcgcaaaagccuaacggucuacgaacccaugcaaggcugcuaccgcacguuaucacuuuuccgauaccggucgaaguucuuuguaggccuagucuggugucuacuccuggugauggaauuaauugucugggcagccucagcagagacccaaaacuuaaacagcggcuggacagacaccgcccacggcuccggcaucauacccaugaaaaccgaccucgaacucgacuuuucccuacccucgagcgcguccuacaccuaccgccgccaacuacaaaacccggccaacgagcaagagaaaauccccuuccaccuccaaauauccaaacaaguaauccaugccgaaauacagcaccucggucacuggauggacgcgacauucaaccuaaaaaccgcauuccacugcuauggauccugcgaaaaauacgccuauccguggcaaacagccggcugcuuuaucgaaaaagauuacgaauacgaaacaggguggggaugcaaucccccugacugccccggcguuggcaccggaugcaccgcuuguggcgucuaccuggacaaacucaaaagcguagguaaaguauucaaaauuguuucucucaaauacacccgcaaaguaugcauccagcucggcaccgaacaaaccugcaaaacaguagacagcaacgauugccuuaucacaacaucggucaaaguuugcaugauaggaaccauaucaaaauuccaaccgagcgauacucugcugauccucggcccacugcaacaaggaggacucaucuucaaacaauggugcacaaccacaugccaguucggagaucccggcgacaucaugucgacccccacaggcaugaaaugccccgaacuaaacggcaguuuccgcaagaagugcgcauucgccacaacacccgugugccaguucgacggaaacaccauuuccggcuacaaacgcaugauagccacaaaagacucguuccaaucauucaauguuacagaaccccauaucucagccagcgcacuugaauggauugaccccgacuccagccuccgcgaccacauaaacguagucgucggccgcgaccucagcuuccaagaccuaucggaaacacccugucagguagaccuaaugacaagcacgaucgacggcgcuuggggcucaggcguaggcuucaaccuugucugcacugugucucucacggaaugcuccgccuuccuuacuuccauaaaagccugcgacagcgccaugugcuaugggagcacaacagccaacuuagucaaagggcaaaacacaguacacaugguaggaaagggaggccacucagggucuaaauucaugugcugccacgacaccaaaugcagcagcaccggccuaguggcggccgccccacaccucgaccgggucaccggcuacaaccaggcagacuccgacaagaucuucgaugauggcgcaccagaaugcgggaugagcugcugguucaagaagucaggagaauggauucucggcguccucaacggcaacuggaugguagucgcaguucuuaucgcccuacucauccucuccauccucauguucacacucugcugccccagacgacccuccuaccggaaagaacacaaacccuaa

SEQ ID NO: 15076 - RNA, 3447 nt, Artificial Sequence
  derived and/or modified CDS sequence (opt11) from PUUV(CRF308/Omsk)__AF442617.1__GP
augggaaaacugucccccgucugccuguaccuccuauuacaaugccuccuacucggggaccgaggcgacgcacgaaaccuaaacgaacuaaaaauggaauguccccacaccaucggucucggucaaggccucgucgucggauccgucgaacugcccccaguaccgauucaacaggucgaaucccucaagcuggaaucuucaugcaacuucgaccuccacaccucaaccgccggccaacaaucuuuuacgaaauggacaugggaaauuaagaacgaccucgcagagaauacccaagcauccuccaccucauuccaaacaaagucaucugaagucaaccugcgagggcuaugccucauaccaacacuggucgucgaaaccgccgcccgcacacguaaaaccaucgcuugcuaugaccugacaugcaaccaaacugucugccaaccaaccgucuaucucaugggcccaauacagaccugcaucacaacaaaauccugccuccucggccugggggaccaacguauucagguaaacuacgagaaaacauacugcgucuccggccagcuaguggaaggggucugcuucaaccccauacacaccauggcccucucccaaccaucucacacauacgauguaaugacacucaugguccgaugcuuccucauaauuaagaaagucacaucaggggacagcaugaaaauagagaaaaauuucgaaacgcucguucagaaaacaggaugcacaggcaacaacuuccagggauacuauauaugccuaaucggauccucaucagaaccacucuacguacccacccuggacgacuacagauccgcagaagugcuaucacgcauggcauucgcuccccauggcgaagaccacgacauugagaaaaacgcagucucgacaaugcgaauugcgggcaaagucgccggccgagccccaucuaccgaagccuccgacacaguacagggcauagccuucagcgguucaccccuguacaccuccaccggcguacucacagcaaaagacgaccccgucuacauuugggcgcccgggauaaucauggaagguaaccacuccagcugcgacaaaaagacucucccauuaacguggaccggcuucauaucccuaccuggcgaaaucgagaaaacuacacaauguaccguauucugcacccuugcaggccccggcgccgacugcgaagcguacucggaaacuggcauauucaacauauccucgccaaccugccucaucaaccggguccaaagauuccggggagcagaacaacaaaucaaauucgucugccagcgagucgacauggauaucauuguguacugcaacgggaucaagaaggucauccuaaccaaaacccuugugauaggccaaugcaucuacacauucaccuccaucuucagucucaucccaggcaucgcgcacucacuagcagucgaacuaugugucccaggacuucaugguuggacuaccaugcuacuccuccucacuuucugcuucggcuggguacuaauaccauucauaacaaugauucuccugaaaauccucaucgcguucgccuaccuaugcucaaaguacaacaccgacagcaaauuucgcauucuaguagaaaaagucaagaaagaauaccagaaaaccauggguuccaugguuugcgaaguaugccaauacgaaugcgaaacagccaaagaacuagagucccaccgaaaaagcuguagcauaggaagcugcccauacugccucaaccccuccgaagccacaaccuccgcacuacaagcgcacuucaaggucugcaaacuuaccucucgauuucaagaaaaccucagaaaaucccucaccgucuacgaaccuaugcaaggcugcuaccgcacccucucacucuuccgauaccgcuccaaauucuucgucggccuaguauggugccuccuacuggucauggagcuaauuguaugggcagccucugccgagacccaaaaccucaauucuggcuggaccgacacagcacacggcucaggcaucauccccaugaagacggaccuagaacucgacuucagccuucccucauccgcauccuacaccuaccgacgucaacuccaaaaccccgccaacgaacaagagaaaauucccuuccaucugcaaauauccaaacaagugauacaugccgaaauacagcaccugggccauuggauggacgcaaccuucaaccuaaagaccgccuuccauuguuauggcagcugcgaaaaauacgccuacccguggcagaccgccgggugcuucauugaaaaagacuacgaauaugaaaccgguuggggcugcaauccacccgacugucccggcgucggaaccggauguaccgcuugcggcgucuaucucgacaaacuuaaaucggugggcaaaguauuuaagauaguaucucuuaaguacacccgaaaagucugcauacagcugggcacggaacaaaccugcaaaaccguagacagcaaugauugccugauaaccacaagcgucaaagucugcaugaucggcaccaucuccaaauuccaacccuccgacacccuacuuuuucucggaccccuccagcaaggcggcuuaauuuucaaacaauggugcaccaccacuugccaguuuggagaccccggggacaucaugucaacgcccacaggaaugaagugcccagaacuaaacggaucauuccgcaagaaaugcgcauucgcaaccaccccuguuugccaauucgacggcaauaccaucuccggauauaaacgcaugauugccaccaaagacuccuuccaaucguucaacgucacagaaccccacauuagcgcaucagcccuugaguggaucgaucccgacuccucauuacgggaccauaucaacguggucguaggacgagaccucuccuuccaagaucuaucagaaaccccgugccaaguagaccugaugaccuccacaauagacggcgccuggggaagcggugucggcuucaaccuaguuugcacuguaagucucacagaaugcagcgcuuucuuaaccagcauaaaagccugcgacuccgccaugugcuacggauccacuaccgcuaaccuuguccgcggccaaaacacuguccacaucguugggaaagggggccacagcggcaguaaauucaugugcugccaugacaccaaaugcucuagcacaggcuuaguugccgcugcaccccaccucgaucguguaacagguuacaaucaagcagacagcgacaagauauucgacgacggcgccccugagugcggcauguccugcugguucaagaaauccggcgaguggauacucggcguuuuaaacggcaacuggauggugguggcggugcuaaucgcgcuccucauacuauccauccuaauguucacacucugcugcccacgucgcccuuccuaucguaaagaacacaaaccuuag

SEQ ID NO: 15077 - RNA, 3447 nt, Artificial Sequence
  derived and/or modified CDS sequence (opt11) from PUUV(Mu/07/1219)__KJ994777.1__GP
auggagaaaaucauucccguaugccuauaccuacccuuucuaugucuacuacucuggucccguggagacacacgcaaccucaacgaacucaaaauggaaugcccacacaccaucgggcuaggccaagggcucgucaucggauccauugaacuacccccaguaccacucauacaaguagaaucucucaaacucgaaagcucgugcaacuucgaucuucacaccucaaccucuagccagcaagccuucacgaaauggacaugggaaguaaaaucugaccuugccgaaaacacccaagcauccuccacuucauuccaaaccaaauccucagaagucaaucuacgaggccuaugccucguacccccucugguaaucgagaccgcugccagaacgcggaaaacuauagcaugcuucgaccuauccugcaaccaaaccacaugucaaccaacugucuuccuaaugggcccgauccagacuugcauaacgacuaaauccugucuccuuggccucggcgaccaaaggauacaaguaaacuacgagaaaaccuauugcgugucaggccagcucaucgaaggaauaugcuucaacccgguccacacaauggcacuaucucaaccaagccacacauacgacaucguaaccguaaugguccgcuguuuccucauagucaagaaaguuaccaccggcgacucaaugaaaaucgaaaagagcuucgaaacucucguacagaaaacaggcugcaccgauaacggcuuucaaggguacuacgucugccucaucgguucaucauccgagccauuauacauacccacucuagacgauuaccguagcgcugaaguccucagccgcauggcauuugcgccccacggcgaagaccaugacauugagaaaaacgcaaucuccgcgaugcggauugucgguaaggucacaggcaaagccccauccacggaaucauccgacacaguccaaggaauagccuucucaggcaauccauuauacaccagcacagguguccucacagccaaggacgacccugucuacguaugggcaccaggcauaaugauggaaggcaaccacuccgucugcgaaaagaaaacucucccacuuacuuggacaggcuucaucccucucccuggcgaaauugagaaaaccacccaaugcaccguauucuguacacuagcagggccaggcgcugacugcgaagcauauuccgaaacggguaucuucaacauuucuuccccgaccugccucaucaaucgagugcagcgcuucagaggcgccgaacaacagaucaaauucauuugccaacgagucgacauggacaucacaguauacugcaacggacuaaagaaagucauccuuacaaaaacucucgucaucgggcagugcaucuauacguuuaccagcauauucucacucaucccuggagucgcucacucgcuagccguugaacucugcgugcccggccuccauggaugggcgacaaugcuacuccuacugaccuucugcuucggguggauucucaucccauucuuugccaugauccuccuuaaaguccucauagcacuugcauaccucugcagcaaauauaacacggacucaaaauucaaaguccucaucgaaaaggucaagaaagaauaccagaaaacgaugggcagcaugguaugcgaagugugucaauacgagugcgaaacagccaaagaacucgagucccaccgaaaauccugccccaugggcucuugcccauauugccuaaaccccgcggaagcaacuacaagugcccuacaagcucacuuuaaaguauguaaacucacuucccgauuccaggacaaucuucgcaaauccuugggugcuuaugaacccaagcaaggaugcuacagaacgcuaucucuguucagauaccgcaguagauuuuucgucgguuucaucuggugccugcuucucguccuagaauuaauagucugggccgcaagcgcagagacgcagaaucucaacucaggcuggacagacaccgcgcauggcucaggcgucaucccaaugcguacagaccuagaacucgauuuuagccuccccaguuccgcauccuacaccuaccgcagacaacuccaaaaccccgcuaaugaacaagagaaaauaccguuucaucuccagaucucaaaacagguuauccacgccgagauacaacaccuaggccacuggauggaugguacguucaaccuuaagaccgcuuuccacugcuacggcuccugcgaaaaauacgccuaccccuggcaaacggccggaugcuucgucgaaaaagauuaugaguacgaaagcggauggggcugcaacccggccgacugcccuggcguaggaaccggaugcacagccugcggcguuuaccucgacaaacugaaaaguguagggaaagcauucaagauugucucccuccgcuacacacggaaggccugcauccagcuaggcaccgaacaaaccugcaaaaacgucgacuccaaugacugccuugucaccaccuccguaaaagucugccucaucggaacagucuccaaauuccagccauccgacacacuucucuucuugggcccccucgaacaaggcgguuugaucuucaaacaauggugcaccacaacuugccaauucggcgacccgggagacaucauguccacccccgucggaaugaaaugccccgaacuuucaggcuccuuccgcaagaaaugcgccuucgccaccacuccagucugccaauucgacggcaacacuauauccggauacaaacgcaugaucgcaaccaaagacagcuuccagucguucaacguaaccgaaccacauauauccgcuagcucacucgaauggaucgacccggacaguucacuccgggaccacauaaacgucauagucggacgggaccucuccuuccaagaccucuccgaaacacccugccaagucgacuuaacaaccacgucgauagauggagcauggggaucaggcgugggcuucaaccucauaugcucagucucgcucacagaaugcagcaccuuccucaccucgaucaaggcuugcgacuccgcuaugugcuacggcagcaccaccgcuaaccuaguacgaggacaaaacacaguccacaucgucgguaaaggcggccacuccggcagcaaauucaugugcugccaugacacaaaaugcagcagcaccggccuagucgcagccgcaccgcaucucgacagagucaccggcuacaaccaagcggacuccgacaaaaucuucgaugacggagccccagaguguggcaucucaugcugguuuacaaaauccggcgaauggauccuuggcguccucaacggaaacuggauggucguagcaguccuagucgcccucuucauccucagcauauuccucuucacucuaugcuguccucgucgacccagcuacgccaaagaacacaaacccuaa

SEQ ID NO: 15078 - RNA, 3447 nt, Artificial Sequence
  derived and/or modified CDS sequence (opt11) from PUUV(Puu/Kazan)__Z84205.1__GP
augggaaaacuuagucccgucugucuuuaucuacuacuacaaggccuauugcucuuuaacaccggaacagcacgcaaccuaaacgagcuaaaaauggaguguccccacaccaucggacuugggcaaggucucguagucggauccguugagcugcccccaguccccauccagcaagucgagacacucaagcucgaauccucauguaacuucgaccuucacaccuccaccgccggacaacaagcauucaccaaguggacaugggagaucaaaggcgaccuugcggagaacacucaagcgucuagcaccucuuuccagaccaaaagcuccgaagucaaccuacgagggcuuugccucaucccaacccuugucaucgagacagcagcacggaugcgaaaaacaaucgcguguuacgaccucagcugcaaccaaaccgugugccaacccaccguguaccucaugggcccgauacagaccugcaucacaaccaaauccugucuacucggacuaggagaccaacgcauacaaguaaauuacgagaaaaccuacugcgucagcggucaacucgucgaagguguuugcuucaaccccauccacaccauggcccuuucccaacccucgcauaccuacgauauagugacaaugauggucaggugcuuucucguuauuaagaaagucacguccggcgacuccaugaaaauagagaaaaacuucgaaacgcucguacagaaaaacggcugcacggccaauucuuuucaaggcuacuacauaugccuaauaggcagcucaucugaaccucucuauguacccacccuagacgacuaucggagcgccgaaguacucucccggauggccuuugcuccccacggugaagaucacgaugucgaaaagaacgccauauccgcccuucguaucgccggcaaagucacaggaaaagcuccauccacugaaucauccgacacaguccaaggcgucgcguucuccggcucgccacuuuacacguccaccgguguucuaaccgccaaggaugacccgguauacauuugggcccccggcaucaucauggaaggaaaccacucgguuugcgaaaagaaaacgcucccgcuaacauggacgggcuucaucucgcuccccggcgaaaucgagaaaaccacgcagugcacagucuucugcacccucgcuggccccggagccgacugugaagcauacucagaaacuggcauauucaacaucuccucaccgaccugccuaauaaacagaguacaacgauuccgcggagccgaacaacaaauaaaguucguaugccagcguguggacauggacaucacagucuacugcaauggggucaagaaagugauccuaaccaagacacuggucauaggucagugcauauacacauucacauccauauucagccuaauccccggugucgcacacucccuagccgucgaacugugcgugccaggccuccacggcugggccacaaugcuacuccuccugaccuucugcuuugguuggguucucaucccgacaaucacaaugauccuacuaaagauccuuaucgccuucgccuaccucugcucaaaauacaacaccgacaguaaauuucgcauccucauugaaaaagucaagaaagaauaccagaaaacaaugggcagcauggucugcgaagucugccaauacgaaugcgaaaccgccaaagaacucgagagccaccgcaaaucauguuccaucggauccugccccuauugccucaaccccagcgaagcgacaacauccgcgcuucaagcucacuuuaagguaugcaaacucacaagccguauacaagaaaaccugcgaaaaucacuuacaguauacgaaccgaugcaaggaugcuaccggacccuaucccucuuccgauaccgcucacgauucuucgucggccuagucuggugcgugcuccucguccucgaacucauagucugggccgccucagccgaaacacaaaaccuaaacgccggcuggacagacaccgcacacgggagcgggaucaucccaaugaaaaccgaucuagaacucgacuucucacuacccagcuccgccuccuacaccuaccguaggcaacugcaaaacccugcuaacgaacaagaaaacauucccuuccaccuacaaauaagcaaacaaguaauccaugcagagauccaacaccuaggccacuggauggacgcgaccuucaacuugaaaacggccuuucacugcuacggcagcugcgaaaaauacgccuaccccuggcaaacggccggcuguuucgucgaaaaagacuacgaauacgaaaccgguuggggcugcaacccgccagacugcccaggaguugguaccggguguaccgccugcggagccuaucucgacaaacuaaaauccguaggcaaaguguucaagaucguaucccuacgcuacacccgaaaagucugcauccaguuaggaaccgaacaaacaugcaaaacagucgacagcaacgacugcuuaaucacaaccucagugaaaguaugccucaucggcacaauaaguaaauuccaacccucagacacgcuccucuuccuaggaccccuccagcaaggcgggcuaauauucaaacaaugguguacaacaaccugccaauucggagaccccggcgacaucauguccaccccaaccggaaugaaaugccccgaucuaaacggcagcuucagaaagaaaugcgccuucgcaaccaccccaguaugccaauucgacggaaauacaaucucaggcuacaaacgcaugaucgcaacaaaagauaguuuccagucuuuuaaugucaccgaaccccacauaucagcgagcgcacuagaauggaucgacccagacagcagccucagagaccacaucaacguuauaguaucucgcgaccucagcuuccaagaucuauccgaaacgcccugccagaucgaccucagcacagcaagcaucgauggcgccugggguagcggcguaggguucaaccucgucugcaccguuucacuaaccgaaugcucugcauuccugacuuccaucaaagccugcgaugcagccaugugcuacggcucaaccaccgcuaaccuaguacgcggucagaacaccauccacaucgucggcaagggcggucacuccggaagcaaauucaugugcugccaugacaccaaauguucgaccacgggccuaguugcagccgcgccccaucuagacagggucacuggcuacaaccaagcugauucugacaaaauauuugacgacggagcacccgaaugcggaauguccuguugguucaagaaaucaggugaguggauccuagggguucucaacggaaauuggauggugguagccguccucauugcgcuccuuauccucagcauacucuuauucacccucugcugcccccgacgcccuucguaccggaaagaacacaagcccuga

SEQ ID NO: 15079 - RNA, 3447 nt, Artificial Sequence
  derived and/or modified CDS sequence (opt11) from PUUV(PUUV/Ardennes/Mg156/2011)__KT247603.1__GP
augggaaaaauaauccccguuugccucuaccuacuuuuccugugucuccuacuaugggaccggggcgacaccagaaaccucaaugagcuuaagauggaaugcccccacacaaucggacuaggacaaggcuuagucaucggcucaguggaacuuccacccguaccccucacccagguggaaucccugaaacuugaaagcuccugcaacuucgaccuccauacaucgacaucaagccagcaaaguuucacaaaauggacaugggaaaugaaggucgaucucgcagaaaacacccaagccucaucaaccucuuuccaaaccaaaucaucugaaauaaaccuccgcgggcugugccucguacccccgcucgucauagagaccgccgcacgaacacgcaaaacuaucgcaugcuucgaccuuagcugcaaccaaaccgcgugccaacccacagucuuccuaaucggcccgauccaaaccuguauuacaaccaaaucgugccuccuaggccuuggcgaucagcgcauccaagucaacuacgagaaaaccuacugcguaucuggccagcuaguagaagggaucugcuuuaacccgguccacaccauggcacucucccagcccucccacaccuacgacaucgucacagucaugguccgaugcuuccucaucgucaaaaaggucuccaccggcgacuccaugaaacuagaaaagucauucgaaacacucguccagaaaacaggcugcaccggcaacggguuccaaggauacuacguaugccuaauaggauccuccuccgaaccgcucuacaucccgacgcucgacgauuaccgauccgccgaaguacuaucccguauggccuucgcgccacacggcgaggaccacgacauugagaaaaacgcaauauccgccaugcggaucgucgguaaagucacaggcaaagcaccgagcaccgaaucauccgacaccguacaaggcauagcauucucagguaacccccucuacacauccacuggcguccugacggccaaagacgaucccauuuacauaugggcccccgggaucauaauggaggggaaccacucuguaugugacaagaaaacgcucccacuaacauggacaggcuuuauaccccuacccggcgagaucgagaaaacaacgcaaugcaccguauucugcacccucgccggccccggagcggacugcgaagccuacucagaaacaggcauauucaacaucucaucacccacaugucucaucaaccgcguacaacgauuccgcggcgccgagcaacaaaucaaauucauaugccaaagaguagauauggacaucaccguuuacuguaacggacucaagaaaguaauacuaaccaagacccuagucaucggucaauguauauacaccuucacauccauuuucucccugauccccggcgucgcucauucccucgccguagagcuaugcgucccagggcuccauggaugggcgacaauguuauuacuucugaccuucugcuucggcuggauccugauacccuucuuuucaaugauacuccuaaaaauucuaaucgcauuugccuaccuaugcuccaaauacaacacagacaguaaauuuaaaauccucaucgaaaagguaaagaaagaauaccagaaaacgaugggauccauggucugcgaagucugccaauacgaaugcgagacagccaaagaacuggaaucccaucgcaaaagcugccccaugggauccuguccauacugccugaauccagcggaagccaccaccagugcacuacaagcccauuucaaagucugcaaacuuacgucgcgcuuccaagacaaccuucgcaaaagccuaggcgccuacgaacccaagcaaggcugcuaccgcacccuuucccuuuuuagauaccgcucccgcuucuucguaggcuucaucuggugcuuccuccuuguacuggaacuaaucguuugggcagcauccgccgaaacccaaaaucucaacucaggauggaccgacacagcccauggcagcgggaucauacccaugcguaccgaccucgaacucgacuucucccuccccucgucagcgaguuacaccuaccgucgacaacugcaaaaccccgcuaacgaacaagagaaaaucccguuccaucugcaaauaagcaaacagguaauccacgcagaaauccaacaccuaggucacuggauggacggaacauucaaccuuaaaacggccuuccacugcuacggcuccugcgaaaaguacgcauaucccuggcaaacagccggcugcuucguagaaaaagauuacgaauaugaaucaggcuggggcugcaauccaccagacugcccaggcgucggcaccggaugcacagcgugcggcgucuaucuugacaaacugaaauccguaggcaaagccuuuaaaauagugucccugcguuacacacggaaagcauguauucagcucggaacagaacagaccugcaaauccguagacuccaaugauugccuaguaaccaccucugucaaagucugccuuauugggacugugagcaaauuccaacccuccgacacgcucuuguuccucggaccgcucgagcaagggggccuuaucuucaaacaguggugcacuacaaccugccaauuuggcgacccaggagacauaaugucuacccccgucggcaugaagugccccgaauuaagcggguccuuccgcaagaaaugugccuuugccacaaccccggucugucaauucgacggcaauacccucuccggauacaaaagaaugaucgcgacgaaggauucuuuccagagcuucaacguuaccgagccccacaucagcgccagcagccucgaguggauagaucccgauucgucccuacgcgaccacaucaauguuaucgucggccgagaccuuucauuccaagaccuuuccgaaacacccugucaagucgaccucgccaccucaucgauagacggagccuggggaagcggcguaggguucaaccuaguaugcagugucucccucacugaaugcuccacuuuccuaacguccaucaaggccugcgacagcgccauguguuacggauccacgacagcgaaucucuugcgcggacaaaacaccguacacauagucgguaaaggcggacacucuggaucaaaauucaugugcugccacgacaccaagugcuccagcaccggccucguugcagccgcgccccaccucgaccgcguuaccgguuacaaccaagccgacuccgacaaaauuuucgacgacggugcacccgaaugcgggauauccugcugguucacgaaaagcggcgaauggauccucggcguauugaacggaaacuggaugguaguggcaguccucguagcccuauucauccugagcauauuccuuuucacccucuguugcccccgacguccaucauacgccaaagagcacaaaccuuaa

SEQ ID NO: 15080 - RNA, 3447 nt, Artificial Sequence
  derived and/or modified CDS sequence (opt11) from PUUV(PUUV/Ardennes/Mg75/2011)__KT247602.1__GP
augggcaagauaauccccgugugccuguaccuccuguuccugugccuucugcugugggaccgcggggacacccggaaccucaacgagcugaagauggagugcccgcacacuauaggccuggggcagggccucgugaucggaucgguggagcugccgcccgugccccugacgcaggucgagucccucaagcuggagagcaguugcaacuucgaccuacacaccuccaccuccagccagcaguccuucaccaaguggacgugggagaugaaggucgaccucgccgagaacacccaggccagcuccacgagcuuccagaccaaguccagcgagaucaaccugcgcggccugugccuugugccgccccucgucaucgagacggcggcccggacucgcaagaccaucgccugcuucgaccuguccuguaaccaaaccgccugccagcccacgguguuccucaucggacccauccagaccugcauuaccaccaagagcugccugcuggggcucggcgaccagcggauccaggucaacuacgagaagacguacugcgucuccgggcagcuggucgagggcaucugcuucaaccccgugcacaccauggcccugucucagcccucucacacguacgacaucgucaccgugauggugcgcugcuuccucaucgucaaaaagguguccaccggggacuccaugaagcuagagaaguccuucgagacccuggugcagaagaccggcuguaccggcaacggguuccaaggcuacuacgucugccugaucgggagcucuagcgaaccccuguacaucccgacgcuugacgacuaccgguccgcggagguucugagccgcauggccuucgcuccgcacggcgaagaccaugacaucgagaaaaacgccaucucagcgaugcggaucgugggcaaggucaccgggaaagccccuagcaccgaauccucggacaccgugcagggcaucgccuuuuccgguaacccccuguacacgucgacuggcgugcugaccgccaaggaugaucccaucuacaucugggccccggggaucauaauggagggcaaccacuccgucugcgacaagaaaacccucccccugacguggaccggauucaucccccugcccggggagaucgagaagacaacacagugcacuguguucugcacccuggcuggcccgggggccgacugcgaggccuacagcgagaccggcaucuucaauaucuccagucccacuugccugaucaaccgcguccagcgguucagaggggccgaacagcagaucaaguucaucugccaacggguggacauggacaucaccguguacugcaacggccugaagaaggucauucucacaaaaacccuggugauaggucagugcaucuacaccuucacguccaucuucagcuuaauccccgggguggcccacucccucgcgguagaacugugcgugcccggacugcacgggugggcgacaaugcuccugcugcugaccuucugcuucggcuggauccucauucccuucuucagcaugauccugcugaagauccucaucgccuucgccuacuugugcuccaaguacaacacggacagcaaguucaagauucucaucgagaaggugaagaaggaguaccagaagaccauggggucuauggucugcgaggucugccaguacgagugcgagacggccaaagagcucgagucccaccgcaagagcugccccaugggcuccugccccuacugccugaaccccgcggaggccaccacgagcgcccugcaggcccacuucaaggugugcaagcucacgucccgguuccaggauaaccuaagaaagagccuuggcgccuacgagccgaagcaggggugcuaccggacgcucucccucuuccguuacagaucacgcuucuucgucggcuucaucuggugcuuccugcucgugcuggagcugaucgugugggcggcauccgccgagacccagaaccucaacagcggguggaccgauacugcccacggcuccggcauaauccccaugcgcacggaccucgaacuggacuucagccuccccuccagcgcgagcuacacguaccgccgccagcugcagaacccugccaacgagcaggagaagauacccuuccaccuccagaucagcaagcaggucauccacgccgagauccagcaccuggggcacuggauggacggcaccuucaaccugaagaccgccuuccacugcuacggguccugcgagaaguacgccuaccccuggcagacggcggguugcuucgucgagaaggacuacgaguacgaaagcggguggggaugcaacccgcccgacugccccggcguggggaccggcugcaccgccugcggggucuaccuggacaagcucaagagcguggguaaggccuucaagaucgugucccuaagguacacgcgcaaagccugcauccagcuggggacggaacaaaccugcaagagcgucgacuccaaugacugcuuagugaccacaagcguuaaagugugccugaucggcacaguguccaaguuccagcccagcgacacccuccuguuccuggggccccuggagcagggcgggcucauuuucaagcaguggugcaccaccacgugccacuucggggacccgggcgacaucauguccacccccgugagcaugaagugucccgagcuguccggcagcuuccggaagaagugcgccuucgcaaccacccccgucugccaauuugacggaaacacccuguccggauacaagcgcaugaucgccaccaaagacagcuuucaauccuucaacgucaccgagccgcacauuagcgccaguagccucgaguggaucgaccccgacuccagccugcgggaccacaucaaugugaucgucgggcgcgacuuauccuuccaggaccucagcgagacccccugccaaguggacuuagcgaccucguccaucgacggcgcgugggggagcggagugggguucaaccuggucugcucagucagccucacggaauguuccaccuuccugaccagcaucaaggcuugcgacucugccaugugcuacggcagcaccacggcuaaccugcuccggggccagaacaccgugcacauugucgggaaaggcgggcacucagggagcaaguucaugugcugccacgacacuaagugcuccagcaccggcuuggucgccgcggcgccucaccuggaccgugugacgggguacaaccaggccgacuccgauaagaucuucgacgacggcgccccggagugugguaucagcugcugguucaccaaaucuggugaguggauacucgggguccugaacggcaacuggauggugguggcgguucugguggcccucuucauccugagcaucuuccuguucacucucugcugcccacggcgcccauccuacgccaaggagcacaagcccuga

SEQ ID NO: 15081 - RNA, 3447 nt, Artificial Sequence
  derived and/or modified CDS sequence (opt11) from PUUV(PUUV/Jura/Mg2/2010)__KT247598.1__GP
augggcaagaucauccccgugugccuguaccuccuguucuuaugccuccugcuguggaaccgcggggacacgcggaaccucaacgagcuaaagauggagugcccgcauaccaucggccuggggcagggccucgucaucgggagcguggagcugccgcccgugccccuaacgcagguagagagucucaagcuggagagcuccugcaacuucgaccugcacaccagcaccuccagccagcagucauucaccaaauggacgugggagaugaagagugaccucgccgagaacacccaggccagcagcaccuccuuccagaccaagagcuccgaaaucaaccuacgggggcugugccucgugccgccccuggugaucgagacggcggcccggacccgcaagaccaucgccugcuucgaccugagcugcaaccagaccgccugccagccaacggucuuccuaauaggccccauccagaccugccugaccacgaaguccugccugcucgggcugggcgaccagagaauccaggugaacuacgagaagacguacugcgugagcgggcagcugguagagggcgugugcuucaaccccauccacaccauggcccucucccagcccucgcacaccuacgacaucgugaccguaauggugcgcugcuuccugaucgugaaaaaggucuccacgggugacagcaugaagauagagaaguccuucgagacguuggugcagaaaacaggcugcaccggcaacggguuccagggcuacuacgugugccucaucgguucgagcuccgagccccuguacauccccacguuggacgacuaccggagcgcggagguccucucccgcauggccuucgccccgcacggagaggaccacgacaucgagaagaaugccaucagcgcgaugcggaucgugggcaaagugaccgggaaggcccccuccaccgagaguagugacaccguccagggcaucgccuuuagcgguaacccccuguacacguccaccggggugcugaccgccaaggacgaccccaucuacaucugggcgccggggauaaucauggaagggaaucacagcgugugugaaaagaagacuuugccccugacguggaccggcuucaucccccugccgggggaaaucgagaagaccacccagugcacagucuucugcacccucgcgggcccgggggccgacugugaggccuacuccgagaccggcauuuucaacaucagcuccccgaccugccugauaaaccgugugcaacgguuccgcggugcugagcagcaaaucaaguucauuugucagcgcgucgacauggacaucaccguguacugcaacggauuaaagaaagucauccucaccaaaacccuggucaucggccaaugcauuuacaccuucaccagcaucuucucccugauccccgggguggcccauagccuugcgguggagcuuugcguccccggccuccacgggugggccacuaugcugcugcugcugaccuuuugcuucggcuggauccucauacccuucaccgccaugcugcugcucaagauccugaucgcuuucgccuaccuguguucgaaauacaacaccgacagcaaguucaagauccucaucgaaaaggugaagaaggaauaccagaagacgauggggucuauggugugcgaggucugucaguacgagugcgagacagcgaaggaacuagaaucccaccggaaaagcugccccaugggcuccugccccuacugccugaaccccgccgaagccaccaccagcgcccuccaggcccauuuuaaggugugcaagcugacguccagauuccaggauaaccugcgcaagagccucggcgcguacgagccgaagcaggguugcuaccgaacccugucccuguuccgcuaccggagccgcuucuucgucggccucgucuggugcuuccugcuagugcucgagcugaucauaugggccgccuccgcagagacccagaaucugaacucggguuggaccgacacggcccacggcuccggcgugauccccaugcggaccgaucucgagcuugacuucagccugcccuccagcgcauccuacaccuaccgccgccagcuccaaaacccggccaacgaacaggagaaaauccccuuucaccuccagauaagcaaacaggucauccacgcggaaauccagcaccuggggcacuggauggacggcacuuucaaccugaagacagccuuccacugcuacggguccugugagaaguacgcuuaccccuggcaaaccgccggcugcuucguugagaaggacuacgaguacgaaagcggguggggcugcaacccgcccgauugccccggcguggggaccgggugcaccgccugcggggucuaccuggacaagcucaagagcgugggcaaagccuuccggaucguaucccugaaguacacgcgcaaggccugcauccagcuggggacggaacagaccugcaagucagucgacuccaacgauugccuggugaccacgagcgugaaggucugccucaucggcaccguuuccaaguuucagcccuccgacacacugcuguuccucggaccccuggaacaaggcgggcugaucuuuaaacaguggugcaccacgaccugucaguucggggacccgcgggacaucauguccacacccguaggcaugcgcugccccgagcucagcggguccuuccggaagaagugcgcguucgccaccacgcccgucugccaauucgacgguaauaccaucucuggcuacaagcgcaugaucgccaccaaggacuccuuccaaucguuuaacgugaccgaaccgcacaucuccgccucgucccuggaguggaucgaucccgacagcucccugcgggaucacauaaacgugaucgucgggcgcgaucucagcuuccaggaucuuuccgagaccccuugccagguggaucuaacgaccaccagcaucgacggcgccugggggagcggugugggguucaacuuaaucugcagugucagcuuaaccgagugcuccacguuccugaccagcaucaaagcgugcgacuccgccaugugcuacggcagcaccacggccaaccucaugcggggccagaacacgauccacauuguggggaaggguggucacuccggcucaaaguucaugugcugccacgacaccaagugcuccuccaccggccugguggccgcggcgccccaucuagaccgcgucaccggguacaaccaggccgacagcgauaagaucuucgacgacggcgcaccggagugcgguaucagcugcugguucacuaaguccggagaauggauccuggguguccuaaacggcaacuggaugguggucgcugugcuggucguccucuucauccugagcaucuuccuguucacccucugcugcccacggagacccuccuacgccaaggagcacaagccguag

SEQ ID NO: 15082 - RNA, 3447 nt, Artificial Sequence
  derived and/or modified CDS sequence (opt11) from PUUV(PUUV/Jura/Mg214/2010)__KT247599.1__GP
augggaaaaauaauccccgucugccucuaccuacuguuccuaugccuccuacuauggaaccgaggagacacccggaaccuaaacgagcuaaaaauggaaugcccgcacaccaucggccugggccaaggccuagucaucggaucgguagagcuaccacccgucccacugacacaaguagaaucgcuuaagcucgaaagcagcuguaacuuugaccuacacacaagcaccagcagucaacaauccuucacuaaauggaccugggaaaugaaaucagaccucgccgaaaauacccaagcauccucaaccagcuuccaaacaaaaagcucagaaaucaaccuacgaggccucugccuaguacccccucuugucaucgagacggcagcgcgcacuagaaagacaauagccugcuucgaccuuucaugcaaccaaaccgccugccaacccaccgucuuccucaucggaccuauacaaaccugccuaacaacaaaaagcugccuacucggucucggcgaccaacgaauccaagucaacuacgagaaaaccuacugcgucucgggacaacugguagaaggcgucugcuucaacccuauacauaccauggcgcuaucccaaccgucccacacguaugacaucgucaccguaaugguccgcugcuuccuaauagucaagaaaguuuccaccggcgacuccaugaaaaucgaaaaaucuuucgaaacguuaguccaaaagaccggauguacgggcaacggauuccagggcuauuacgucugucuuaucggaucauccuccgaaccgcuguacaucccuacacucgacgacuaccgaagcgccgaaguccucagccgcauggcacucgcuccccacggagaagaccacgacauagagaaaaaugccaucagugcuaugcggauagugggaaaagucaccggcaaagccccaucaaccgaauccuccgauacaguccaggggauagcguucucaggaaauccucucuacacaagcaccggcguccucaccgcaaaagacgacccuaucuacauaugggccccgggaaucaucauggaaggcaaucacucaguaugcgagaaaaagacccuaccacuuaccuggaccggcuucaucccccuccccggugaaaucgagaaaaccacacaaugcacggucuucugcacucucgccggcccaggcgccgauugcgaagccuacagcgaaacaggaaucuucaacauaaguucccccaccugucucaucaaccgcguacagcgauuccggggagccgaacaacaaaucaaauucauuugccagcgcgucgacauggacaucacaguguauugcaacggccucaagaaagugauccucaccaaaacucucguaaucggacaaugcaucuacacauucacuucaauuuucagccuuauaccaggggucgcccacagccuugcuguagaacucugcgucccuggucuacacgggugggcuacuaugcuacuauugcucacauucugcuucggguggauccuaauccccuucacugcaaugcugcuacucaaaauacucaucgccuuugccuaccuaugcuccaaauacaauaccgacagcaaguucaaaauccuaaucgaaaaaguuaagaaagaauaccauaaaucaauggguuccauggucugcgaaguuugccaauacgaaugcgaaacggcuaaagaacuagaaucacaccgcaaaucgugccccaugggaaguugucccuacugccuaaaccccgcagaagcgaccacaucagcacuacaagcucauuucaaagucugcaaacugaccaguagauuccaagacaaccugcgaaaaucucucggggccuacgaacccaaacaaggcugcuaucguacucuaagccucuuucguuaccgcucacgauucuucgucggacuugucugguguuuccuacugguucucgaacucauaaucugggccgccuccgcagagacucaaaaccucaacucaggcuggacugacaccgcccacggcagcggcguaauccccaugcguaccgaccuagaacuagacuucucgcugcccucaucagccucauacacauacagacgccaacuccagaacccugccaacgaacaagaaaagauuccuuuucaccuccaaaucagcaaacaggucauccacgccgaaauacaacaccucggacacuggauggacggaaccuuuaaccuuaaaacagccuuccacugcuacggaagcugcgaaaaauacgcauacccauggcaaaccgccgguugcuucgucgaaaaggauuacgaguaugaauccggauggggcugcaacccacccgacugccccggagugggaacaggguguacagccugcggggucuaccucgacaaacuaaaauccguuggaaaagccuuccguauaguaagccuaaaauacacacgcaaggcaugcauccaacuaggcacagaacaaacaugcaaaagcguagauagcaacgacugccucgucacaaccagcguaaaagucugucuaaucgggaccgucagcaaguuccagcccuccgacacccuccuauuccuagggccccucgagcaaggaggucuuaucuucaagcaauggugcacuaccacaugccaauuuggagaccccggagacaucaugucaacaccaguaggaaugagaugccccgaacuguccggguccuuccgcaaaaagugcgccuuugcaaccaccccggucugccaauucgacgguaacaccaucuccggcuacaaacgcaugaucgccacaaaagauucauuccaaucauuuaacguuacugaaccucacaucagcgccucaucccucgaauggaucgacccugauagcucccucagagaccacauaaaugucauaguaggacgcgaucucagcuuccaggaccuauccgagacccccugccaggucgaucuuacaacaaccucuauagauggcgcuuggggcuccggcgucggcuucaaucucauaugcucaguaucacucacagaauguagcaccuuccugaccagcaucaaagcaugcgauuccgccauguguuacgggagcaccaccgcaaaucucaugcgcggccaaaacaccauccauaucgucggcaagggugggcacagcggaucaaaauucaugugcugccacgauacaaaguguuccucaacaggccugguagcugccgcaccccaucuugaucgggucacgggauacaaccaagccgacucggauaaaauauuugacgacggagcccccgaaugcggcaucucuugcugguucacaaaaucaggagaauggauccucgggguccucaacggaaacuggauggucgucgcuguccucguaguacucuucauccuguccaucuuccucuucacgcucugcugcccgcgccgaccuuccuacgccaaagaacauaagccguag

SEQ ID NO: 15083 - RNA, 3447 nt, Artificial Sequence
  derived and/or modified CDS sequence (opt11) from PUUV(PUUV/Orleans/Mg23/2010)__KT247600.1__GP
auggguaagauaauaccggugugucuguaccuccuguuccgcugccugcuuuuaugggaccgggggaacgcccgcaaccugaacgagcucaagauggaaugcccacacaccaucggccuggggcagggccuggucauuggcucaguggagcucccacccgugccacugacccagaucgaauccuugaagcucgagucauccugcaauuucgaccuacacacgaguaccuccagccagcaguccuucaccaaguggaccugggagauaaaaucggaccuggccgagaauacccaagcguccagcaccuccuuccaaaccaagucuagcgaggucaaccuccgaggccugugucuggucccgccgcucgugauugagaccgcagcccgcacaagaaagaccaucgccugcuucgaccuguccugcaaccagaccgccugccagcccaccguguucuugaucggccccauccaaacgugcaucacgacgaaauccugccucuuaggccugggggaccagcgcauccaggugaacuacgagaaaaccuacugcgugagcggacagcucaucgagggcaucugcuucaacccaguccauacgauggcgcugucccagcccucacacaccuaugauguggugacuguaauggugcgaugcuuccugaucgugaagaaggucucaaccggggacucaaugaagaucgagaaauccuucgaaacucucgugcagaagaccggcuguacaggcaacggguuccagggcuacuacgugugccuuaucggguccagcuccgagcccuuguauauccccacccucgaugacuacaggagcgcggagguccugucccggauggcuuuugcuccccacggcgaagaccaugacaucgaaaagaacgcgauaagugcaaugcguaucguuggaaagguuaccgggaaggcgccaucgaccgaggcgagcgacaccguccaggguaucgcguucucagggaacccccuguacaccagcacgggcguucuaaccgcgaaggacgaccccaucuauaucugggccccgggaaucaucauggagggcaaccacuccguaugcgagaagaagacacugccccugaccuggacaggcuucaucccccuccccggcgagauagaaaagaccacacagugcaccguuuucugcacucuggccgguccgggcgccgacugcgaagccuacagcgagaccggcauuuucaauaucagcagcccgaccugccugaucaaucguguccaacgcuuucgcggggcugagcagcagaucaaguucaucugccagcgggucgacauggauaucaccguguauugcaacggccuuaagaaggugauccuaacgaagacguucaucauaggccagugcaucuauaccuuuaccuccaucuucagccugauccccggggucgcccacucccucgccguggagcugugcguuccaggccugcacgggugggccaccaugcuccuguuacucacguucugcuucggcuggguccugauccccuucuucucuaugauccugcugaaaauccucaucgccuuugcguauuuauguuccaaguacaauacggauagcaaguuccggauccuaaucgagaaggugaagcgcgaguaucagaaaaccauggguuccauggugugcgaggucugucaauacgagugcgagacugccaaggaacucgagucccacagaaagucgugccccaugggcagcugccccuacugccugaaccccgccgaggccacgaccagcgcccuacaggcgcacuucaaggugugcaaacucaccucgcgguuccaagacaaccugcgcaagucccugggcgccuacgagccgaaacaggggugcuaccguacccucucccuuuuucgguaccggucacgcuucuuuguggguuucaucuggugcuuucuucuuguccuggaacucaucaucugggccgccuccgcagagacgcagaaccucaacagcggguggaccgauaccgcccauggcuccggugugauaccuaugcggaccgaccuggagcucgacuucagccuccccagcagcgccuccuacacguaccgccggcaauugcagaacccggccaacgagcaggagaagauccccuuccaucugcagaucuccaaacaggucauccacgccgagauacagcaccugggucacuggauggacggcaccuuuaaccuuaagacagcguuccacugcuacggguccugugagaaguaugccuaucccuggcagaccgcaggcuguuucaucgaaaaggacuacgaguacgagagcggguggggcugcaauccgcccgacugcccaggcgucggcacgggcugcaccgcaugcgggguguaccuggacaaacucaaguccgucggaaaggccuucaagauugucucgcugcgcuacacccggaaggcgugcauccagcuggggaccgagcagacgugcaaguccguggacucgaacgacugucuugugaccaccagcgucaagguuugcuuaauagggacaguuuccaaguuccagcccagugacacgcucuuauuccuaggccccuuggaacaaggcggguuaaucuucaagcagugguguaccacgaccugucacuucggggacccgggcgacauaaugaguacccccgccgguaugaaaugcccggagcuaagcggcucguucaccaagaagugcgccuucgcccccaccccggucugccaguucgacggcgacacuacgucgggguacaagaagaugauagccaccaaggacucguuccagagcuucaacgugaccgagccgcacaucuccgcgaguagucuagaguggaucgaccccgaccgcagccuacgggaccauaucaacgugauaguaggccgcgaccugucauuccaggauuugagcgagacccccugccagguagaccucaccacgaccuccaucgacggggccuggggcagcggcgugggauucaaccugaucugcagugucucccugaccgagugcagcaccuucuuaacguccaucaaagccugcgauagcgccauguguuacggcuccacuacggcgaaccugcugcggggacagaacaccgugcacauagugggcaagggagggcacagcggguccaaguucaugugcugccacgacacgaagugcagcuccaccgggcucgucgccgccgccccgcaccuggaucgugugaccggcuacaaucaggccgacagcgacaagaucuuugacgauggcgcgcccgagugcgggauuuccugcuggcucaccaaaucgggggaauggauacucgggguacugaacggcaacuggauggucgucgcugugcuggucgcucuguucauauucuccaucuuccuguucacacugugcugucccaggcgcccaagcuacgccaaagagcacaagccguga

SEQ ID NO: 15084 - RNA, 3447 nt, Artificial Sequence
  derived and/or modified CDS sequence (opt11) from PUUV(PUUV/Orleans/Mg29/2010)__KT247601.1__GP
auggguaaaauaauucccgugugucuauaccuacucuuccguugccuccuucucugggaccgcgguaacgcccgcaaccugaacgaguuaaagauggaauguccccacaccauaggacucggucaaggccucgucaucggcucggucgagcucccaccaguaccccucacccaaaucgaaucauuaaagcucgaauccucaugcaacuucgaccuccacacaucgacuuccagccaacaaucuuuuaccaaauggacaugggaaaucaaaucagaccuugcagaaaacacccaggcgucaucaaccuccuuccaaacuaaaagcucagaagucaaccuacgcggccucugucucgugccaccccuagucauugaaacagcagcccgaaccagaaagaccauagccugcuucgaccuaaguugcaaccaaaccgcaugccagcccacugucuuccuaauaggacccauacaaaccugcauaaccaccaaaagcugccuccucggucuuggggaccagcggauucaagucaauuaugagaaaacauacugcguuuccggccaacucgucgaaggcgucugcuuuaacccaauccacaccauggcccuuucgcaaccaagccacacauacgacauaguaaccgucaugguacgaugcuuccucauaguaaagaaaguaucuacgggagauucuaugaaaaucgaaaaaucauuugaaacccuaguacagaaaaccgggugcacaggaaacggcuuccaagguuacuacgucugcuuaauaggcucauccagcgaaccgcucuacaucccaacccuugacgauuaccgauccgccgaaguacuaagccgcauggccuucgcgccccacggugaagaccacgacauagagaaaaacgccaucagugccaugagaauagucggcaaagucacagguaaagccccauccacagaagccuccgacacuguccaaggaauagccuucuccggcaacccgcuuuacaccucaaccggaguccucacagcaaaagacgaccccauuuacaucugggcgccaggcauaauaauggaaggcaaccacuccguaugcgaaaagaaaacacucccacuaacuuggaccggcuucauaccccuucccggagagaucgagaaaaccacccaaugcacgguauucugcacccucgcaggacccggcgccgauugcgaagccuacucagaaacuggaauuuucaacauuuccuccccaaccugccuaaucaaccgaguccaacgcuuccgcggggcagaacaacaaaucaaauucauaugccaaagaguggacauggacaucaccgucuauugcaacggguuaaagaaagucauacuaacaaaaacguucauaauaggacaauguauuuauacuuuuaccagcauauucucccuuauccccggggucgcccacagccucgccguagaacucugcgucccaggccuccacggaugggccaccaugcuacuacuccucacauucugcuucggcuggguacuaauccccuucuuuagcaugauccuacugaaaauacugauagcauucgccuaccucugcagcaaauacaacacagacuccaaauuccgcauccucaucgagaagguuaaaagggaauaccagaaaaccaugggauccauggucugcgaagucugccaauacgaaugcgagacagcgaaagaacuugagucccacaggaaauccugccccauggggucaugccccuacugccucaacccggccgaggccaccaccucagcucugcaagcccauuucaaaguauguaaacucaccucccguuuccaggauaaccuccguaagagcuuaggcgccuacgaaccuaaacagggcugcuaccgcacccuaagccucuucagauaccgcagccgauucuucguaggcuucaucuggugcuuccugcugguacucgaacuaaucaucugggcagcuucugccgaaacccaaaacuuaaacuccggguggacagacacagcccacggguccgggguaauacccaugcgaacagaccucgagcuagacuuuucccugcccucaucugccagcuacaccuaccgccgucaacuccaaaacccugccaacgagcaagagaaaauccccuuucaccuacaaauauccaaacaagucauccacgccgaaauacaacaccugggccacuggauggauggcacauucaaucucaaaacagcauuccacuguuacggauccugugaaaaauaugccuacccuuggcaaacggcuggauguuucauagaaaaagacuacgaauacgaaucugggugggguugcaacccacccgacugcccuggagucgguacaggaugcaccgccugcggaguauaccuagacaaacuaaaauccgucggcaaagccuucaagaucgucucccuccgguacacccgaaaggcuugcauccaguuaggaaccgaacaaaccugcaaaucaguagacuccaaugacugccuagucacaaccagcgugaaagugugccucaucggcacuguuucuaaauuccaaccauccgauacccuacucuuccuggguccacucgaacaaggaggccuuaucuucaaacaguggugcaccacaaccugccacuucggagacccaggugacauaaugucuaccccagcaggcaugaaaugcccagaacuauccgggucuuuccgcaaaaagugcgccuucgcgcccaccccggugugccacuucgacggcaagacuauuucaggcuauaaacguaugaucgcuaccaaagacagcuuccaaaguuucaaugugacagaaccacacauauccgccuccagccuugaauggaucgaccccgacucgucacucagagaccacauaaauguuauagucggccgagaccucucuuuccaagaucuuucagagacaccuugccaagucgaccucacaacaacauccaucgacggugccuggggauccggcgucggauucaaccuaaucugcucugucucccuaacagaaugcagcaccuuccuuaccuccaucaaagccugcgauagcgcaaugugcuacggauccaccacagccaacuuauugcggggccaaaacaccguccacaucgucgguaaaggcggucauucuggcagcaaauucaugugcugccacgacaccaaaugcuccagcacgggccuuguagcagcagccccacaucucgacagagugaccgguuacaaccaagcggauucagacaagaucuucgacgacggcgcucccgaaugcggaaucuccuguuggcucaccaaauccggagaguggauacucggaguccuaaacgguaacuggauggucguugcggugcucguagcacucuucauauuuuccaucuuucuuuucacacucugcuguccgcgccguccuuccuacgcaaaagagcacaagcccuag

SEQ ID NO: 15085 - RNA, 3447 nt, Artificial Sequence
  derived and/or modified CDS sequence (opt11) from PUUV(Vranica)__U14136.1__GP
auggguaaacucuccccagucugccucuaccucuuccuccaaugccuccuacucuggaaucgcgguuccgcgcgaaaccugaacgagcucaagauggaaugcccacacacuauaggacucggucagggcuuagucaucggauccgucgagcuaccucccguccccauccagcaggucgaaucccuuaaacuugaguccagcuguaauuucgaccuacacacaucgacugcuacacaacaauccuucacuaaauggaccugggaaaugaaagacgaccuugcagaaaacacccaagccucauccaccucguuccaaaccaaguccagcgaagugaaucugcgcggccuuugccugauaccuccccuagugguagaaaccgcaagccgcacucgaaaaacaaucgcguguuucgacauaucaugcaaccaaaccgucugccaacccacagucuaucucguaggccccauacaaacuugcaucaccaccaaaagcugccuucuuggccugggcgaucaacguauccaggucaacuacgagaaaaccuacugcguaucagggcagcucaucgaaggcgucuguuucaaucccguccacacgcgagcccucucacaaccgagccauaccuacgacauugucaccaugaugguacguugcuuccuagugguaaagaaagugaccuccggcgacuccaugaaaauagagaaaaacuuugaaacacuugugcagaaaacggacugcaacgccaacggcuuccaagguuacuacauuugccuagucggcagcuccucagaaccccuuuacguacccaccuuagacgacuaccguagcgccgaaguacuuucccgcauggccuucgcgccccacggagaagaccacgacguagagcgaaacgcagucucugcgcuccggaucguaggaaaagucacgggaaaagcccccagcaccgaagccuccgauaccguccaaggcauagccuucucaggaucgccccuauacacguccaccggcguacugacagcuaaggacaaccccgucuauaucuggucgcccggaauuauaauggaaggcaaccauucaguuugcgagaagaaaacccucccgcucaccuggacagguuucauaccccuccccggcgaaauagagaaaaccccacaaugcacggucuucugcacucuagcaggacccggagcggauugugaggcguacucagaaacaggcaucuuuaacauauccuccccgaccugccuccugaaccgcguacaaagguuccgcggcgccgaacaacaaaucaaauucgucugccaacgcguggacauggacauaacuguauacugcaacggaaugaagaagguaauccuuacaaaaacccuagugaucggacaaugcaucuacaccuucacaaguaucuucucacucauacccggcaucgcacacucccuggccgucgagcugugcguccccggccuacacggaugggccacaguccucuuacuccucacauuuuguuucggcuggauacuaauccccuucaucgcaaugauccuacuaaaaauccucaucgccuucgccuaccuuuguucgaaauacaacacggacucaaaauucaaaauacuuaucgaaaaaguaaagaaagaauaccagaaaacuauggguagcauggucugcgaagucugccaauacgagugcgagacugccaaagaacucgagagucaccgcaagucuugccccaucgguuccugcccguacugucuaaaucccuccgaagccaccaccagugcccuacaggcacacuuuaaaguaugcaagcugacuucccgcuuccaagauaaccuacgcaaaucacuagccgcuuacgaacccaaacaaggaugcuaccgcacccucucacuguuccgcuacagaucacguuucuucgucgguuucauauggugcauccuccuaguucucgagcuaguaauuugggcagcaagcgccgaaacccagaaucucaacucaggcuggacagacacagcccacggcagcggcgugguccccaugcgaacagaccucgaacucgacuucucucuuccuucaagcgcauccuauaccuaccgccgacaacuccaaaaccccgcaaaugaacacgaaaagaucccguuccaccuccaaauaaguaaacaagugauucacgccgaaauccaacaccugggucacuggauggaugcaacuuucaaccuaaaaacagccuuccacugcuacgggcucugcgagaaauacgcauacccguggcagaccgcaggcugcuucuuugagaaagacuacgaguucgaauccggauggggcuguaauccucccgacugccccggcaucggcacgggcugcacagccugcggugucuauuuagacaaacugaaauccguaggaaaaguauucaagauaaucucacuccgcuacacaaggaaggcaugcauacaacuaggcacagaacaaaccugcaaauccgucgauagcaacgacugccucgucacaacaucaaucaaaguaugcuuaaucggaaccguaucaaaauuccaacccucagacacucuauuauuccuaggcccccucgaacaaggcggccucauauucaaacaauggugcaccacaaccugccaauucggagaccccggggauauaauguccaccuuaaccggaaugaaaugcccagaacucaacggcagcuuccgcaagaaaugcgcuuucgccacuacacccguuugccaauuugacggaaauacgauauccggcuacaaacgcaugauggccaccaaagacuccuuccaaucauuuaacgucacggaaccccacauaucuacgucagcccuugaauggaucgacccagacucaagccuccgggaccacaucaacguaguugucucucgagaccuauccuuccaagaccucuccgaaacgcccugccagguagaccucacaaccucuucgauagauggcgcuugggggucgggaguuggcuuuaaccucguuugcaccgucucgcucacagaaugcccaacauuucucacgucgauuaaagccugcgacuccgcgauguguuacggcagcaccacaaccaaccugguacgaggccaaaacaccguacacauagucggcaaaggaggccacaguggcucaaaauucaugugcugucacgacaccaaauguucuuccaccggccuuaucgccgcagcaccucaccuggaucgcgucaccggauuuaaccaagcggacuccgacaaaaucuucgaugacggcgcccccggcugcgguaugagcugcugguucaagaaaucaggcgaauggauccuagguguucuaaacggcaauuggcuuguaguagccguccucaucgcucuuuucauacuuucaaucuuccuguucaccuuaugcugcccccgccgacccacguacaccaaagagcacaaaccauaa

SEQ ID NO: 15086 - RNA, 3447 nt, Artificial Sequence
  derived and/or modified CDS sequence (opt11) from PUUV(CG1820/POR)__KT885051.1__GP
augggugaacucagcccuguaugccucuaccuacuccuccaaggcuuacuacucugcaauaccggcgccgcacgcaaccugaacgagcucaaaauggaaugcccgcacacaauccgccucggacagggacucgucguuggcucgguggaacucccaagucugccaauucaacaagucgaaacccucaaacuugaguccagcugcaacuucgaccuacauacaaguaccgcaggacaacaguccuucacaaaauggaccugggaaauaaaaggagaucuugcggaaaacacacaagccuccagcaccucguuccaaaccaagagcucagaaguaaaccuacgcggacuuugucuaauaccaacccuagucgucgaaaccgcggcccguaugcguaaaaccaucgcaugcuacgaccugagcugcaaccaaaccguaugccagcccacagucuaccucaugggaccaauccagaccugcauaacgaccaaauccugccuccuaucccuaggggaucaaagaauccaagucaacuacgaaaagaccuacugcguaucgggucaacucgucgaaggcaucugcuucaacccgauucacaccauggcccuaucacaacccucacacacauacgacauuaugaccaugaugguacgauguuuccucguuauaaagaaagugaccagcggcgauagcaugaaaauagagaaaaacuucgaaacacucguccagaaaaacgguugcacagccaauaacuuccaaggauacuacaucugccucauagguuccagcucagaaccgcucuacguaccagcacuagacgacuacagauccgcagaaguccuuucccgcauggccuucgccccgcacggcgaagaucacgacaucgagaaaaacgcaguaucggcuaugcggauagccggcaaggucacaggaaaagcaccguccaccgaaucaucugacacuguccaaggaauugcauucucagggucuccccucuacacuuccacgggagugcuuacuucuaaagacgaccccgucuacauaugggcccccggcauuauaauggaaggcaaccacucaaucugcgaaaagaaaacucuaccccucacuuggaccggauuuaucagccuccccggcgaaauagagaaaaccacucaauguaccguauucugcacccuagccggacccggcgccgacugcgaagcauacagcgaaaccggaaucuucaauauaagcucgcccacaugccuaauaaaucgaguccagcgcuuccgagguagcgaacaacaaaucaaauucguaugccagcgcgucgacauggacauaaccgucuacugcaacggcaugaaaaaggucaucuuaaccaaaacgcuaguaauaggccaaugcaucuacaccuuuaccuccaucuuuucccuaauaccgggggucgcgcauaguuuagccguggaacucugcguccccggacuacauggcugggcaacaaugcucuuacuccucaccuucugcuucgguuggguccucauacccacgaucaccaugauccugcucaagauccuaauagcauuugcguaccugugcagcaaguacaacaccgacucaaaauuccgaauccugaucgaaaaaguaaagcgagaauaccagaaaaccaugggaagcauggucugcgaagucugccaauaugaaugcgaaacagcuaaagaacuugaaagccacagaaaaucuugcuccauaggcuccugcccguacugccucaaucccagcgaagcuaccaccucugcccuacaggcccacuucaaaguaugcaaacuaacaucacguuuccaagaaaacuuacgcaagucccugacaguauacgaacccaugcaaggaugcuaccgcacucuaucccuauuccgcuaccggagccgguucuucgugggucuaguguggugcguacugcuaguucuagaacuuauagucugggcugcaucagccgaaacccaaaaccuaaacgccggcuggacggacaccgcccacggauccggcauaauuccaaugaaaaccgaccuugaacucgauuuuagccuccccagcuccgcuagcuacacauaccgacgccaacuccaaaaccccgcuaaugaacaagagaaaaucccuuuccaucuccaacugucaaaacaagucauccacgcagaaauccaacaccuuggccacuggauggacgccaccuucaaucucaaaacugccuuccacuguuacggcucaugcgaaaaguacgccuaccccuggcaaacagccggcugcuucauagaaaaggacuacgaauacgaaaccgguuggggaugcaacccgccagacuguccaggggucggcacagguugcaccgccugcgguguuuauuuagacaaacugaaauccguuggcaaagucuucaaaaucgucagucuccgguacacccgcaaagugugcauacaacucggcaccgaacagacaugcaagaccgucgauuccaacgacugccuaauaaccacgucaguuaaaguaugccuaaucggaaccauauccaaauuccaacccuccgacacacucuuguuccuaggcccccuucagcaaggaggccuaauauuuaaacaauggugcaccaccacaugccaauucggcgacccgggcgauaucauguccacccccacuggcaugaaaugucccgaacuuaacggcuccuuccgaaagaaaugcgccuucgccaccacaccugucugccaauucgauggaaacacaauuucgggcuacaaaagaaugaucgccacaaaagacucguuccaauccuuuaacgugacagaaccacacaucucuaccagcgcccuugaguggaucgacccagacagcucccuccgcgaccacauaaacguaauaguaucacgagaccucuccuuccaggaccuauccgaaacgccaugucaaauugaccuagccaccgcuagcauugacggcgcgugggguagcgggguaggguucaaccuuguaugcaccgugucacuaaccgaaugcagcgccuuucugaccuccauaaaggcaugcgacgcagccauguguuacggcuccaccacugccaaucucguacgcggacaaaacacaauacacaucgucggcaaagggggacacuccggcuccaaauucaugugcugccacgacaccaaguguucauccaccggccuagucgccgccgccccacaccuugacagaguaacaggguacaaucaggccgauucggauaagaucuuugacgauggcgcccccgaaugcgggaugucuugcugguucaaaaagucaggagaauggauccuuggcgucuuaaacggaaacuggaugguagucgcgguccuugucguccuccuuauacucucaauacuccuauucacucucugcugcccccgccgacccuccuacagaaaagaacauaagcccuag

SEQ ID NO: 15087 - RNA, 3447 nt, Artificial Sequence
  derived and/or modified CDS sequence (opt11) from PUUV(DTK/Ufa-97)__AB297666.2__GP
augggugagcuuucacccgucugccuauaccuucuucuacaaggacuucuccucuguaacaccggcgcagccaggaaucucaacgagcucaagauggaaugcccccacacaguaagacucggccagggucucgucgucggcucgguagaacuacccagccuuccgauacagcaagucgagacgcucaaacuagagagcuccugcaauuucgaccuccacacaucaaccgcaggccaacaaucauucaccaaauggacuugggaaaucaaaggggaccuagccgaaaacacacaagcgaguucuaccuccuuccagaccaagucauccgaagucaaccugagagggcugugccucauacccacacucguggucgaaacagcggcccgcaugcgaaaaaccauugcgugcuacgaccuaucaugcaaccaaacuguaugccaacccaccguauaucugaugggacccauucagaccuguaucacaaccaagucgugccuccucucccuaggagaccaacgaauccaagugaacuacgagaaaaccuacugcgugucgggccagcugguagaaggaaucuguuucaacccaauacacacaauggcacucucucaaccgucccacaccuacgacauaaugaccaugaugguacguugcuuccuaguaauaaagaaaguuaccuccggagacuccaugaaaaucgagaaaaacuucgaaacacuugugcaaaagaacggcuguacugccaauaacuuucaaggcuauuacauaugccugaucggcuccagcucggaaccucucuaugucccagcacuagacgacuaccgcucagccgaaguccuaucgcgaauggccuucgcaccucacggcgaagaccacgauauugagaaaaaugcagucucagcaaugcggauagcuggaaaagucaccggcaaagccccuucaacagaaucaagcgauacgguucaaggcauugccuucucaggcucgccccucuacacauccaccggaguacucacgucaaaggacgaccccguuuauaucugggcaccagguaucauaauggaaggcaaccacucaauaugcgaaaagaaaacacuuccacuaacauggacaggcuucauaucacuaccaggagaaaucgagaaaacgacucagugcaccgucuucugcacccucgcaggccccggggccgacugugaagccuacuccgaaacuggcaucuucaacauauccuccccaacgugccuaauaaaccgcguacagcgguuccgaggcagugaacaacaaauaaaauucguaugccagcgcgucgacauggacaucacuguauacugcaacggcaugaagaaagugauauuaaccaaaacgcuuguuaucggacagugcaucuacaccuucaccuccaucuucucgcucauacccggagucgcccacucccuagcaguagaauugugcguccccggccugcacggcugggccaccaugcuccuacuacugacauucugcuucggauggguacuaauacccaccaucaccaugauccuccuuaaaaucuuaauagcguucgccuauuuguguagcaaauacaacacggacucaaaauuccguauucucaucgaaaaaguaaagcgcgaauaccagaaaaccaugggcuccaugguaugcgaagucugccaauacgaaugcgaaaccgccaaagaauuagaaucccaccgcaaauccuguuccauaggauccugcccguacugucucaaccccuccgaagccacaacauccgcacuccaagcccauuuuaaagucugcaaacuaaccucccgcuuucaagagaaccugcgcaaaucccuaaccguguacgaaccaaugcaagguugcuacagaacacucucccuauuccgguaccggucucgcuucuuuguaggucucgucuggugcguccuccuugugcuagagcuuaucgugugggccgccuccgccgaaacacaaaaccucaacgcgggcuggaccgacaccgcccacggauccggaaucauacccaugaaaaccgaccucgaacuugacuucagccuccccagcucggcuucauacacguaccgcagacaacugcaaaauccagcgaacgaacaagagaaaauccccuuccaucuccaacucucuaagcagguaauccacgccgaaauccaacaccuaggccacuggauggacgccaccuuuaacuuaaagacagcauuccauugcuacggauccugcgaaaaauacgcguauccuuggcaaaccgccggcuguuucauugaaaaggacuacgaguacgaaacuggauggggaugcaacccacccgauugccccggugucggcaccggcugcaccgcguguggugucuaccucgacaagcugaaaucgguaggaaagguauucaagaucguaucccuccgauauacacgaaaaguaugcauucagcucggaaccgaacaaaccuguaaaaccguagauagcaacgacugccucauuacaacaucugucaaaguaugccuuauuggcacaauaucaaaauuccagcccucggacacccuacucuuccuagguccacuccaacaggguggcuuaauauucaagcaauggugcaccacgaccugccaguucggcgaucccggcgauauaaugaguacacccaccggaaugaaaugccccgaacucaacggcuccuuuagaaagaaaugcgccuuugccacgacuccugucugccaauucgacggcaacacgauaucgggcuacaaacgaaugauagccacaaaggacuccuuccaaucguucaaugucaccgaaccgcacaucucaaccuccgcguuagaauggaucgacccagauaguucacuccgcgaccacauuaacgugaucgucuccagagaccucagcuuucaggaccuaucagaaacucccugccaaauugaccuugcaacugcaagcaucgacggggcuuggggaagcggcgugggguucaaccucgucugcaccgucucccuuacggagugcucagccuuccuaacaucaauaaaagcaugugacgccgccauguguuauggcuccacaaccgccaaccucguacgcggccaaaacacgauucacauagucgguaaaggcggccauucaggaagcaaguucauguguugccacgacacaaaauguucauccaccggccuggucgcggcagcaccacaccucgaccgcgugaccggauacaaccaggccgacuccgauaagaucuucgacgacggagcgcccgaaugcgguauguccugcugguucaagaaauccggagaguggauccuaggcguccucaacggcaacuggauggucgucgcaguccucguaguacuccucauccuguccauucuucuauucaccuuaugcugcccucgucgcccuucguacagaaaagaacacaaaccauaa

SEQ ID NO: 15088 - RNA, 3447 nt, Artificial Sequence
  derived and/or modified CDS sequence (opt11) from PUUV(PUU/Cg-Erft)__AJ238778.1__GP
augggcaagaucaucccuguaugccuguaccuccuguuccugugccuccugcuguggaaccgcggagacgcccggaaccucaacgagcugaagauagagugcccgcacaccaucggccuggggcagggccucgucaucgggagcguggaacugccgcccgugccccugacccaggucgagucccucaagcuggagagcuccugcaacuucgaccugcacacgagcaccuccagccaacagcccuucaccaaguggaccugggagaugaaguccgaccucgccgagaacacucaggcgagcuccaccagcuuccagaccaaguccagcgagaucaaccugcgcggcuuaugccucgugccgccccugguaaucgagacagccgcccgcacgcgcaagaccaucgccuguuucgaccuguccuguaaccagaccgccugccagcccaccgucuuccucaucggccccauccagacgugcaucaccaccaaaagcugccugcuggggcucggcgaccagcggauccaagugaacuacgagaagaccuacugcguguccggccagcuggucgagggcgugugcuucaaccccgugcacacgauggcgcugagccagcccucccacaccuacgacaucgucaccgugauggugcgcugcuuccucaucgccaagaaggucagcaccggggacuccaugaagcuggagaaguccuucgagacgcuggugcagaagaccagcugcaccggcaauggcuuccagggguacuacauuugccucgugggcagcagcuccgagccccuguacaucccgacccuggacgacuaccggagcgccgagguccucucccgcauggccuucgcgccccacggggaggaccacgacguggagaagaacgccaucagcgccaugcggaucaucggcaaggugacgggcaaggcccccuccaccgagagcuccgauaccauccagggggucgccuucagcggcaacccccuguacaccagcacgggggugcugaccgcgaaggacgacccgguguacaucugggcccccgggaucaucauggaggggaaccacagcgucugcgacaagaagaccuuaccccugaccuggacgggcuucaucccccugccgggcgagaucgagaagaccacccagugcaccguguucugcacgcucgccgggcccggcgccgacugcgaggccuacuccgagaccgggaucuucaauaucagcuccccgaccugccugaucaaccgcguccagcgguuccgcggcgcggagcagcagaucaaguucaucugccagcggguggacauggacaucaccguguacugcaacgggcugaagaaggucauccucaccaagacgcugaucaucggccagugcaucuacaccuucaccagcauuuucucccugauccccggcguggcccacagccucgccguggagcugugcguccccgggcugcacggcugggccaccaugcucuugcugcugacguucugcuucggguggauccucauccccuucuucuccaugauccugcugaagauccucaucgccuucgcguacuugugcucgaaguauaacacagacagcaaguucaagauccugaucgagaaggugaagaaggaguaccagaagaccaugggcuccauggugugcgaggucugccacuacgagugcgagaccgccaaggagcucgagagccaccgcaaguccugccccauggggagcugccccuauugccugaacccggccgaggccaccaccuccgcccugcaagcgcacuucaaggugugcaagcucaccagccgguuccaggacaaccugcgcaagucccugggcgccuacgagcccaagcagggcugcuaccggacccucagccucuuccgcuaccggucccgcuucuucguggguuucaucuggugccugcuccugguccuggaguugauagugugggccgccagcgcggagacgcaaaaccugaacuccggcuggacagacaccgcccacgggagcggcaucauccccaugcggaccgaccuggagcucgacuucucccugccgagcuccgccagcuacacguaucgccgccagcugcagaaccccgccaacgagcaggagaaaauccccuuccaccuucagaucuccaagcaggucauccacgccgagauccagcaccugggccacuggauggacgggaccuuuaacuuaaagaccgcguuccacugcuacggcucaugcgagaaguacgccuaccccuggcagaccgccgggugcuucaucgagaaggacuacgaguacgagagcggcugggggugcaacccgcccgacugccccggcgugggcacggggugcaccgccugcggcguguaccucgacaagcugaaguccguugggaaggccuucaagaucgucagccugcgguacacccgcaaggcgugcauccagcucggcaccgagcagacgugcaaguccguggacagcaacgacugccuggugaccaccuccgucaaggugugccugaucgggaccgugagcaaguuccagcccuccgacacgcuccuguuccugggcccgcucgagcagggcgggcugauuuucaagcaguggugcaccacgaccugccaguucggcgaccccggggacaucauguccacccccgucggcaugaagugccccgagcugaacgggucauuccggaagaagugcgccuuugccaccaccccggugugccaguucgacggcaacacccucagcggcuacaaacgcaugaucgccacgaaggacuccuuccagucauucaacgugaccgagccccacaucuccgccuccucccuggaguggaucgaccccgacagcucccugcgggaccacaucaacgucaucguggggcgcgaccucagcuuccaggaccuguccgagacccccugccagguggaccuggcgaccaccagcaucgacggcgccugggggagcggcgucggguucaaccucgugugcuccgugagccugacggagugcuccaccuuccugaccagcaucaaggccugcgacuccgccaugugcuacggcagcaccacggcaaaccuccuccggggccagaacaccguccacauaguggggaagggcgggcacuccggcagcaaguucaugugcugccacgacacaaagugcuccucgaccggccugguggccgccgccccgcaccucgaccgcgucacgggguacaaccaggccgacuccgacaagaucuucgacgacggcgcgccggagugugggaucagcugcugguucacaaaguccggcgaguggauccugggggugcugaacggcaacuggaugguggucgccguucucguggcccuguucauccugagcaucuuccucuucacccugugcugcccccggcgccccuccuacgccaaggagcacaagccguga

SEQ ID NO: 15089 - RNA, 3447 nt, Artificial Sequence
  derived and/or modified CDS sequence (opt11) from PUUV(PUUV/Konnevesi/Mg_M105A/2005)__JQ319173.1__GP
augggcaaauccucgcccgugugccuguaccuaauccuccaaggccuacugcucauaggcgcggucaaugcacgcaaccucaacgaacugaaaauggaguguccgcacaccauaggcuuaggccaaggccuagucgucggaucuguagaguuacccccgguccccauccaacaggucgaaucccuuaaacuugagucgucaugcaacuucgaccuccacaccagcacagcgggccaacaaucauucaccaaauggaccugggaaacaaaguccgaucuagccgaaaacacccaggccuccagcaccagcuuccagacaaaaagcuccgaagucaaccuacgcggacucugccucauccccaccuuaguagucgaaacagcggcccgcaugcgcaaaacgaucgccugcuacgaccucuccugcaaccagaccgucugccaaccgacagucuacuuaauggggcccauacaaacaugccugacaacaaaauccugccuccugggcuuaggcgaccagcgaauccaggugaacuaugaaagaacauacugcguguccggccagcuuguagaaggagucugcuucaacccaauucacaccauggcccucucucaaccuucccacaccuacgacauagucaccguuaugguacgaugcuuccuaguaaucaagaaaguaaccucuggugauagcaugaaaauugaaaagaacuuugaaacgcucguccagaaaacagggugcacagccaacaguuuccaaggauacuacauuugucucgugggcaguuccucagaaccccucuacguacccacccuagacgacuauagguccgccgaagugcuaucccgcauggcauucgcuccccauggagaagaccacgauaucgaaaagaacgccauuucagcacuaagaauagcuggaaaagucacgggaaaagcucccucaaccgaauccucagacacaguccaaggcauagcguuuuccgggucacccuuguacaccagcaccggcguccucaccgccaaggacgauccggucuacauaugggccccggggaucaucauggaaggaaaccacuccgucugugaaaagaaaacacugccccucacauggacaggcuucaucccccuccccggagagauagagaaaacgacacaaugcacagucuucugcacuuuagccggccccggagccgacugugaggcuuacuccgaaaccggcaucuucaacaucuccuccccaaccugccuaaucaacagaguccaacgcuuccgcggagccgaacagcaaaucaaauucgugugccaacgcgucgacauggacaucacggucuacugcaacgggguaaagaaagugauucuaacuaaaacccuaguaauagggcaguguaucuacacauucacgagcauauucucccuaauccccggaaucgcacacucccuagccgucgaacuuugcgugcccgguuuacacggcugggcuacaguccuccuucugcugaccuucugcuucggauggguacugaucccgaccaucaccaugauccuccugaaaauccucauugcauucgccuaccuaugcaguaaauacaacaccgacucaaaauucaaaauccuaguagaaaaagucaagaaagaauaccagaaaacaaugggcuccauggucugcgaaguuugccaauacgaaugcgaaacagcaaaagaacuugaaucccacagaaaaucaugcucaaucggaucuugcccguacugccucaaccccagcgaagcaacacccagugcccuccaagcccacuucaaaguaugcaaauugacauccagauuccaagagaaccucaagaaaucucucacaauguacgaaccaaugcaaggaugcuaccgaacccucucccucuuccgcuaccgaucgcgcuucuuugucggccucgucuggugcaugcuccuaguccuagaacugauaguaugggcagcaucagcagagacucaaaaccucaaugccggcuggacugauaccgcacacggauccgggaucauaccaaugaaagccgaccucgaacucgacuucagcuuaccaucaucagcaucauauacauaccgccgacaacuccaaaaccccgcuaacgaacaagagaaaauaccauuccaccuccaaauaucaaaacaaguaauacacgcggaaauccagcaccuaggacauuggauggacgccaccuucaaccuaaaaacagcguuccacugcuacggaucuugcgaaaaauacgccuacccauggcaaaccgcgggcugcuucguagaaaaagauuaugaauacgaaacaggguggggcuguaaucccccagacugccccggcgucggcaccggguguacggcguguggcguauaccuagauaaauuaaaguccgucggaaaaguauucaaaauagugucgcugcgauacacccggaaggugugcauacaacuugguaccgaacaaaccuguaaaaccguggacuccaacgacugccucaucacgacaucugucaaagucugccuaaucggcaccauaagcaaauuccagcccuccgacacccuccucuuucucgguccccuccaacaagggggacuaauauucaagcaaugguguaccacgaccugccaauucggcgaucccggugauaucauguccacccccaccggaaugaaauguccagaacucaacggcagcuuccguaagaaaugcgccuuugcaaccaccccaguuugccaguucgacggcaacacgauuucggguuacaaacggaugaucgccaccaaagauagcuuucaaucauucaacguuacagaaccccacauaagcacaagcgcucuggaauggauagacccagacuccucucugcgcgaccacaucaacguaaucguuucacgagacuuaaguuuccaagaucuguccgagacgcccugucaaauugauuuaacugcgucugccauugacggugcaugggguagcggaguaggcuucaaucuggucugcaccaucagccucaccgaaugcagcaccuuccucacuuccaucaaagccugcgacgcugccaugugcuacggcucgacaacuaccaaccuaguccgugggcagaacacaauacacgucgucggaaaagguggacacuccggcagcaaguucauguguugccacgacacuaaaugcucuagcacaggccuagucgcagccgcaccccaccuaaacagaguaacaggcuucaaccaggccgacuccgacaagaucuuugacgacggcgcccccgaaugcggcgucuccugcugguucaagaaauccggcgaguggguacuaggcgucuugaacggaaacuggaugguggucgcaguccuuaucgcccuacugauacuuucaauauuccuguuugcacucugcugcccgcgccgaccaucuuacaagaaagaacacaaacccuaa

SEQ ID NO: 15090 - RNA, 3447 nt, Artificial Sequence
  derived and/or modified CDS sequence (opt11) from PUUV(PUUV/Konnevesi/Mg_M114B/2005)__JQ319175.1__GP
augggcaagagcucccccgugugccuguaccucauccugcaggggcugcuccuguucggcgccgucaacgcccgcaaccugaacgagcucaagauggagugcccgcacaccaucgggcugggccaggggcuggugguggggagcgucgagcucccgcccgugccaauccagcaggucgagucccugaagcuggagagcuccugcaacuucgaccuccacaccagcacggcggggcagcaauccuucaccaaguggaccugggagaucaaaaacgaucuggccgagaauacccaggccagcuccacgagcuuccagacgaaguccagcgaggugaaccugcgggggcucugccugauccccacccuggugguggagaccgccgcacgcaugcggaagacgauugcgugcuacgaccucagcugcaaccagaccguuugccagccaaccguguaccugaugggcccaauccaaaccugccugacgaccaagagcugccuccugggauuaggcgaccagcgcauccaggugaacuacgagcggaccuacugcgucuccggucaacucguggaaggcgugugcuucaaccccauccacacgauggcccugagccagcccagccacacguacgacaucgucaccaucauggugcgcugcuuccuggucaucaagaaggucaccagcggcgacaacaugaagauugagaagaauuucgagacccuugugcagaagacaggauguaccgcgaacuccuuccaaggcuacuacaucugccuggugggaagcagcagugagccccuguacguccccacacucgacgacuaccggagcgccgaagugcugucccgcauggcguucgcgccccacggcgaggaucacgacaucgagaagaacgcaauaagcgcccugcggaucgccggcaaggugacaggaaaagccccgucaacggagagcuccgacaccguccagggcaucgcuuucagcggcagcccccucuacaccagcaccggcgugcugacggccaaggaugaccccgucuacauuugggcccccgggaucaucauggagggcaaucacucggugugcgagaagaagacccuuccgcucaccuggaccggcuucaucccccugcccggggagaucgagaagacaacccagugcaccguguucugcacccuugccggccccggggcggauugcgaggccuacagcgagacgggcaucuuuaauaucuccagcccgaccugccucaucaacagagugcagcgguuccgcggggccgagcagcagaucaaguucgugugccagcggguggacauggacaucaccgucuacugcaacggcgugaagaaggucauucugaccaagacccuggucaucgggcagugcaucuacacguucaccuccauuuucagccucaucccugguaucgcccacucccuggccguggagcugugcgugcccggcuuacacgggugggccaccgucuuacugcuucugaccuuuugcuucggcuggguguugauccccacgaucaccaugauccuacucaagauccuuaucgccuucgccuaccuaugcagcaaguacaacaccgacuccaaguucaagaucuuaguggagaaggucaagaaggaauaccagaagaccauggggagcaugguuugcgaagugugccaguacgaaugcgagacggccaaggagcuggaaagccaccgcaagaguugcagcaucggcuccuguccguacugccugaaccccagcgaggcaacccccucagcgcuccaggcccacuucaaggucugcaagcuaaccagccgguuccaggagaaccuuaagaaaucccucaccauguacgagcccaugcagggcugcuaccguacgcucagccuguuccgguaucgcucccgguucuuugugggguugguauggugcaugcugcucguccucgagcugaucgugugggcugccuccgcggaaacccagaaccugaacgccggcuggaccgacacggcccacggguccggcaucauuccaaugaaggcagaccuugagcuggacuucagccugcccuccagcgccucuuacacguaccgccggcagcuccaaaaccccgcgaacgagcaggaaaagaucccguuccaucuccagaucucaaagcagguuauccacgccgagauucaacaccugggccacuggauggacgcaaccuucaaucugaagacagcguuccauugcuacggguccugcgagaaguacgccuaccccuggcagaccgcgggcugcuucguggagaaggauuacgaguacgaaacgggguggggaugcaauccgcccgauugccccggggugggcaccggcugcaccgccugcgggguauaccuggacaagcucaagagcgucggcaaaguguucaagaucgugagccugcgcuacacccgcaaggucugcauccagcuggggacugagcagaccugcaagaccguggauuccaacgacugccugaucacaacgagcgugaaggucugccucauuggcaccaucucaaaguuccaaccaucggacacccugcuuuuccucggcccccugcagcagggcggccugaucuucaaacaguggugcacuacuaccugccaguucggagaccccggcgacauuaugaguaccccgaccggaaugaagugccccgagcucaacggcagcuuccggaagaagugcgccuucgcgacgacccccgucugccaguucgacgggaacaccaucuccggauacaagcgcaugaucgccacuaaggauagcuuccaguccuucaacguuaccgagccccacaucagcacguccgcccuugaguggauagacccggacagcucccugcgagaccacaucaacgucaucgugagccgcgaccuuuccuuccaggaccugagcgagacccccugccagaucgaccuaaucgcguccgccaucgacggcgcaugggggagcggggucggguucaaccucgucugcaccgugucccugacugagugcagcacguucuuaaccagcauuaaagcgugcgacgccgccaugugcuauggcuccaccaccaucaaccucauucgggggcagaacacgauccacguggucggcaagggcgggcacucuggcuccaaauucaugugcugccacgacaccaagugcucauccaccgggcugguggccgccgcgccccacuuagaucgcgucacaggcuucaaccaagccgacuccgauaagaucuucgaugauggugcccccgagugcggggucuccugcugguucaagaagucgggcgaguggguccuuggcgugcugaacggcaacuggauggucguggccgugcugaucgcccuccugauccucuccaucuuucucuucgcgcugugcugcccgcggcgccccagcuacaagaaagagcacaagcccuga

SEQ ID NO: 15091 - RNA, 3447 nt, Artificial Sequence
  derived and/or modified CDS sequence (opt11) from PUUV(PUUV/Konnevesi/Mg_M78B/2005)__JQ319174.1__GP
auggguaaaaguucccccgucugccuuuaccucauccuacaaggacugcuucuuuucggagcaguaaacgcgcgcaacuugaaugaacucaaaauggaaugcccccacacuauuggccucggccaaggucucguagucggcuccguagagcucccacccgugccuauccaacaaguagagagccuaaaacuagaaucaagcugcaacuucgaucuacacacauccacggccggacaacagagcuuuaccaaauggacaugggagauuaaaaacgaccucgcagaaaacacccaagccagcucgaccucuuuucaaacaaaaucauccgaaguaaaccuccgcggccucugccucaucccaacgcuagugguggaaacugccgcacgcaugcgaaaaacuaucgccugcuaugacuuaagcuguaaccaaaccguuugccagccaacaguguauuuaaugggccccauccaaaccugccuaaccacuaaaagcugccuacucggacuuggcgaucaacgaauccaagucaacuacgaaagaacauacugcgugucuggccagcuaguggaaggagucugcuucaacccuauucacacaauggcccucagccaaccaucccacaccuaugacauugugaccaucauggugcgcugcuuuuuaguuaucaagaaagucaccucuggcgacaacaugaaaaucgagaaaaacuucgaaacacugguacaaaagaccggcugcaccgcaaacggguuucaaggauacuacaucugccucgucggcucaaguucagagccccucuacguacccacacuagacgacuaucggucagcagaaguacuaucacgcauggccuucgcgccgcacggcgaagaccaugacaucgagaaaaacgccauaucugcacuacguaucgcaggaaaggucaccgggaaagcccccuccaccgaaucuagugacaccguacaaggaaucgccuucuccgguagcccccuguacacuuccaccggcguccucacugccaaagacgaccccgucuacaucugggcacccgggauaaucauggaaggaaaucacagcgucugcgaaaagaaaacucuuccccucacauggacaggguucauaccccuccccggugagauagagaaaacaacccaaugcaccguauucugcacccuagcaggcccgggagccgacugcgaagcauacucggaaaccgggaucuucaauauuagcuccccaaccugucuaaucaaccgcguccaaagauuccgcggggccaaacaacaaaucaaauuuguaugccaacgggucgacauggacaucaccgucuauugcaacggcgugaagaaagucauucuuaccaaaacccuagucaucggacaauguaucuacacuuucacuagcaucuucucccuuauccccgguauagcacacucacucgccgucgaacucugcguacccggccugcacggaugggccaccgucuuacuccuucuaacauucuguuuuggcuggguccuuauccccaccaucaccaugauccuccucaaaauccucaucgccuucgcguaucucugcuccaaauauaauacagacucuaaguucaaaauacuuguagaaaaggucaagaaagaauaccagaaaaccaugggcagcauggucugcgaaguaugccaauaugaaugcgaaaccgccaaagagcucgaaucacaccgcaaaagcugcaguauagggucaugccccuacugccuaaacccaucagaagcaacuccaagcgcucuacaagcucacuucaaagucugcaagcucacaucccgauuucaagaaaaccuaaagaaaagccucaccauguacgaacccaugcaagggugcuaccgcacgcucucacucuuccgcuaucgcucccgcuucuucguaggccucgucuggugcaugcuccuaguacucgaacuaauuguaugggccgccucggcggagacccaaaaccucaacgccggauggacugacacagcccacggaucgggcaucauccccaugaaagcagaucuagaauuggacuuuagucugccaucgucugccuccuacacuuaccgccgacaacuccaaaacccugccaaugagcaagagaaaauccccuuccaccuccaaaucucaaaacaaguuauacacgccgaaauacaacaccugggccacuggauggacgcgacauuuaaccucaaaacagccuuccacugcuauggcucaugcgaaaaauacgcuuacccauggcaaaccgccgguugcuucgucgaaaaagacuacgaauacgaaaccggcugggguugcaacccgccugacugccccggcguuggcaccggcugcaccgcuuguggggucuaucuugauaaacugaaauccguuggcaaaguauuuaaaauaguaucgcugcgauacacccgcaaggucugcauacagcugggcacagaacaaaccugcaaaacagucgacaguaaugacugucucaucaccacaucaguaaaggucugucuuaucggcaccaucuccaaauuccagccuucggacacucuacucuuccucggcccacuccagcaaggaggacugauauucaaacaguggugcaccaccacuugccaguucggugaccccggggauauaaugaguacaccaaccgggaugaaaugccccgaacuaaauggcagcuuucguaagaaaugcgcauucgccacuacucccgugugccaauucgacgguaacaccaucucaggcuacaaacgcaugaucgcuacuaaagauuccuuccaaucauucaacguuacagagccucacaucucuacauccgcccuagaauggauagacccggauucgucccuacgagaucauaucaauguuauagugucacgugaccuauccuuccaagaccuuuccgaaacaccgugccaaaucgauaugaccgcguccgccaucgacggcgcauggggaagcgggguaggauucaaccucguuuguacaguaagccucaccgaauguuccaccuuccuaaccuccaucaaggcuugcgacgccgccaugugcuacggcuccaccaccaccaaccucguucgaggucaaaacacuauccacgucguaggaaaaggcggccacuccgguaguaaauucaugugcugccacgacacuaaaugcucgagcaaaggccucgucgccgcugcgccccaccucgaccgaguaaccggauuuaaccaagccgauucagacaaaaucuuugacgacggcgcucccgaaugcggcguauccugcugguucaagaaaucgggggagugggugcuaggcguacucaacggcaacuggauggucgucgcaguccucaucgcacuucuaauccucagcaucuuccuuuucgcacucuguugcccccgcagacccucauacaagaaagaacacaaacccuag

SEQ ID NO: 15092 - RNA, 3447 nt, Artificial Sequence
  derived and/or modified CDS sequence (opt11) from PUUV(PUUV/Konnevesi/Mg_O78A/2005)__JQ319172.1__GP
augggcaagucgucccccgugugccuauaccuuauccugcaagggcugcuccuguuuggcgccgucaacgcccgcaaccugaaugagcucaagauggagugcccgcacaccaucgggcugggccaagggcugguggucggcagcguagagcucccgcccgugcccauccagcaagucgagucccugaaacuugagagcuccugcaacuucgaccuccacaccagcacggccgggcaacagucguucaccaaguggacuugggagaucaagagcgaccuggccgagaacacccaggccaguagcacguccuuccagaccaagagcagugaagugaaccugagggggcucugcuuaauaccuacacucgugguggagacggcggcccggaugcggaagacgaucgcgugcuaugaccuuagcugcaaccaaaccgucugccagcccaccguuuaccugaugggccccauccagaccugccuaacaaccaaguccugucuccuggggcuaggcgaccagcgcauccaggugaacuacgagcggaccuacugcgucagcgggcaacucguggagggcgugugcuucaaccccauccacaccauggcgcugucccagccgagccacacauacgacaucgucaccauaaugguucgcugcuuccuggugaucaagaaggugaccuccggcgacagcaugaagaucgagaagaacuucgagacccucgugcagaagaccgggugcaccgccaacagcuuccaaggcuacuacaucugccuggugggguccucuuccgagccccuguacguccccacccucgacgacuaccggagcgccgaggugcuaucccgaauggccuucgcgccccacggcgaagaccacgacaucgagaagaacgccaucagcgcccugcggaucgccggcaagguuacggggaaggccccgagcacggagagcuccgacacaguccagggcauugccuucagcgggagcccacucuacacaagcaccggcgugcugacggccaaggacgauccuguguacauaugggcccccgggauaaucauggagggcaaccacuccgugugcgagaagaagacguuaccgcucacuuggaccggcuucauaccucuccccggggagaucgagaagacgacccagugcacaguguucugcacccuggccggcccuggggcggacugugaggccuacagcgagaccggcaucuucaacauuuccucgccgaccugccucaucaaccgcguccagcgguuccgcggggccgagcagcagaucaaguuugucugccagcggguggacauggacaucaccgucuacugcaacggagugaagaaggucauccugacaaagacgcuggucaucggccaguguaucuacacguucaccucuaucuuuagccuuauccccgggaucgcccacucccuagcgguggagcuuugcgugcccggccuccacgggugggcgaccguccuccugcucuuaaccuucugcuucgguugggugcugauucccacaaucaccaugauccuucucaagauccugaucgccuucgccuaccugugcagcaaguauaacaccgacagcaaguucaagauccuuguggaaaaggucaagaaggaguaccagaagaccauggggagcauggugugcgaggugugccaguacgagugcgagacggccaaggagcuggagucucaccgcaaauccugcucgaucggcucauguccguacugccuuaaccccagcgaggcgaccccauccgcacuccaggcccauuucaaggucugcaagcuaaccagccgguuccaagagaaccugaagaaaucccucaccauguacgagcccaugcagggcugcuacagaacacuaagccuguuccgguaccgcucccgguucuucguugggcucgucuggugcaugcuguuggucuuggagcugaucgugugggccgcgagcgcggagacccaaaacuugaacgccggcuggaccgacaccgcccacgggucggguaucauccccaugaaggccgaccucgagcuggacuucucucuucccucuagcgcauccuacacguacaggcggcagcuccagaaccccgcgaacgagcaggagaaaauaccguuccaccuccagaucagcaagcaggucauccacgccgagauccagcaccugggccacuggauggacgccaccuucaaccugaagacagccuuccauuguuacgggagcugcgagaaguacgcguaccccuggcaaaccgcgggcugcuucguggagaaggacuacgaauaugagaccggguggggcugcaacccgcccgauugucccgggguuggcaccggcugcaccgccugcgggguguaccuggacaagcugaaguccguaggcaagguguucaagaucgugucccuccguuacaccaggaaggucugcauccaacuagggacggagcagaccugcaaaacagucgacuccaacgacugccugaucacgacgagugugaaggucugccucaucggcaccaucuccaaguuccagccaagcgacacccugcuguuccucgggcccuugcagcagggcggccugaucuucaagcaguggugcaccacuaccugucaguucggagaccccggcgacaucauguccaccccgaccgggaugaagugucccgagcucaacggcagcuuccgaaagaagugcgccuucgccacgacccccgugugccaguucgacgggaacaccaucuccggcuacaagcgcaugaucgccaccaaggacagcuuccagucauucaacgugaccgaaccccacaucagcacuuccgcucucgaguggaucgacccggacagcucccugcgggaccacaucaacgucauugugagccgcgaccucuccuuccaggaccugagcgaaacuccuugccaaaucgaccucaccgccuccgcgaucgauggcgccugggggagcggcgugggguucaauuuagucugcaccauaagccugacggaaugcuccaccuuucugaccagcauuaaggcgugugacgccgcaaugugcuacggcuccaccacgaccaaccucgugcgggggcagaacaccauccacguggucggcaagggcgggcacagcggcuccaaguucaugugcugccacgacaccaagugcucauccacggggcugguggccgccgcgccgcaccugaaccgcgugaccggcuucaaccaggccgauagcgacaagauuuucgacgacggcgcccccgagugcggggucuccugcugguucaagaaguccggcgagugggugcucggggugcugaacggcaauuggauggucguggccgugcugaucgccuugcugauccugaguaucuuccuauucgcgcugugcugcccacggcgccccuccuacaagaaagagcauaagcccuga

SEQ ID NO: 15093 - RNA, 3447 nt, Artificial Sequence
  derived and/or modified CDS sequence (opt11) from PUUV(PUUV/Pieksamaki/human_kidney/2008)__JN831951.1__GP
augggcaaaagcuccccggucugccucuaccugauccuccaaggccuacuccucuucggagccguaaacgccagaaaccuaaacgagcuaaaaauggagugcccccacacuauaggccuagggcaaggacucgucguaggcagcgucgaacuuccgcccguccccauacaacagguagagagccuaaaacucgaaucaagcugcaacuucgaccugcauaccuccaccgccggccaacaauccuucacgaaauggaccugggaaaucaaaucggaucuagccgaaaacacacaggcuucauccaccucuuuccaaaccaaaucauccgaaguuaaucugaggggucugugccuuauccccacccuagugguggaaacagccgcgcgcaugagaaaaacaaucgcaugcuacgaccucucaugcaaccaaacaguaugccaacccacuguuuacuugauggguccaauccaaaccugccuaaccacgaaaucaugccugcucggccucggcgaccagcgcauccagguuaacuaugaacgaacuuacugcguaucaggccaacucgucgaaggcguauguuucaacccaauccauacuauggccuuaucccaacccucacauacauaugacgucguaacaaucaugguccgaugcuuccuagugaucaagaaagugacaucgggcgauuccaugaaaaucgagaaaaacuucgaaacacucguucagaaaacaggcugcacagccaacaacuuccaaggauauuacauuugccuugucggcucuagcucugaaccccucuacgucccaacacucgacgacuaccgaucagccgagguccugucaagaauggccuuugcaccacacggagaggaccacgacauugagaaaaacgcgauauccgcccuacguaucgccgguaaggucaccgggaaagcucccuccaccgaauccuccgauaccguccaaggcauugcauuuaguggcucuccacuguacaccuccacaggcgugcuaacggccaaagacgacccgguguauauaugggccccaggcaucauaauggaagggaaccacuccgucugcgaaaagaaaacccuaccacucaccuggacgggauuuauaccgcucccaggagaaauagagaaaaccacacaaugcaccgucuucugcacacucgcaggucccggcgccgacugcgaagcauacuccgaaacagguaucuucaacaucuccucaccaacaugccugauaaaccgcguacaacgcuuccgcggcgccgaacagcagaucaaguucgugugccagcgcguggacauggacaucaccgucuacugcaacggcguuaagaaagucauacucacuaaaacucucgucauuggacaaugcauuuacaccuucacgagcaucuucucucuuauacccggcauagcccauucucucgcgguagaacucugcguccccggacuucacggcugggcuaccguccuccuacucuuaaccuucugcuucggcuggguccucauccccaccauaaccaugauccuccuaaaaauccucaucgccuucgccuaccucugcucgaaauauaacacugacaguaaauuuaagauccucguagaaaaaguuaagaaagaauaccagaaaacgauggggucuauggucugugaaguaugccaauacgaaugcgagaccgccaaagaacucgagucccaccgcaagagcuguagcaucggaucaugccccuacugccuaaacccgagcgaagcaacgccauccgcgcuccaggcacacuucaaaguaugcaaacuaaccucacgcuuccaggaaaaccucaagaaaucacucacaauguacgagcccaugcagggcuguuauagaacacucagccucuuccgcuaccgaucgcgauucuucguagggcuggugugguguaugcuacucguccuggaacucaucgucugggccgcauccgcagaaacacaaaaccucaacgcugguuggacagacacugcccauggcuccggcaucauacccaugaaagcagaucuugaacucgauuuuagccucccaucaucagccuccuacaccuauagacgacaacuacaaaacccggcuaacgagcaggagaaaaucccauuucaccuccagauuucaaaacaagugauacacgcugaaauacagcaccugggacauuggauggacgccaccuucaaccucaaaaccgcuuuccauugcuacggcagcugugagaaguacgcuuacccauggcaaacugccgggugcuucgucgagaaggauuacgaauaugagaccggcuggggaugcaacccgcccgacugucccggcgugggcacaggcugcaccgcaugcggcgucuaccucgacaaacuaaaaucugucggaaaaguuuucaaaauaguaucacugcgcuacacccgaaagguaugcauccagcucggcaccgagcagacgugcaaaaccguagacagcaacgacugucucauaacaaccuccgucaaggucugccucaucggaaccaucagcaaguuccagccaucagacacccuccuauuccucggcccucuccagcaaggaggccucaucuuuaaacaauggugcacaacgaccugccaauucggcgacccuggagacauaauguccacacccaccgguaugaaaugccccgaacucaacgguucguuucgcaagaaaugugccuucgccacuaccccaguaugccaauuugacgguaacacgaucuccggcuacaaaagaaugaucgccacaaaagacucauuccaauccuucaacgucaccgaaccacacauauccaccuccgcccucgaguggauugacccagacuccucccuucgagaccacauaaacgucauugugucucgcgaccuaucauuucaagaccuuuccgaaacgccaugccaaauugaccuaacugccuccgccauagacggcgccuggggcuccggcgucggauucaaccuuguauguaccaucagccucaccgaguguagcacauucuuaacaucaauaaaagccugcgacgcagcgauguguuacggcagcaccaccacuaaccuaguacgaggacaaaacacuauccaugucgucggcaaaggaggccauucugguagcaaauucaugugcugccacgacaccaaaugcuccucuaccggccuagucgcagccgcaccccaccuugaccgaguuaccgguuucaaccaagccgacucagacaagaucuucgaugacggcgcgccagaaugcggcgucagcugcugguuccgcaaauccggcgaauggguccucggaguacuaaacggaaacuggauggucgucgcuguccucaucgcccuacuaauucugucaauauuccuauucgcccuauguugcccccgccgcccuuccuacaagaaagaacacaaacccuaa

SEQ ID NO: 15094 - RNA, 3447 nt, Artificial Sequence
  derived and/or modified CDS sequence (opt11) from PUUV(Samara_49/CG/2005)__AB433850.2__GP
augggaaaacuuucaccuguaugccucuaccuccuccugcagggacuacugcuuugcaaaacgggcacagcucgcaaccugaacgaacucaaaauggaaugcccacacaccaucggccucggccagggacugguugugggcagcgucgagcuaccucccguucccauacaacaaguagagacccuaaaauuggaaagcucaugcaacuucgaccuccacaccucaaccgccggucaacaagcauucacaaaauggaccugggagauaaaaggagaccucgccgaaaacacgcaggccucuucaacauccuuccagaccaaaagcucagaggucaaccuucgaggacucugccugauccccacucuagugauagagacagccgcccggaugagaaagacgaucgccugcuacgaucucagcugcaaccaaaccguaugccagcccacaguauaucuaaugggucccauccaaaccugcaucacaacaaaaucaugucuacuggggcugggagaccaacgaauccaggugaacuacgaaaagaccuauugugucuccggccagcuugucgaaggaguaugcuucaacccaauacacacuauggcacuaucgcaaccaagccacaccuacgacaucguaacgaugaugguccgaugcuuccuagucauaaagaaaguaaccucaggugacucaaugaaaaucgagaaaaacuuugaaacccucguacaaaagaacgggugcaccgcaaauucauuccaaggguauuacaucugcuuaaucggcucaagcucagaaccgcucuacguccccacccuagacgacuaucgcucggccgaagucuugucgcggauggcuuucgcaccccacggugaagaucacgacgucgaaaagaacgccaucuccgcacuccgcauagccggcaaagucaccggcaaagccccauccacagaauccucagacaccguucaaggcaucgccuucagcggaucuccccuauacaccuccacaggaguccuuacagcaaaagacgaccccguguacauaugggcaccgggaauuaucauggaagguaaccacuccgucugcgaaaagaaaacgcuaccacugacauggacuggcuucaucagccuucccggugaaauugagaaaacaacccagugcaccguauucugcacacucgcaggacccggagccgacugcgaggcuuacagcgaaacaggcauuuucaacauaucauccccaaccugccucaucaaccgaguccaacgcuuccgaggcgcagaacaacaaauaaaauucguaugccagcgagucgauauggauaucacgguuuacugcaacggcgucaagaaaguuauccucacaaaaaccuuagucauaggacagugcaucuacacauucacgagcauauucucccuaauccccggcguggcacacucucucgcgguugaacucugcguccccggacuacacggaugggccacaaugcuacuccuccuaacauucugcuucggauggguccuaauuccuaccaucaccaugauccuccuaaaaauccuaaucgccuucgcuuaccuaugcaguaaauacaacacagacuccaaauuccgcauacucaucgaaaaagucaaacgcgaauaccagaaaacaaugggauccauggugugcgagguuugccaauacgaaugcgaaacagcaaaagaacuagagucucacaagaaauccuguuccauuggcucuugccccuacugccuaaacccuucugaagccaccacgucagcccuacaagcccacuucaaagucugcaaacucacaucccgguuccaggaaaaccuaagaaaaagccuaacaguguacgaacccaugcaaggcugcuaccgcacacuaagccucuuccgguacagaucccgcuucuucguaggauuggucuggugcguacuccugguccuagaauuaaucgucugggccgccucggccgaaacgcaaaaccucaacgcaggcuggaccgacaccgcucacggaagcggcauuauccccaugaaaaccgaccuggaacuagacuucucccuacccucaucagcgaguuauaccuaucgcagacaacuucaaaacccagccaacgaacaagaaaauaucccuuuccaccuacaaauaagcaaacaaguaauacacgcagaaauccaacaccucggccacuggauggacgcaaccuucaaucuaaaaaccgccuuccacugcuacgggucuugcgaaaaauacgcuuacccauggcagaccgccggcugcuucgucgaaaaagacuaugaauacgaaaccggcugggguugcaaucccccagacugccccggagucggaacaggcugcaccgcaugcggugcauaccucgacaaacuaaaauccgucggcaaaguuuucaagaucguaucucuccgauacacaagaaaaguaugcauccaacuaggaacagaacagaccugcaaaaccgucgauucuaacgacugccugauaaccaccuccgucaaagucugccuaaucggaaccaucagcaaguuccaaccaucagauacccuacucuuccucggcccacuccagcaaggcggccuaauauucaaacaauggugcaccacaaccugccaauucggagaccccggcgacaucaugucaaccccgaccggcaugaaguguccugaucucaacgggagcuuccgcaagaaaugcgccuucgccacaacccccgucugccaauucgacggaaacaccaucagcgguuauaaacggaugauagcgacuaaagacuccuuccaauccuuuaacguaaccgaaccacacaucucagccucugcgcucgaauggauagacccagauucaagucugcgcgaccacauuaacguaauugucuccagagaccucuccuuccaagaccucuccgaaaccccaugccagauagaucugagcacagcuuccaucgacggagccuggggcagcggcguagguuucaaccuuguauguaccguaagccuaacagaaugcuccgcauuucucacaucaauaaaagcaugcgacgccgcaaugugcuacggcucaaccaccgcgaaccucauccgcgggcaaaacacgauccauaucgugggaaaggguggccacuccggcagcaaguucauguguugccacgauacuaaaugcuccacgaccggccuagucgcggccgccccacaccuugaccgagugacaggcuacaaccaagcagacuccgacaagaucuucgacgacggggccccagaaugcggaauguccuguugguucaagaaaagcggggaauggauacucggaguccuaaaugggaauuggauggucguugcagucuuaauugcgcugcuuguacucuccauccuccuguucacccuuugcugcccccgccggcccucuuacagaaaagaacacaagcccuag

SEQ ID NO: 15095 - RNA, 3447 nt, Artificial Sequence
  derived and/or modified CDS sequence (opt11) from PUUV(Samara_94/CG/2005)__AB433852.2__GP
augggcaagcucucucccguaugucuauaccuccuucuccaagggcuacuccugugcaacaccggaaccgcccgcaaccucaacgaacuaaaaaucgaaugcccgcacacaaucggccuaggacaaggccucguagucgguagcguagaacucccaccaguaccaauucagcaaguagagacacuuaaacuagaauccucaugcaacuucgaccuacacacguccacggcaggccagcaagcguucaccaaauggaccugggagauaaaaggcgaccucgccgaaaacacccaagcaucguccaccucauuccaaacaaaauccucagaagucaaccuacgaggucucugccucaucccuacccucgucauagaaacagccgcacgaaugcgcaaaaccauugcaugcuacgaccucucuugcaaucaaacuguaugucagccuaccguauaucucaugggacccauacagacauguaucaccacgaagucaugcuuacugggucuaggagaccagcggauacaagucaacuacgagaaaacauacugcguaagcggccaacucgucgaaggagucugcuucaaucccauacauaccauggcacucucacaaccaagccacaccuacgacaucgucacuaugaugguacgcugcuuccucaucauaaagaaagugaccucuggugacuccaugaaaaucgagaaaaauuucgaaacccuagugcagaaaaacgacugcacagccaauucauuccaaggauacuacaucugcuucaucggauccagcucagaaccacuuuacgucccaacacucgaugacuaccgaucggccgaagugcuaucccgcauggccuucgcuccccacggggaagaccacgacguugagaaaaacgcaauauccgcccuccguaucgccggcaaaguaaccgguaaggccccuucaaccgaaucgagcgauaccgugcaagguaucgcauucucgggcucgccgcucuacacuagcaccgggguucucgccgcuaaagacgaccccguauauaucugggcaccuggcaucaucauggaaggaaaccacucaauuugugaaaagaaaacccucccgcucacauggacaggcuucaucucauuaccgggagaaaucgagaaaaccacccaaugcacuguguucugcacccuagcggggccgggugccgauugcgaagccuacucagaaaccggcauauucaacaucucaaguccaacaugccucaucaauagaguucaaagauuccgaggcgcagagcaacagauaaaguucgucugccagcgaguugacauggacaucacaguauacugcaacggagucaagaaaguaauccuaaccaagaccuuagucaucggccaauguaucuacaccuucaccucaaucuucucgcucaucccuggaguagcacauagccuagcagucgaacucuguguacccggccuacacggcugggcgaccaugcuacugcuccugaccuucugcuucggcuggguacugauucccaccauaaccaugauccuauuaaaaauccugaucgccuucgccuaccugugcucaaaauauaacaccgauucuaaauuccguauacuaauagaaaaggucaagaaagaauaccagaaaacuaugggaucaaugguaugcgagguaugccaauacgaaugcgagaccgcaaaagagcuggaaagccaccgaaaaucgugcaguauagguucaugcccauacugcuuaaacccuucggaagcaaccacaucugcccuacaagcccacuucaaagucuguaaauuaaccucccgcuuccaagagaaccucagaaaaucccuuacgguguacgaacccaugcaaggaugcuacaggacgcuaucccucuuccgauaccgcucccgauucuucguaggccucgucuggugcgugcuacucguccucgaacuaaucguaugggccgccucagcagagacccagaaucuaaacgccggauggaccgacaccgcacacggauccggcaucauuccaaugaaaacugaccuugaacuagacuucagccuccccuccagcgccucauauaccuaccgaagacaacuacaaaaccccgccaaugaacaagagaacauaccuuuccaccuucaaauuucaaaacagguaauacacgcagaaauccaacaccuuggccacuggauggacgccaccuucaacuuaaagaccgcguuucacugcuacggauccugugaaaaauacgccuaccccuggcaaacggccggaugcuucgucgaaaaagauuacgaauacgaaacgggcuggggcugcaacccaccagauugcccuggcguggguacgggaugcacugccugcggcgccuaucuugauaaacugaaaucugucggcaaggucuuuaaaaucguaagccuaagguacacaagaaaaguguguauccaacuaggaaccgaacaaacuuguaaaacaguagacaguaacgacugucuaaucacuacaagcgugaaagucugucucaucggaaccaucucaaaauuccagccuuccgacacccucuuauuccucgguccacuccaacaaggcggacucaucuuuaaacaauggugcacaaccacaugccaauucggcgacccuggugacaucaugucaacuccaaccgggaugaaaugccccgacuuaaacggcucauuucguaaaaagugcgccuucgccacaacacccgucugccaauucgacggcaacacuaucuccggcuacaaacggaugaucgccacgaaagacucauuccaguccuucaauguaaccgagccacacauaagcgcaagugcacuagaauggaucgaucccgauuccucacuccgcgaccacaucaacgucaucgugucaagggaccucagcuuccaggaccuaagcgagacacccugccaaauagaucucagcaccaccuccaucgauggcgcauggggguccgggguugguuucaaccuaguguguaccgucucccucacagaaugcuccgcauuccugacuuccauaaaagccugugacgccgccauguguuacggcucaacaaccgcaaaccuuauccgcggccagaacacaauacacauugucggcaaaggcggccacucgggcagcaaauucaugugcugccacgacaccaaaugcucgacaaccggccuaguagccgccgcaccccaccuagaccgagucaccggauacaaccaagccgacagugacaaaaucuucgacgacggagcgcccgagugcggaaugucaugcugguucaagaaauccggggaauggauccucggaguccugaauggcaauuggaugguugucgccguacucaucgcacuccugguccuauccauccuucucuucacccucuguugcccgcgccgccccucauaccguaaagaacacaaaccuuaa

SEQ ID NO: 15096 - RNA, 3447 nt, Artificial Sequence
  derived and/or modified CDS sequence (opt11) from PUUV(Sotkamo)__NC_005223.1__GP
augggaaaaaguuccccggucugucucuaucucauacuccaaggacucuuacucuucgacaccgucaacgccaaaaaucucaaugagcucaaaauggagugcccacauacuauuggccucgggcaaggccuaguagucggaucagucgaacuaccacccguuccaauucaacaaaucgaauccuugaaacucgagagcucuugcaauuuugaccuucacaccucaaccgccggacaacaaucauuuaccaaguggaccugggaaaccaagggagaccuagccgaaaacacccaagcuagcuccaccucuuuccaaacaaaaagcuccgaaguaaaccuacguggccucugccucauacccacacucgucgucgaaaccgccgcucgcaugagaaaaaccaucgcgugcuacgaccucucauguaaccagaccguaugccaaccuaccguuuaucucaugggucccauacaaaccugccuuacuaccaaaaguugucuccuuggacucggagaccaacguauucaaguaaacuacgaacgaacauacugcgucuccggacaacuugucgaaggcgucugcuucaauccuauacacaccauggcacuaucccaacccucccacaccuacgacaucgugacgaucaugguacguugcuuccucgucaucaagaaggucacuagcggcgacucaaugaaaauugagaaaaacuucgaaacccuuguccagaagaccggaugcacagccaacggcuuucaagguuacuacaucugucucaucggcucauccuccgaaccuuuauacguccccacacuagacgacuaucgaucugcagaagugcuaucacgaauggccuucgcgccacacggcgaagaccaugacaucgagaaaaaugcaguauccgcucuccgcauagcugggaaagucacaggaaaagcccccaguacagaguccuccgacacaguccaaggaauagccuucucaggcuccccacuauacaccuccacagggguacuuaccgccaaagaugaccccgucuacgugugggcccccgguauaaucauggaagguaaccacucuguuugugagaagaaaacgcuaccccuaaccuggaccggauucauaccccuucccggcgaaaucgagaaaaccacccaauguaccgucuuuugcacgcuagcggggcccggagccgacugcgaagcauacuccgaaaccggcaucuucaacauaagcagccccacuugccuuauaaacagaguccaacgauuccgaggggccgaacagcagauaaaguucguaugucagagaguagacauggacaucaccguauacuguaauggcgucaagaaagucauauuaaccaaaacacuuguaaucggccaaugcaucuauacauucaccucaauauucuccaugauccccggcaucgcgcacucccucgcaguggaacuguguguccccggacuccacggaugggccaccguacuccuccuucucacauucugcuucggcuggguccucaucccaacuaucaccaugauccuucugaaaauccuaauagccuucgcauaccucugcuccaaauauaacacagacuccaaauucagaauacuuguggaaaaagucaagaaagaauaccagaaaacaaugggaaguauggugugcgaagugugccaauaugaaugugaaacagccaaagaacucgaaagccaccgaaaauccugcuccauaggcucaugcccauacugucuuaacccauccgaagcuacccccagugcguugcaagcccacuucaaagucugcaaacuuaccagccgcuuccaagagaaucuaaagaaaucacucacaauguacgaacccaugcaggggugcuaccguacacucagcuuauuccgcuaccguucccgauucuucgucggguuagucuggugcaugcuacuuguacucgaacucaucgugugggccgccagugcugagacccaaaaccucaacgacggauggacagacaccgcccacggcucaggcaucauacccaugaaagcagaccucgaacuagacuucucacuacccuccucggcaucguacacguaucgacgucagcuccaaaaccccgcaaacgagcaagagaaaauaccauuucaccuccagauaagcaaacaaguuauacaugcggaaauacagcaccucggccauuggauggacgcaacauucaaccuaaaaacggccuuucacugcuauggcagcugcgaaaaauaugccuaccccuggcagacugcaggaugcuucgucgaaaaagacuaugaauaugaaacaggcugggguugcaaucccccagacugccccggagugggcacaggcugcaccgccugcggcgucuaccucgacaaacucaaaucuguaggcaaaguguucaaaaucgucucacuucgguacacccgaaaagucugcauccagcuaggcacgggccagacuugcaaaaccgucgacuccaacgacugccucauuacaacaagcgucaaaguaugccucauagguacaaucuccaaauuccaacccuccgacacacuccucuuccuugggccacuucaacaagggggccuaaucuucaaacaauggugcacgacaacaugccaauucggagaccccggcgacauuauguccacccccaccggcaugaaaugucccgaacuaaacggcuccuuucgcaagaaaugugccuuugcaaccaccccgguaugccaauucgacgggaacaccaucuccggcuacaaacgcauggucgccacgaaagacuccuuccagagcuucaacguaaccgaaccccacaucuccacaucagcacuugaauggaucgaucuagacuccagccuucgcgaccacaucaacgugauugugucaagagacuuguccuuccaagaucuaucggaaacuccaugccaaguagaccuaaccacauccgcaacggacggagccuggggaucaggcgugggauucaaccucguaugcaccguaagccucacagaaugcuccgccuuucugaccuccaucaaagcaugccacgcagccaugugcuacggguccaccaccaccaaccuaguacgagggcaaaacaccauccacguuguaggcaaaggcggccacucaggcucuaaauucaugugcugccacgacaccaaaugcucauccaccggacucgucgccgccgcaccacaccucgaccggguaaccgguuucaaccaagcagauuccgacaaaaucuucgacgauggcgcccccgagugugggaugucaugcugguucaagaagcucggggaauggguccucggaguccuaaauggaaacuggauggucguagccguacucaucgcccuacucauccuuagcaucuuccucuucgcacuaugcugcccacgucggccgucuuacaagaaagaccacaaaccuuag

SEQ ID NO: 15097 - RNA, 3447 nt, Artificial Sequence
  derived and/or modified CDS sequence (opt11) from PUUV(2009)__HE801634.1__GP
auggguaaaucgucccccgucugucuauaucugauacuacaaggccuccuccuuuucgacaccgucaacgcccgcaaccuaaacgagcuuaaaauggaauguccucacacaaucggccucggccaagggcuaguaguaggauccguagaacuuccacccguucccauacagcaaauagaaagccuuaagcucgaaucaucaugcaauuucgaccuccacaccucuacagccggccaacaaucguuuacgaaauggaccugggaaacaaaaggagaccuggcugagaacacccaagcguccucaacaucauuccagacuaaauccuccgagguaaaccuacguggacucugccucaucccaacucuagucgucgaaacagcagcccgcaugcgcaaaaccauagccugcuacgaccuuagcugcaaccagacgguaugccaaccgaccguguaccuuaugggccccauacaaaccugcuuaacuaccaaguccugcuuacuaggcuuaggcgaccaacggauucaagucaacuacgaacguacguauugcguauccggacagcugguggaaggcguuuguuuuaaccccauacacacaauggcacuuucacaacccucccauaccuacgauaucgucaccaucaugguacguugcuuucucgucaucaagaaagugacauccggagacuccaugaaaauagagaaaaauuuugagacacucguacagaaaacaggcugcaccgccaacggcuuccaaggguacuacaucugccugauagggucuuccagcgaaccacucuacguaccaacacuagacgacuaccgcuccgccgaaguacucucgcgcauggccuucgccccgcacggugaggaccacgacauugagaaaaacgcaguauccgcccucagaaucgcaggcaaagucaccggcaaagcccccuccacggaauccuccgacacaguccaagguaucgccuucucagggucacccuuguacaccagcacgggcguccucacugccaaagaugaucccguauacgugugggcgcccggcaucaucauggaaggcaaucacucuguaugcgaaaagaaaacacucccgcucaccuggacgggcuucauaccccuaccaggcgaaaucgagaaaaccacccaaugcacagucuucugcacacuagcaggcccuggcgcagacugcgaagccuacucagaaaccggaaucuucaacauuucuucacccacaugccuaaucaaccggguacaacgcuuccgcggggcagaacaacaaaucaaauucgucugccagcgcgucgacauggacauaaccguguauuguaacggcguaaagaaagucauccucaccaaaacccucgucaucggacagugcauauacacguucacaucgauauucagccuuauaccaggcauagcccacucccucgcaguagaacucugcgucccaggccuccacggcugggccaccguacuccuacugcuaaccuucugcuucggcugggugcuaaucccaacaauaaccaugauacuccucaaaauacuuaucgccuucgccuaucugugcuccaaauauaauacagacuccaaauucaaaauccucguagaaaaagugaagaaagaguaccagaaaacaaugggaucgauggucugcgaggucugccaauaugaaugcgaaacugcaaaagaacucgaaucgcaccgcaaaucuugcucgaucggcucaugcccauauugccucaacccaagcgaggccacaccauccgcauuacaagcccacuucaaggucugcaagcucaccucacgcuuccaagaaaaccucaagaaaagccuaacaauguacgaaccgaugcaaggcugcuaccgcacccucucgcuguuccguuaccgcucacgcuucuucgucggucuaguauggugcaugcuucuugugcuggaacucaucguaugggccgcuucggccgaaacacaaaaccugaacgcaggauggaccgacaccgcacacgguuccgguauaauaccgaugaaagccgacuuagaacuugacuuuucccuuccauccucugcguccuacaccuaccgucgccagcuccaaaaccccgccaacgagcaagagaaaaucccauuccaccuacaaaucucuaaacaagucauccaugcagaaauacaacacuuaggacauuggauggacgcaaccuucaacuuaaaaacagcauuccacugcuacggguccugugaaaaauaugcauaccccuggcaaacagcaggcugcuucguugaaaaagacuacgaauacgaaacaggauggggcugcaaucccccagacugucccggaguaggcacaggaugcacggccugugggguguaccuugacaaacucaagagcgucggaaaaguauucaaaauaguuagccuccgcuacacccggaaagucugcauccaacuaggaacugaacagaccugcaaaaccguagacucgaacgacugccucauuaccaccucugucaaaguaugccuaaucgggaccaucucaaaauuccaacccucagacacccuauuauuccucggcccccuacagcaaggaggccugaucuucaaacaauggugcacuaccacaugucaauucggagaccccggggacauaauguccaccccaaccggcaugaagugucccgaauuaaacggcagcuuccgaaagaaaugcgccuucgccaccaccccuguaugucaauucgacggaaacaccaucucugguuacaaaagaaugguagccacuaaagauucuuuucaauccuucaacguaaccgaaccucacauaucuaccucagcacucgaauggauagacccagauuccucccuccgcgaccauauaaacgugauaguuucgagagaccucaguuuucaagaccuauccgagacacccugccaaguugaccuaacaaccuccgcgauagauggcgcauggggguccgguguaggcuucaaccucgucuguacuguaucucuuaccgaaugcuccgcauuuuuaacguccaucaaggcaugcgacgccgcgauguguuauggcucaaccaccacaaaccuaguacgcggacaaaacacaauccacgucguaggaaagggcggccacuccggcucaaaguucaugugcugccacgacaccaaaugcuccucaacgggccucguagcagcagcgccacaccucgaucguguaacuggcuucaaccaggccgacuccgacaaaauuuucgacgauggcgccccagaaugcggaaugagcugcugguucaaaaagcucggcgaauggguacucgggguacucaacggcaacuggauggucguagccgucuuaaucgcccucuuaauacugagcauuuuccucuucgcccucuguugcccccgcagacccuccuauaagaaagaacacaaaccuuag

SEQ ID NO: 15098 - RNA, 3447 nt, Artificial Sequence
  derived and/or modified CDS sequence (opt11) from PUUV(Umea/hu)__AY526218.1__GP
augggcaagcugagccccgugugccucuaccuguuccugcagugccuccugcuguggucccgcgggagcgcucggaaccuaaacgagcugaagauggagugcccgcacaccauuggccuggggcagggccucgucaucggguccguggaguugccgccggugcccguccagcaggucgagagccugaaacucgaauccagcugcaauuucgaccugcacaccagcacggccacccagcagagcuucaccaaguggacgugggagaugaaggacgaucuagcagagaacacgcaggccuccagcaccuccuuccagaccaagagcuccgaagugaaccuccgcggccugugccugaucccgccccucgugguggagaccgccucgcggacacgcaagaccaucgccugcuucgacaucuccuguaaccagaccgugugccagcccaccgucuaccugguuggccccauccagacgugcaucaccacaaagagcugccugcucgggcugggcgaccagcggauccaggugaacuacgagaagaccuacugcgucuccgggcagcugguggagggcgugugcuucaacccgguccacacgauggugcucagucagcccucccacaccuacgacaucgugaccaugaugguccgcugcuuccugguggugaagaaggucaccagcggggacagcaugaagaucgagaagaaccuggagacccuagugcagaagaccgacugcaacgccaacggcuuccaaggcuacuacaucugccugguuggguccagcuccgagccccuguacguccccacccucgacgacuaccgguccgcggaggugcugucccgcauggccuucgccccacacggcgaggaccacgacaucgagcguaacgccguaagcgcgcugcgcaucguggggaaggugaccggcaaagcacccuccacggaggccagcgacaccauccagggcaucgccuucuccgggagcccccucuacaccuccaccggcguccugacggcgaaggacaaccccguguacguguggagcccgggcaucaucauggagggcaaccacuccgucugcgagaagaagacccugccauugacuuggaccggguucaucccccugcccggcgagauuggcaagacgagccagugcaccguguucugcacccuggccgggccaggugccgacugcgaggcauacuccgagaccgggaucuucaacaucagcucccccacaugccucauuaaccgggcccagcgcuuccgaggcgccgagcagcagaucaaguucgugugucagcgcgucgacauggacaucaccguguacugcaacgggaugaagaaggugauccuuaccaaaacccuggucaucggccagugcaucuacaccuucacgucuaucuucucccucauccccggcaucgcgcacagcuuggccguggagcugugcgugcccgggcuccacggcugggccaccguccugcuguuacugaccuucugcuucggguggauccugaucccauuuaucgccaugaucagccugaagauccucaucgccuucgcguaccugugcuccaaguacaacaccgacagcaaguucaagauccugaucgagaagguuaaaaaggaguaccaaaagacaaugggcuccaugguuugugaggucugccaguacgagugcgagaccgccaaggaacucgagagccacaggaaguccugcccuaucggcagcugcccauauugccugaaucccuccgaagccaccaccagugcacugcaggcccacuuuaaggugugcaagcucacgucccgcgugcaggacaaccugcgcaagagccuggcggccuacgagccuaagcagggcugcuacagaacccucucccuguuccgguaccgcagccgguucuucgucggcuucaucuggugcauccugcuugugcuggagcugaucauaugggccgcguccgcggagacccaaaacuugaacagcggguggaccgacacggcccacggcuccgggaucaucccuaugcgcaccgaccuggagcuggacuucagccuccccuccagcgccucguacaccuaccgccggcagcugcagaacccggccaacgagcacgagaagauacccuuccaccuccagaucuccaagcaggucauccacgccgagauucagcaccugggccacuggauggaugcgaccuucaaccugaagacggccuuccacugcuauggcucgugcgagaaguacgccuacccguggcaaaccgccgggugcuucuucgaaaaggacuacgaguucgaauccagcuggggcugcaacccgcccgacugccccggggugggcaccgggugcaccgccugcgguguguaccuggacaagcucaaauccgugggcaaggucuucaagauuaucagccuccgcuacacgaggaaggcgugcauccagcuagggaccgagcagaccugcaaguccguggacagcaacgacugccuggugaccacgucagucaaggugugccugaucggcaccgugagcaaguuccagccuuccgacacccuccuguuccuggggccccuggagcaaggcgggcucauauucaagcaguggugcaccacgaccugucaguucggggacccuggcgacaucaugagcacccccaccgggaugaagugucccgagcugaacggcuccuuccgcaaaaagugcgccuuugccacgacgcccgucugccaguucgacgggaacaccaucagcggcuacaagcggaugauagccaccaaggacuccuuccagaguuucaacguuacggacccgcacaucuccaccagcgcccucgaguggaucgaccccgacuccagccuccgcgaccacaucaacguggucgugagccgggaccucuccuuccaggaccugagcgagacccccugccagguggaccucaccaccuccagcaucgacggggcguggggcuccggcgucggguucaaccuggugugcacggugagccugacagagugcuccaccuucuugaccagcaucaaggccugcgacuccgccaugugcuacggcagcaccaccaucaacuuaaugcgcggucagaacaccguccacaucgucggcaagggcgggcauuccggcagcaaguucaugugcugccacgacaccaagugcuccagcacuggucuuguggccgccgcgccccacuuggaccgggucaccggcuucaaccaggccgacuccgacaagaucuucgaugacggggccccggagugcggcaugagcugcugguucaagaaauccggcgaguggauccugggggugcugaacggcaacuggcucguggucgccgugcugguggcccuguucauccucagcaucuucuuauucacccugugcugcccacgccggccgaucuacgcgaaggagcacaagccauga

SEQ ID NO: 15099 - RNA, 3447 nt, Artificial Sequence
  derived and/or modified CDS sequence (opt11) from PUUV(P360)__L08755.1__GP
augggagagcucucacccgugugccucugccuucuucuccaaggccuccuacuuugcaacacgggcgcagcaagaaaccuaaacgagcucaaaauggagugcccccacaccauccgccucggucaaggacuugucgucggcucgguagaacuccccucgcuaccaauccagcaaguagaaacacucaaacuugaauccuccugcaacuucgaccuacacacgucaaccgcaggccagcaaucguuuacaaaguggacaugggagaucaaaggcgacuuggccgagaacacgcaagccuccucaaccagcuuccaaaccaaauccucagaaguaaaccuccgcggacucugcuuaauacccacucucgucguggaaaccgcggccagaaugagaaaaacaaucgccugcuacgaucugagcuguaaccaaaccguaugccagcccacgguauaccuuauggguccaauccaaaccugcaucacaaccaaauccugucugcuaucccuaggcgaccaacggauccaggucaacuacgaaaagaccuacugcgucuccggccaacucguugagggaauuugcuucaacccuauccacacgauggcgcugucccagccuucccacaccuacgacaucaugacuaugaugguacggugcuuccuugucauuaagaaagugacuucaggggauagcaugaaaauagaaaagaacuucgagacacuuguacagaaaaacggaugcacagcaaauaacuuccaaggguacuacaucugccuaaucggauccuccucggagccacuguacguccccgcucuagacgacuauagaagcgccgaaguccucucgagaauggcauucgcgccccacggcgaagaucacgacaucgagaaaaaugccgucucagccaugagaaucgccggaaaagucacgggcaaagccccgucuacagaaucaagcgacaccguccaagguaucgcguucucaggaucaccucucuacaccuccaccggagugcuuacgaguaaagacgaucccgucuacauaugggcaccaggcaucauaauggaagggaaccauucaauuugcgagaaaaagacccucccccuaacauggaccggcuuuaucucccuccccggcgaaaucgaaaagacgacucaaugcaccgucuucuguacucucgcgggcccaggagccgacugcgaagcguauucagaaaccgggaucuucaacaucucgaguccaacaugucuaaucaaccggguccaaagauucagaggguccgaacaacaaaucaaauucgucugccagcgaguggacauggacaucacaguauacugcaacggaaugaaaaaggugauccuaacaaaaacccuggucauaggccaaugcauauacaccuucacaucaauauucucacuaauccccggaguagcccacucacuagcagucgaacuaugcguccccggacuacacggaugggccacaaugcugcuauuauugaccuucugcuucggcuggguccuuaucccaaccauaaccaugauccuccuaaagauccucauagccuucgcuuaccucugcucuaaauacaacaccgacuccaaauucagaauacucaucgaaaaggucaaacgcgaauaccagaaaaccaugggaaguauggucugugaaguaugccaauacgagugcgaaaccgcgaaagagcuagagucccaccgcaaaagcugcuccauaggcagcugcccauacugccucaacccaucagaagccacuacaagcgcgcuccaagcacacuucaaagucuguaaauuaaccucccgauuccaggaaaaccuacgcaagucccugaccguuuacgaacccaugcagggcugcuacagaacccuaucucuauuucgauaccgcucccgauucuuuguuggucuaguauggugcguccuccuaguccuagaacuaauagucugggcggcaagugccgaaacacaaaaucuaaaugcaggcuggaccgauaccgcgcacggauccggcauuauacccaugaaaacagaccuggaacuugacuucucgcuacccagcucagcgagcuacaccuaccgucgacaacugcaaaauccagcgaaugagcaagagaaaauccccuuccaucugcagcucucaaaacagguaauccacgccgaaauccagcaccucggucauuggauggaugccaccuuuaaccuuaaaacggccuuccacugcuacggaaguugugaaaaguacgccuauccguggcaaaccgcaggcugcuucaucgaaaaggauuacgaauacgaaacaggaugggguugcaacccgcccgacugccccggcgugggcaccggaugcacugcaugcggcgucuaucucgacaaacuuaaauccgucggaaaagucuucaaaauaguaagccugcgcuacacacgcaaagucuguauccagcucggaaccgagcagaccugcaaaaccgucgauucaaaugacugucuaauuacaacuagcgugaaagucugccugaucgguaccauaagcaaauuccaaccuuccgacacccuacuuuuucuaggcccacuccaacaagggggccucaucuucaaacaguggugcacaaccaccugucaauucggcgacccuggagacauaauguccacccccaccggcaugaaaugccccgaacuaaacggcuccuuccgcaagaaaugcgccuucgcaacaacgcccguaugccaauuugacggcaacacaauaucuggauacaaacgaaugaucgcuacgaaagacuccuuccaaucguucaacgucacagagccccacaucuccacgagcgcgcucgaauggauagacccagacucaagccuacgcgaucacaucaacgucauugucagccgggaccuaaguuuucaagaccuaucggaaaccccaugccaaauagaccucgcgaccgccuccauagacggcgcguggggauccgguguaggauuuaaccucguauguaccguaucgcugacagaaugcagugccuuucuuacaucaaucaaggcaugugacgccgccaugugcuacggauccaccacugcaaaucucguccgaggacaaaauacuauacacauaguagguaaaggcggccacucaggcuccaaauucaugugcugccacgauaccaaauguucuucaacaggacugguagcagccgcgccacaccuugaccgcguaacaggauauaaccaagccgacuccgacaagauauucgacgacggcgcccccgaaugcggcaugagcugcugguucaaaaagucuggugaauggauauuagggguccucaacggcaacuggaugguagucgcaguacucguaguccuccucaucuuaucaauccuccuguucacccuaugcugcccgagaagaccuuccuaccgaaaagaacauaaacccuaa

SEQ ID NO: 15100 - RNA, 3447 nt, Artificial Sequence
  derived and/or modified CDS sequence (opt11) from MUV(11-1)__JX028272.1__GP
augggcaagaucagccccguguaccuguaccugcuguuccagggccugcuccuguggcgcgacggccuggcccggaaucucaacgagcugaagauggaguguccgcauacaaucgggcugggccaagggcucguaaucggcuccguugagcugccgcccgucccccugcgccagguagagagccuaaaacuggaguccagcugcaacuucgaccugcacaccucuacggccacccaacagagcuucaccaaguggaucugggaguccaagaacgaccucacugacagcacgcaggcguccagcaccaguuaccagaccaagagcaccgaggugaaccucaagggccugugccucgugccaacucuggucaucgaaaccgccgcacggacccgaaagaccauugccugcuucgaucuguccuguaaccagacggugugccagcccaccguguaucucaucggccccauacagaccugcauaaccaccaagagcugccuaaucggccugggggaucaacggauacaggucaacuacgagaagaccuacugcguauccggccagcuuguggagggggucugcuucaaccccauccacaccauggcccugucccagccaucccacaccuacgacguggugacgaugaugguccgcugcuuccuggugguuaagaaggucaccagcggcgauuccaugaagaucgagaagaacuucgagacccucgugcaaaagaccgggugcagcaacaauaacuuccagggguacuacguaugccugaucggcagcuccagcgaaccucuguacgucccaacgcucgaugacuaccgauccgccgagauucugucucgcauggccuucgcgccccacggugaggaccaugacauagagcggaaugccaucuccgccaugcgcaucguaggcaaggugacgggcaaggcgccgucauccgagucauccgacaccguccaagggguggcauucagcggcaacccacuguacaccuccacggggguccugaccucaaaggacgacccgguguacguaugggcccccgguaucaucauggaggggaaccacuccgucugcgacaagaaaacuuuaccgcugacauggacgggcuacaucccccucccaggcgagaucgagaagaccacccagugcaccguguucuguacgcuggcuggucccggcgcggacugcgaggccuacagcgagaccgggaucuucaacaucuccagcccaaccugucugaucaaccgcgugcagcgcuuccgaggagccgaacagcagauaaaguucgucugccagcgcguggacauggacaucaccguauacugcaacgggaucaagaaagucauucucaccaagacgcugguaaucggacaauguaucuacacauucaccaguaucuucagccucaugcccggcguagcccacucccucgccgucgagcugugcgugcccgggcugcacggcugggcaaccaugcuucugcugcucacauucugcuucggauggauccugaucccaaccauaacccugauucugcugaagauccugcuggcuuucgcguaugugugcaguaaguacaacacagacagcaaguucaaaauccuaauagagaaggugaagcaggaguaccagaagacgaugggcuccauggugugcgaggugugccaacacgaaugcgagaccgcgaaggagcuggagagccauaagaaguccugcccgauagggagcugccccuauugucuuaaccccgcggaggcgaccaccucagcccuccaggcacauuucaagguaugcaagcugacaagcagauuccaagagaacuugcgcaaaagccucacgguguacgaacccaagcaggggugcuaccggacccugagccuguuccgcuaccggucccgcugcuucgugggucucaucuggugcauccuccugacauuggagcugaucguaugggccgccagcgcggaaacucuaaacuuaaacccgggguggaccgauaccgcucacggauccgggaucgugcccaugaaaaccgaccuggaguuagacuucagccuacccuccagcgccucauauacguaccggaggagccuucagaacccggccaaugagcaggagcaggucccguuccaucuucagaucgagaaacaggugauccaugccgagauucagcaccugggccacuggauggacgccaccuucaaccucaagacugcauuccauugcuacggcgccugcgagaaguacgcguacccuuggcagaccgcggggugcuucguggagaaggacuucgaguucgaaaacggaugggggugcaacccgcccgacugccccggcguggggacugguugcaccgcaugcggcgccuaccuggacaagcucaagagcgucgguaagguguucaagaucgugagccugcgcuauacccggaaagccugcauccagcuggggaccgagcagacgugcaagaacguggacucaaacgacugccucgugacaacuuccguuaaggucugucugauagggaccaucagcaaguuccagcccagugacacgcuccuguuccucggcccccuugagcagggcggaaucaucuucaagcaguggugcaccacuaccugccaguucggugauccuggggacaucaugaguacucccauugggaugaagugucccgaacucaauggguccuucaggaagaagugcagcuucgcaaccacccccgugugccaguucgacggaaacaccauauccggguauaagcggaugaucgccaccaaggacuccuuccaguccuucaacgugacggagccgcacauuucugccagcgcccuggaguggaucgaccccgacagcucacugcgggaccacauuaacguggucgugggacgggaccuccccuuccaggaucugagcgagacccccugccagaucgaccuguccaccagcuccaucgacggcgccugggggagcggggucggcuucaaccucgugugcuccguuagccugacagaaugcuucacguuucugaacagcaucaaggccugugacaccgcgaugugcuacggcuccaccaccgccaaucuaguccgcggucagaacacggugcacguggucgguaagggagggcauucuggcuccaaguucaugugcugccacgacaccaaguguucuaacaccgggcugcuggccgccgcgccgcaccucgaccgugucacgggcuacaaccaggccgacuccgacaaaguguucgacgacggcgcccccgagugcgggaugacguguugguucaagaaguccggugaguggaucauggggguccuguccgguaauuggauggugguggccguccugaucacccuccucguguuaucgauauuccucuucgcgcugugcuguccccgccgggcggccuacaagaaggagcauaaaccuuga

SEQ ID NO: 15101 - RNA, 3447 nt, Artificial Sequence
  derived and/or modified CDS sequence (opt11) from MUV(11-4)__JX046483.1__GP
auggggaaaauuucgcccgucuaucucugccuccuccugcagggccuccugcuauggcgcgacggccuagcccguaaccucaacgagcucaagauggaauguccccauacgaucggccuugggcaaggacucgucauaggcuccguagaacucccaccuguaccauugcggcaaguagaaucgcucaagcucgaaucuucaugcaauuucgaccuacacaccuccaccgcaacucaacaguccuucaccaaauggaucugggaauccaaaaacgaccuaacugacucaacccaagccucaucaacaucauaccaaacaaaauccaccgaaguaaaccucaaaggccucugccuaguucccacacuuguaauugaaacagccgcgcgaacccguaaaaccaucgccugcuuugaccucucgugcaaccagaccgucugucaaccuaccgucuaccugauaggcccaauccaaacaugcaucacaacaaaaucaugucuuaucggucugggggaucaacguauacaagucaacuacgagaaaacauacugcguaagcggccagcuuguagaaggcgugugcuucaaccccauccacacgauggcgcucucccaacccucccacaccuacgacguggucaccaugaugguacgauguuuccucguaguaaagaagguuaccuccggagacucaaugaagaucgagaaaaauuucgaaacccucguccagaaaacuggaugcucaaacaauaacuuccaaggauacuacguaugccucaucggguccuccucagaaccccuuuacguaccaacacucgacgauuaccgcagugcugaaauacugucccgcauggccuucgcgccccauggagaagaccacgacaucgaacgaaaugccauauccgccaugcgaauaguaggcaaagucacgggaaaagccccaucuucggaaucgagcgacacaguacagggaauagcauucucgggaaacccacucuauacguccaccggagugcucacgagcaaagacgacccaguguacgugugggccccugguaucaucauggaaggcaaccacucggucugcgacaagaaaacucuccccuugacauggacaggcuacaucccauuaccgggcgaaaucgagaaaacgacccaaugcacaguauucugcacccuugccggaccuggagcagacugugaagcguacucggaaaccggcaucuucaauauaucuuccccgaccugccuuaucaaccggguccaacgguuccgcggugcugaacaacaaaucaaauucguaugccaaagagucgacauggacauaacggucuacugcaacggcauuaagaaagucauccuuaccaaaaccuuaguuauaggccagugcauauacacuuucacaagcauauucagccucaugccuggaguagcccacucacucgcagucgaacucugcguacccggacuacacgguugggcaacaaugcuucuccugcucaccuucugcuucggcuggaucuuaauacccaccauaacccuaauccugcugaaaauccuacuugcauucgccuaugugugcucgaaauacaacaccgacagcaaauucaaaauccuaaucgaaaaagucaagcaagaauaccagaaaaccauggguucaauggucugcgaaguaugccagcacgaaugcgagacggccaaggaacuggagucccacaagaaaucaugcccuaucgguucuugcccauacugccugaaccccgcagaggcaaccaccucagcgcuacaggcccacuucaaagugugcaagcucaccucacgcuuccaagaaaaccuacguaagagccuaacggucuacgaacccaaacaaggcuguuaccggacacuuagccuuuuccguuacagaucaagaugcuucgucgggcucaucuggugcauacuccucaccuuggaacuuaucguaugggccgccuccgccgaaacccuaaaccuaaacccgggcuggaccgacacagcacacggcuccggaauaguccccaugcgaacugaccucgagcuggacuucucucuacccagcagcgccuccuacaccuaucgccguucgcuccagaacccagcgaaugaacaagagcaaauccccuuccaccuccagauugaaaaacaaguaauacacgccgaaauccaacaccuaggacacuggauggacgcaaccuucaacuugaaaaccgccuuccacugcuacggagcaugcgaaaaauacgccuaccccuggcaaaccgcaggcugcuucguagaaaaggacuucgaguucgaaaacggcuggggaugcaacccacccgacugccccggcgucggcacggguugcacugccugcggagcauaccuggacaaacuaaaaucagucgggaaagucuucaaaaucgucucccuacgauacacaagaaaagcaugcauacaacucggaacagaacaaacuugcaaaaacguagauuccaaugacugccuaguaaccacuuccguaaaggucugccucauaggaacuaucuccaaauuucaacccuccgauacccuucuguuccucggaccgcuagaacaaggcggcaucaucuuuaaacaauggugcaccacaacaugucaauucggcgacccaggcgacaucaugucgacacccaucggcaugaaaugcccagaacugaacgguucauuccgcaagaaaugcucauucgcuaccacacccgucugccaauucgacggaaacacgaucucgggauacaagcgcaugauugcuacaaaagacagcuuccaauccuucaacgucacagaaccgcacaucagcgccagcgcccuagaauggaucgauccugacuccagccuaagagaccacauaaacgucgugguagggcgcgaccuaccuuuccaagaccuauccgaaacacccugccagaucgauuuauccaccagcuccaucgacggcgcauggggcagcggcgucggcuucaaccucguauguagcguuucacuaaccgaaugcucaacauuccucaccuccauaaaagcaugcgacaccgcaauguguuacggcagcaccacggccaaccucguuaggggucaaaacacuguccacguaguagguaaaggagggcacuccgguuccaaauucgucugcugccacgacacgaaauguuccaacacugggcuacucgccgcugccccgcaucuagaccgcguaaccggguacaaccaagccgacucugacaaaguauucgacgauggcgcacccgaaugcggcaugacgugcugguucaaaaaguccggcgaauggauaaugggcgugcucuccggcaacuggaugguagucgcgguccuuaucacccuccuaguccuauccauauuccuuuucgcccuaugcugcccacgacgcgcugcauacaagaaagaacacaagccguaa

SEQ ID NO: 15102 - RNA, 3447 nt, Artificial Sequence
  derived and/or modified CDS sequence (opt11) from MUV(11-5)__JX046486.1__GP
augggaaaaauaucaccagucuaccuuugcuuacuucugcaaggccuccuccuguggcgcgauggacucgcccggaaucuaaacgagcucaagauggaaugcccacacaccauaggccucggucagggccuuguaaucggcucaguugaacugccaccugucccucuccgacaagucgagucccuaaaacuugaguccucaugcaacuucgaccuccacacguccacagcaacacaacaauccuucaccaaauggauuugggaaagcaaaaacgaccucaccgacucuacccaggcuagcucgaccuccuaccaaaccaaguccaccgaaguaaacuuaaaagggcuaugucucguucccacccuagucauagaaaccgccgcccgcacucgcaaaacgaucgccugcuucgaccucagcuguaaccagaccgucugccaaccuaccguauaucucauaggcccgauccagacaugcaucaccacuaaaagcugccugauaggccuaggugaccaacggauccaggucaacuacgagaaaacauacugcgucuccggucaacucguggaaggggucuguuucaaccccauucacaccauggcccugagccagcccucccacaccuacgacgucguaaccaugauggucagaugcuuccucgucguaaagaaagugacgaguggcgauuccaugaaaaucgagaaaaacuucgaaacccucguccagaaaacugguugcagcaacaacaacuuccagggcuauuacguaugccucauagguagcucaucugaaccacuguacguucccacacuagacgacuaccgcuccgccgaaauccucucccgcauggccuucgcaccccacggcgaagaccacgacaucgaacgaaacgccauaagcgccaugagaaucguagggaaagucaccggaaaggccccguccucagaaaguuccgacacagugcaagggaucgccuucucugggaacccacuauacacaagcaccggcguccucacuuccaaagacgaccccguguacguuugggcucccggaaucauaauggaaggcaaccacucuguaugcgacaagaaaacgcucccccucacauggacaggcuauaucccguuaccaggcgaaauugagaaaacaacccaaugcaccgucuucugcacacuugccggcccaggggcugacugugaagcguacagcgaaaccgggaucuucaauaucuccuccccaaccugccucaucaacagaguucaacgcuuccgcggggccgagcagcagauaaaauucgugugccagcgcgucgacauggacaucacaguauauugcaacgguaucaagaaagucauccuaacuaaaacccucgucauaggccaaugcauauacacuuucaccucuaucuucagucucaugcccgggguugcucacucucuagccgucgaacuaugcguccccggccuccacggaugggcaaccaugcuucuccuccucaccuucugcuucggcuggauccucauccccacaaucacccuuauccuccucaaaauccuacuagcauucgcuuacgucugcuccaaguacaacaccgacagcaaguucaaaauucuuaucgaaaaaguaaagcaagaguaccagaaaacaaugggaagcaugguaugugaagugugccaacacgagugugaaacagcaaaggaacucgaaucccacaaaaaguccugcccaaucggauccugcccuuacugccucaaccccgccgaagcgacaaccuccgcgcuccaggcccacuuuaaagucuguaaacucaccucacgcuuccaagaaaaccuacgcaagagccucacuguauaugaacccaagcagggaugcuaccgaacauugucacuguuccgauaccgcuccaggugcuucgucggacucauauggugcaucuuacucacccuugaacucgucgucugggccgcuucagccgagacgcucaaccucaacccugguuggacagacaccgcacauggcucaggcauagucccaaugcgcacugaucucgaacuagauuucucccuuccuuccucggccuccuacaccuaccgccgcucucuccaaaauccagcaaacgaacaagagcaaaucccuuuucaccuacaaauagagaaacaaguuauucacgccgaaauccaacaccuuggccacuggauggacgccaccuuuaaccucaaaacagcguuccauugcuacggggccugugagaaauacgccuacccauggcagaccgccggcugcuucgucgaaaaagauuucgaguucgaaaacggcuggggaugcaacccgcccgacugcccaggcgugggcaccggcugcaccgcuugcggugccuaccuugacaaacuuaaaagcgucgguaaagucuucaaaauaguaucccuacgauacacccgcaaggcaugcauccaacuaggaaccgaacagaccuguaagaacguugacuccaacgacugucucgucacgaccuccguuaaaguaugcuugaucgggacaaucaguaaauuccaacccagcgacaccuuacuguuccucggaccccuugaacaaggggguauuauauucaaacaauggugcaccacaaccugccaauucggggaccccggagacauaaugagcacacccaucggcaugaaaugcccagaauuaaauggcagcuuccgcaaaaagugcaguuucgccacaaccccggucugucaauucgacggaaacaccaucuccggcuacaaacggaugaucgcaaccaaagauuccuuucaauccuucaacgucaccgaaccccacauauccgccagcgcccucgaguggaucgaccccgacucaucacuacgugaccacauuaacguagucguuggaagagaccuacccuuccaagaccuaucagaaacacccugccagauagaccuguccaccuccucgauugacggcgcuuggggcucaggagucggcuuuaaccugguaugcucaguuuccuuaacagaaugcaguaccuuccuaacaucgaucaaagccugugacacugccaugugcuacggaucaaccacagccaaccucguccgcggucaaaacaccgugcacgucgucggaaagggaggucauucaggaucuaaauucguaugcugucacgauacaaaaugcagcaacacuggacuauuagccgcugcaccccaucucgaccgcguuacaggcuacaaccaggccgacucagacaaagucuucgacgacggcgcacccgagugcgguaugacaugcugguucaagaaaucgggggaauggaucaugggaguacuuagcggcaauuggauggucguagcaguccucaucacucuccuggucuuguccauauuccucuucgcgcucugcugcccacgacgggccgcauacaagaaagagcacaaaccauaa

SEQ ID NO: 15103 - RNA, 3408 nt, Artificial Sequence
  derived and/or modified CDS sequence (opt11) from SANGV(SA14)__NC_034516.1__GP
augaucauguggggccugcuccugcuggccgccaucacauucccgugccagucgcucaagaacguguacgauaugaagaucgagugcccgcauuccgucaacuucggggagagcuccgugaugggcaaagugcaacugcccagccuguccaucaccgaggccgagcagcucguccccgagagcuccugcaacauggacaaccaccagucccuguccgugcugcagaaggccacaaagaccaccuggcgcaagaaggccgaccacagcaacgccgggaaggacuccuacgagcucaucaccagcgaaauccaguucaagggcgugugcucccugacgcacaagaugaucgaggagagccaccggcugcgccgguccgucaucugcuacgaccucagcugcaacaccacccacugcaagcccacccuguacaugguggugccgguccacuccugcaacaugaugaaguccugccugaucgggcucggccccuaccgcauccaggugguguacgagagaacguacugcaccgucggcgugcugaacgaggggaagugcuucgugcccgaccaguccgucgccaacaucguuaagaacggcauuuucgacaucgugagcguccagaucaucugcuucuucauccgcaucaaggggagcaccuacaagauccuggagaccgugaagacggccaugaacggcaagugcaaugggaccgacgacaaggugcaggguuacuauaucugccuccugggcgggaacuccggccccaucuacgucccgagcgguaccgacuuccgggccauggaggcccuggccaacaugcuccgcgcgccccacggcgaggaccacgaccugcccggcgaggagcuggccuccuacagcaucgccggcaccaucgagggcaagaucccacacacggcauccagccagaaccucgaguucacagccuacuccgggaucccgagcuacucuagcuucucagugcacacccucacccaggacggccagcugagcuacucccccggccucuuccccaaccugaaccaaagcgacugcaagaagaacgcgcuaccccucaucugggaggggacgaucgaacugccgggcuacuacgaggccauccaccccugcaacguguucugcgucuucuccgggcccggcgccagcugcgaggccuucuccgaaggcgggaucuucaacaucaccagcccgaccugccugguguccaagcagaaccgguuccgcgccgcggagcagcagaucaccuucgucugccagcggguggacauggacaucaucaucuacugcaacgggcagaggaaggugauccucacgaagacgcuggucaucggccagugcaucuacagcaucaccagccuguucucccuccugcccagcguagcccacuccaucgccaucgagcugugcgugccaggcuuccacgggugggccaccgccgcgcuccugacgacguucugcuucggcuggcugcucauccccagcaucaccuacaucguccugcugauccucaaguucaucgccgccaucuuccacaacaccacgcaggagaacaaguucaaggccauccugcggaagaucaaggaggaguucgagaagaccaagggguccauggugugcgacaucugcaaguacgagugcgagaccggcaaggagcugaaggcccacaaucucagcugcaaccagucccagugccccuacugcuucacccacugcgagaugacggagagcgcguuccaggcccacuacaaggugugccaggccacccaccgcuuccgggaggaccuuaagaagaccaucaccccgcagaccaucucccccgggugcuaccgcacgcugaaccuguuccgguacaaaagccgcugcuacauccucaccgucuggcugugccugcucauccuggaauccaucgcgugggcggccagcgcuuccgaaaccagccugaacccccucuggaccgacaacgcccacggcgugggcagcgugcccaugcacacggaccuggagcuggacuucagccucccguccagcagcaaguacaccuacaagcggaagcugaccucccccaccaaccccgagcaggccgucagccugcacaucgagaucgagucccaggggaucgcggccgacgugcacagccucggccacugguacgacgcccgccugaaccugaagacguccuuccacugcuacggggccugcaccaaguaccaguacccguggcacaccgccaagugccacuucgagcacgacuuucaguacgagaacagcuggggcugcaacccgcccgacugccccggcguggggaccggcuguacggcuugcgggcucuaucuggaucagcugaaacccgucggcuccgccuauaagcucaucaccgugcgguacagccgcaaggugugcguccaguucggggaggagaaccuuugcaagaccaucgacaugaacgacugcuucaugucccgccacgugaagguguguaucaucggcaccgucucuaaguucucccagggcgacacgcugguguuccucgggccccuggagggcgggggccugaucuucaaagacuggugcaccagcacgugccaguacggggaccccggcgacaucaugagcccccgugaccguggcuucagcugcccggaguuccccggguccuucaggaagaagugcaauuucgccaccacccccgucugugaguacagcgguaacauggucuccggguacaagaaggugauggccaccaucgacagcuuccaguccuucaacaccagccucauccacuucaccgaggagcgcaucgaguggaaggacccggacggcaugcugcgggaccaccugaacauccucgugacgaaggacaucgacuucgagaaccugggggagaacccgugcaaggucggccugcagaccagcuccauugagggcgccuggggcagcggcgucggguucacccuugugugccaggucucccugaucgacugcgcgcgcuuccugaccagcaucaaggcaugcgacauggccaucugcuacggcgcccaguccgugagccucgugcgggggcagaacacggucaagaucacuggcaagggcgggcacuccggcagcuccuucaagugcugccacgagguggacugcagcuccaccgggcugcaggcgagcgcgccccaccuggacaaggugaacggcaucagugagcaggagaacgauaaggucuacgacgacggcgcgccccagugcggggugagcugcugguucgugaaguccggcgaguggaucagcgggauccuccacggcaacugggucgugguggucgugcuggucauccugcuccuguucucccugauucuucugagcauccugugcccaguccgcaagcacaagcggaguuga

SEQ ID NO: 15104 - RNA, 3408 nt, Artificial Sequence
  derived and/or modified CDS sequence (opt11) from SANGV(SA14)__NC_034516.1__GP
augaucauguggggucugcuccugcuggccgccaucaccuuccccugccagagccucaagaacguguacgacaugaagaucgagugcccgcacuccgucaacuucggggagagcuccgugaugggcaaggugcagcugcccagccuguccaucaccgaggccgagcagcucguacccgagagcucgugcaacauggauaaucaccagagccugucugugcugcagaaggcuacgaagaccaccuggaggaagaaagccgaccacagcaacgccgggaaggacuccuacgagcucaucaccucagagauccaguucaagggagugugcucccugacgcacaagaugaucgaggagagccaccggcugcgccgguccgucaucugcuacgaccucagcugcaacaccacccacugcaagcccacccuguacaugguagugccgguccacuccugcaacaugaugaaguccugccugaucgggcucggccccuaccgcauccaggugguguacgagcggacguacugcaccgucggggugcugaacgaggggaagugcuucgugcccgaccaguccgucgcaaacaucgugaagaacggcaucuucgacaucgugucgguccagaucaucugcuucuucauccgcaucaaggggagcaccuacaagauccuggagaccgugaagacggccaugaauggcaagugcaacggcaccgacgacaaggugcagggcuacuacaucugccuccugggcgggaacuccggccccaucuacgucccgagcgggaccgacuuccgggccauggaggcccuggccaacaugcuccgggcgccccacggcgaggaccacgaccugcccggcgaggagcuggccuccuacagcaucgccgggaccaucgagggcaagaucccccacacggccucaagccagaaccucgaguucaccgccuacuccgggauaccgagcuacuccagcuucuccgugcacacccugacccaggacggccagcuguccuacucccccggccucuuuccaaaccugaaccagagcgacugcaagaagaacgcgcugccucucaucugggaggggacgaucgagcugccgggcuacuacgaggccauccaccccugcaacguguucugcgucuuuuccgggcccggcgccucaugcgaggccuucagcgaaggcgggaucuucaacaucacaaguccgaccugccugguguccaagcagaaccguuuccgcgccgcggagcagcagaucaccuucgucugccagcggguggacauggacaucaucaucuacugcaacgggcagcgcaaggugauccucacgaagacccuggucaucggccagugcaucuacagcaucaccagccuguucucccuccugcccagcguggcccacuccaucgccauagagcuaugcgugcccggcuuccacgggugggccaccgccgcgcuccuaacgaccuucugcuucggcuggcugcucauccccagcaucaccuacaucguccugcugauccucaaguucaucgccgccaucuuccacaacaccacgcaggagaacaaguucaaggccauccugcggaagaucaaggaggaguuugagaagaccaagggguccaugguuugcgacaucugcaaauacgagugcgagaccggcaaggagcugaaggcccacaaccugagcugcaaccagucccagugccccuacugcuucacccacugcgagaugacggagagcgcguuccaggcccacuacaaggugugccaggccacccaccgguuccgggaggaccugaagaagaccaucaccccgcagaccaucucccccgggugcuaccgcacgcugaaccuguuccgguacaagagccgaugcuacauccucaccgucuggcugugcuuacucauccuggaguccaucgccugggcggccagcgccuccgaaaccagccugaacccccucuggaccgacaacgcccacggcgugggcuccgugcccaugcacacggaccuggagcuggacuucagccucccuuccagcagcaaguacaccuacaagcguaagcugaccucccccaccaaccccgagcaggccgucagccuacacaucgagaucgagucccaggggaucgcugccgacgugcacagccucggccacugguacgacgcccgccugaaccugaagacguccuuccauugcuacggggccugcaccaaguaccaguacccguggcacaccgcgaagugccacuucgaacacgacuuccaguacgagaacagcuggggcugcaacccgcccgacugccccggcguggggaccggcugcacggcgugcgggcucuaccuggaccagcugaagcccgucggcucugccuacaagcucaucaccgugcgguacagccgcaaggugugcguccaguucggggaggagaaccugugcaagaccaucgacaugaaugacugcuucaugucccgccacgugaaggugugcaucaucggcaccgucagcaaguucucccagggcgacacacugguguuucucgggccccuggagggcgggggccugaucuucaaggacuggugcaccagcacgugccaguacggggaccccggagacaucaugagcccccgggaccgcggcuucagcugcccggaguuccccggguccuuuaggaagaagugcaacuucgccaccacccccgugugcgaguacagcggcaacauggucuccggguacaagaaaguuauggccaccaucgacagcuuccaguccuucaacacuagccucauccacuucaccgaggagcgcaucgaguggaaggaccccgacggcaugcugcgggaccaccugaacauccucguaacgaaggacaucgacuucgagaaccugggggagaacccgugcaaggucggccugcagacaagcuccaucgagggcgccugggggagcggcgugggguuuacccucgugugccaggucucccugaucgacugcgcgcgcuuccugaccagcaucaaggccugcgauauggccaucugcuacggcgcccaguccgugagccucgugcgggggcagaacacggucaagaucaccggcaagggcggucacuccggcagcuccuucaagugcugccaugagguggacugcagcuccaccgggcugcaggcgagcgcgccccaccuggacaaggugaacggcaucuccgagcaggagaacgacaaggucuacgaugacggcgcgccccaaugcggggugagcugcugguucgugaaguccggcgaguggaucagcgggauccuccacggcaacugggucgugguggucgugcuggugauccugcuccuguucucccugauccuccugagcauccugugccccguccgcaagcacaagcgguccuga

SEQ ID NO: 15105 - RNA, 3402 nt, Artificial Sequence
  derived and/or modified CDS sequence (opt11) from SEOV(L99)__AF288298.1__GP
auguggagccuccuccugcuggccgcccucgugggccagggguuugcccugaagaacgucuucgacaugcgcauccagugcccccacuccgugaacuucggcgagaccagcguguccggguacaccgagcugccgccccugagccugcaggaggccgagcagcugguccccgaguccuccugcaacauggacaaccaccagucccucagcacgaucaacaaacugaccaaggugguguggcggaagaaggccaaccaggagcuggccaaccagaacuccuucgaggucguggagagcgagguguccuucaagggccucugcaugcugaagcacaggauggucgaggagucauaccggaaccgccggagcgugaucugcuacgaccuggccugcaacagcaccuucugcaagcccaccguguacaugaucgucccgauccacgccugcaacaugaugaagaguugccucaucgggcugggccccuaccgaauccaggugguguaugagcggacguacugcaccaccggcauccugaccgaggggaagugcuucguccccgacaaagcaguggugagcgcccucaagcgcggcauguacgccauugcguccaucgagacgaucugcuucuucauccauaagaaggggaacaccuacaagauagucaccgccauaaccagcgccaugggcuccaagugcaacaacacggacaccaaggugcagggguacuacauaugcaucaucggcggcaacagcgcacccguguacgccccggcgggggaggacuuccgggccauggaggucuucagcggcauaaucaccagcccccacggggaggaccacgaccugcccggggaggagaucgccaccuaccagaucucuggccagaucgaggccaagaucccccacacgguguccagcaagucccugaagcucaucgccuucgcggggaucccgagcuacuccagcaccuccauccuggccgccagcgaggacggccgcuucauuuucucccccgggcuguuccccaaccucaaccagagcgugugcgacaacaacgcccugccccugauauggcggggccuaaucgaccugaccggguacuacgaggccguccacccgugcaacgucuucugcguccuguccggccccggcgcgagcugcgaggccuucuccgagggcgggaucuucaacaucaccagccccaugugccucguguccaagcagaaccgcuuccgugccgcugagcagcagaucagcuucauaugccagcgcguggacauggacauuaucgucuacugcaacgggcagaagaaaacgauacuaaccaagacccuggugaucggccagugcaucuacaccaucacgucccucuucagccugcugcccgggguugcccacagcaucgcgaucgagcucugcgucccaggcuuccacggcugggcaaccgccgcccugcugauuaccuucugcuucggaugggugcucauccccgcgugcacgcuggccauccugcucgugcugaaguucuucgccaacauccugcacacguccaaccaggagaaccgguucaaggccauccuccgcaaaaucaaggaggaguucgagaagaccaagggcagcauggucugcgagaucugcaaguacgagugcgagacccugaaggagcugaaggcgcacaaccucuccugcgugcagggggaaugccccuacugcuucacccacugcgagcccacggagaccgcgauccaggcucacuacaaggugugccaggccacccaccgguuccgcgaggaccugaagaagaccgucacgccgaagaacaucggccccgggugcuaccggacccugaaccuguuccgcuacaagagccggugcuauauccucaccauguggacccugcugcucaucaucgaguccauccugugggccgccagcgcggccgagaucccccuggugccccucuggaccgacaacgcccacggcgugggcuccgucccgaugcacacggaccuggagcuggacuucagccuccccuccagcuccaaguacgccuacaagcgccaucugaccaaccccgugaacgaccagcagagcgugucccugcacaucgagaucgagagccaggggaucggcgccgacguccaccaccucgggcacugguacgacgcgcgccugaaccugaagaccaguuuccacugcuacggcgccugcaccaaguaccaguacccguggcacacggccaagugccacuucgagaaggacuacgaguacgagaacagcugggccugcaacccgcccgacugccccggcguggggaccggcugcaccgcgugcgggcucuaccuggaccagcugaagcccgugggcaccgccuucaagaucaucuccguccgcuauagccgcaaggugugcgugcaguucggggaggaguaccucugcaagacgaucgacaugaaugacugcuucgucacccggcacgccaagaucugcaucaucggcacggugagcaaguucucccagggggacacccugcuguuccucgggcccauggagggcgggggcaucauauucaagcacuggugcacgagcacgugccacuucggggaccccggcgacgugaugggccccaaggacaagccguucucuugccccgaguuccccgggcaguuccgcaaaaagugcaacuucgccaccacccccaucugcgaguacgacggcaacaucaucucaggguacaagaagguccuggccaccaucgacuccuuccagagcuucaacaccuccaacauucacuucaccgacgagcggaucgaguggcgcgacccggacggcaugcugcgggaccacaucaacaucgugaucagcaaggacaucgacuucgagaaccucgcggaguccccuugcaagguggggcugcaggccgccaacaucgagggcgccuggggcagcggggucggcuucacccugacgugccaggugucccucaccgagugccccaccuuccugacaagcaucaaggccugcgacauggcgaucugcuacggggccgaguccgugacgcugagccgcggccagaacaccguccggaucaccgggaagggcggccacuccgggagcuccuucaagugcugccacggcaaggagugcagcuccaccgggcuccaggcuagcgcgccccaccuggacaaggugaacggcauaagcgagcuggagaacgagaagguguacgacgacggcgccccggagugcggggucacgugcugguuuaagaaauccggcgagugggugauggggaucaucaacggcaacugggugguccucaucgugcugugcgugcugcuccuguucagccucauccuccuguccauccugugccccguccgcaagcacaagaaguccuga

SEQ ID NO: 15106 - RNA, 3402 nt, Artificial Sequence
  derived and/or modified CDS sequence (opt11) from SEOV(Rn10-134)__JF693883.2__GP
auguggagccugcuccuucuagccgccuuagugggccagggcuucgcccugaagaacgucuucgacaugcgcauccagugcccccacuccgugaacuucggugagaccagcguguccggauacaccgagcugccgccccucagccugcaggaggccgagcaguugguccccgaguccagcugcaacauggacaaccaccagucccucagcaccaucaacaagcugaccaagguuaucuggcggaagaaggccaaccaggaguccgccaaucagaacagcuucgagguggucgaguccgaggugagcuucaagggccugugcaugcucaagcaccgcaugguggaggagagcuaccggaaccgccggagcgucaucugcuacgaccuggccugcaacuccaccuucugcaagcccaccguguacaugaucgugccgauccacgcgugcaacaugaugaaguccugccugaucgggcucggccccuaccgcauccagguuguguacgagcggacguacugcaccaccggcauccugaccgaggggaagugcuucgugcccgacaaggccgucguaagcgcccugaagcgcggcauguacgccaucgcgagcaucgagacgaucugcuucuucauccaccagaaggggaacaccuacaagaucgugaccgcgaucaccuccgccaugggcagcaagugcaacaacacggacacaaagguccagggguacuacaucugcaucaucggcggcaacagcgcccccguuuacgccccggcgggggaagacuuccgggccauggagguguucuccggcaucaucaccucaccccacggggaggaccacgaccucccaggcgaggagaucgccaccuaccagaucuccggccagaucgaggccaagaucccccacacggucagcuccaagaaccugaagcugaccgccuucgcggggaucccgagcuacuccagcaccuccauccucgccgccagcgaggacggccgcuucaucuucucccccgggcuguuccccaaccugaaccagagcgugugcgacaacaacgcccucccccugauuuggcggggccugaucgaccucaccggguacuacgaggccgugcacccguguaacgucuucugcgugcuguccggccccggcgcgagcugcgaggccuucuccgagggcgggaucuucaacaucacgagccccaugugccuggucuccaagcagaaccgcuucagggccgccgagcagcagaucagcuucgugugccagcgcguggacauggacaucaucgucuacugcaacgggcagaagaagaccauccucaccaagacccuggugaucggccagugcaucuacacgaucaccucccuguucagccucuuacccgggguagcccacagcaucgcgaucgagcugugcgucccgggcuuccacggcugggccaccgccgcccuccugaucaccuucugcuucggauggguguugauccccgcuugcacccucgccauccugcuggugcuuaaguucuucgccaacauccugcacaccagcaaccaggagaaccgguucaaggccauccugcgcaagaucaaggaggaguucgagaagaccaagggcagcauggucugcgagaucugcaaguacgagugcgagacccugaaggagcugaaggcccacaaccugucuugcguacagggggagugccccuacugcuucacgcacugcgagcccaccgagacggcgauccaggcccacuacaaggugugucaggccacccaccgguuccgcgaagaccucaagaagacggucaccccgcagaacaucggccccgggugcuaccggacccugaaccuguucagauacaagagccggugcuacauccugaccauguggacccuccugcugaucaucgaauccauccucugggccgccagcgcgguggagaucccgcuggugccccuguggacggacaacgcccacggcgucggcuccgugccgaugcacaccgaccuagagcuggacuucagccugcccuccagcucccgcuacaccuacaagcgccaccucaccaaccccgugaacgaccagcagagcgucucccugcacaucgaaaucgagucgcaggggauaggcgccgacgugcaccaccuggggcacugguacgacgcccggcucaauuuaaagacguccuuccacugcuacggcgccuguaccaaguaccaguacccguggcacaccgcuaagugccacuucgagaaggacuacgaguacgagaacagcugggccugcaacccgcccgauugccccggcguggggaccggcugcacggccugcgggcuauaccucgaccagcugaagcccgucggcaccgccuucaagaucaucuccgugcgcuacagccgaaaggugugcguccaguucggggaggaguaccugugcaagaccauugacaugaacgacugcuucgugacccgccacgcgaagaucugcaucaucggcacggugucaaaguucucccagggcgacacccuccuguuccuggggcccauggagggcgggggcaucaucuucaagcacuggugcacuagcacgugccacuucggggaccccggagacgucaugggccccaaagauaagccguucaucugccccgaguuccccgggcaguuccggaagaagugcaacuucgccaccacccccgugugcgaguacgauggcaacaucaucuccggguacaaaaaggugcucgccaccaucgacagcuuccaauccuucaacaccagcaacauccacuucacggacgagcgcaucgaguggcgagacccggacggcaugcugcgcgaccacaucaacaucgucaucuccaaggacaucgauuucgagaaccuggccgagaaccccugcaagguggggcuccaggccgcgaacaucgagggcgccuggggcagcggggugggcuucacccugaccugccaggucucccugaccgagugccccacguuccucaccagcaucaaggccugcgacauggccaucugcuacggggccgaguccgugacgcugucgcggggccagaacaccgugaagaucacggggaagggcggccacuccgggagcuccuucaagugcugccacggcaaggagugcagccugaccgggcuccaggcguccgcgccccaccuggacaaggucaacggcaucagcgagcuggagaacgagaagguguacgacgacggcgccccggagugcgggaucacgugcugguucaagaaguccggcgagugggugauggggaucaucaacggcaacugggucguccucaucguccugugcguacugcuccuguucagccugauccuccugagcauccugugccccgugcgcaagcacaagaaguccuga

SEQ ID NO: 15107 - RNA, 3402 nt, Artificial Sequence
  derived and/or modified CDS sequence (opt11) from SEOV(Gou3-e5)__AF288650.1__GP
auguggggguugcuccugcuggcugcccucgugggccagggccuggcgcugaagaacgucuucgacaugaagauccagugcccccacuccgugaacuucggggagacaagcgugagcggcuacaccgagcugcccccgcucccgcugcaggaggccgagcagcucguccccgaguccuccuguaacauggacaaccaccagagucugagcaccaucaacaagcugacgaaggugauuuggcgaaagaaggccaaccaggaguccgccagccagaauagcuucgagguggucgagaacgagguauccuucaagggucucugcaugcugaagcacagaaugguggaggaguccuaccgaaaucggcgcagcgucauuugcuacgaccuggccugcaacaccaccuucugcaagcccacgguguacaugaucguccccauccacgcgugcaacaugaugaaguccugccucaucggccuuggccccuaucggauccaggucaucuaugaacgcaccuacugcaccaccggcauucugacggagggcaagugcuucgugcccgacaaggccgucgucagcgcucucaagcgggggauguacgccauugcguccauagaaaccaucugcuucuucgugcaccagaaagguaacaccuauaagaucgugagcgccaucacuuccgcaaugggaucuaagugcaauaacacggacuccaagguacagggcuacuacaucugcaucaucggagggaacagcgccccgguguacgcccccgcgggugaggauuuccgcgccauggagguguucagcgggauaaucaccucaccgcacggcgaagaccacgaccugcccggcgaggaaaucgccaccuaccagaucagcgggcagaucgaggccaagauaccgcacaccgugucaagcaagaacuugaagcucacggccuucgcgggcauccccuccuacagcaguaccagcauccuagccgccucugaggacgggagauucaucuucucacccggccuguuucccaaucucaaccaguccgugugcgacaacaaugcccugccgcugaucuggcgcggucucaucgaccugacuggcuacuacgaggccauccaccccugcaauguguucugcguccuaagcggccccggggcgucaugcgaggccuucucugagggcgggauuuucaacaucaccagccccaugugccuggugagcaaacaaaaccgguucagggccgccgaacagcagaucuccuucauaugccagagaguugacauggacaucgugguguacugcaauggccagaagaagacuauccugacaaagacccugguuaucgggcaguguaucuacaccaucacgucuuuauucucccuguugccgggcguggcgcauagcauagcgaucgaacucugcgugccuggcuuccacgggugggccaccgcagccuuacuggucaccuucugcuucgggugggugcugauccccgcgugcacccuggcagugcuccucuuccugaaguucuucgccaacaucuuacacacgucaaaccaggagaaucgcuucaaggccauccuccggaagaucaaagaggaguucgagaaaaccaaagguucuauggucugcgaaauaugcaaguacgaaugcgagacccugaaggagcugaaggcccacaaccucagcugcgugcagggcgagugcccuuauugcuucacccacugcgagccaacggagaccgcgauccaggcccacuacaaggucugucaggccacccaccgcuuccgggaggaccugaagaagaccgucacgccgcagaacaucgggcccggcugcuaccgcacccugaaccuguuccgguacaagagucgcugcuacauccucacuauguggauacugcugcucgugaucgaaagcauccugugggccgccuccgcggccgagauuccccucgugccguuauggaccgacaacgcccacggcgucggaagcgugcccaugcacaccgacuuggagcuggacuucucccugccaagcuccagcaaguacaccuacaagcgucaccugaccaacccggugaaugaccagcagucagucucucugcauaucgagaucgagucccaaggcaucggggccgauguccaccaccucggccacugguacgaugcccgccugaaccugaagacgagcuuccacuguuacggcgcgugcaccaaguaccaguaccccuggcacacggccaagugccacuucgaaaaggacuacgaguaugagaacucuugggccuguaacccgcccgacugucccggggugggcaccgggugcaccggcugcggauuauaucuggaccagcugaagcccgucggaaccgcguucaagaucaucagcguacgcuauucuaggaaggugugcguccaguucggagaggaauaccucugcaagacgaucgacaugaacgacugcuucguuacccggcacgcgaagauaugcaucaucgggaccgugagcaaguucagucaaggagacacccuccuauuccucgggcccauggagggcgggggcaucaucuucaagcacuggugcacguccacgugccacuucggcgaccccggggacgucaugggcccgaaagacaagcccuuuauuugccccgaguuccccgggcaguuccgcaagaagugcaacuucgccaccaccccgguuugcgaguacgacggcaacgugaucagcggguaccgcaaagugcuggcaaccaucgacuccuuccagucauucaacaccuccaacgugcauuucaccgacgagaggaucgaguggaaggauccagacggaauguuacgcgaucacaucaacaucguuaucagcaaggacaucgacuucgagaaccuugccgagaacccgugcaaggucggccuucaagccgcgaacaucgagggggccuggggcuccgggguuggguuuacguugacgugccaggucagccucaccgagugcccgaccuucuuaaccucaaucaaggcuugcgacauggccaucugcuacggggcugagagcguuacgcugucccggggccagaacacgaucaagaucaccggcagagggggccacagcggcagcaguuucaaaugcugccacggcaaggaaugcuccgcaaacggccuccaggcgagcgccccgcaccuggacaaggugaacgggaucuccgagcuggagaacgagaagguguacgaugauggcgcccccgagugcgggauaacgugcugguucaagaaguccggcgaaugggucauggggaucauaaacggcaacuggguggugcucauaguccugugcgugcugcucuuauucucccugauccuccugagcauccugugucccgugcggaagcauaagaaauccuaa

SEQ ID NO: 15108 - RNA, 3402 nt, Artificial Sequence
  derived and/or modified CDS sequence (opt11) from SEOV(China)__EU163437.1__GP
auguggagccugcuccugcuggccgcccucgugggccagggguuugcccugaagaacgucuucgacaugcggauccagugcccccacuccgugaaguucggcgagaccagcguguccggguacaccgagcugccgccucucagccugcaggaggccgagcagcugguccccgaguccagcuguaacauggacaaccaccagucccucagcacgaucaacaagcugaccaaggugaucuggcggaagaaggccaaccaggaguccgccaaccagaacagcuucgagauccuggaguccgaggugagcuucaagggccucugcaugcugaagcaccgcauggucgaggaguccuaccggaaccgccggagcgugaucugcuacgaccuggcuugcaacuccaccuucugcaagccaaccguguacaugaucgucccgauccacgcgugcaacaucaugaaguccugccucaucgggcuuggccccuaccgcauccaggugguguacgagcggacguacugcaccaccggcauccugaccgaggggaagugcuucguccccgacaaggccgucgugagcgcccucaagcgcggcauguacgccaucgcgagcaucgagacgaucugcuucuucauccaccagaaggguaacaaguacaagaucgucaccgccaucaccuccgcaaugggcagcaagugcaacaacaccgacacgaaggugcagggguacuacaucugcaucaucggcggcaacagcgcccccguguacgccccggcgggggaggacuuccgggccauggaggucuucuccggcaucaucaccagcccccacggggaggaccacgaccugcccggcgaggagaucgccaccuaccagauuuccggccagaucgaggccaagaucccccacaccgugagcucccagaaccugaagcucaccgccuucgcggggaucccgagcuacuccagcaccuccauccuggccgccagcgaggacggccgcuucauuuucucccccgggcuguuccccaaccucaaccagagcgugugcgacaacaacgcccugccacugaucuggcggggccucaucgaccugaccgguuacuacgaggccguccacccgugcaacguguucugcgugcuguccggccccggcgcgagcugcgaggccuucuccgagggcgggaucuucaacaucaccagccccaugugccucgucuccaagcagaaccgcuuccgggccgccgagcagcagaucagcuucaucugccagcgcguggacauggacaucaucgucuacugcaacgggcagaagaagacgauccugaccaaaacccuugugaucggccagugcaucuacaccaucacgucccucuucagccugcugcccgggguggcccacagcaucgcgaucgagcucugcgucccgggcuuccacggcugggccaccgccgcgcugcugaucaccuucugcuucgggugggugcucauccccgcgugcaccuuggccaucuuguuagugcugaaguucuucgccaacauccugcagacguccaaucaggagaaccgguucaaggccauccuccgcaaaaucaaggaggaguucgaaaagaccaagggcagcauggucugcgagaucugcaaguacgagugcgagacccuaaaggagcugaaggcccacaaccucuccugcguccagggggagugccccuacugcuuuacccacugcgagcccacggagaccgcgauacaggcccacuacaaggugugccaggccacccaccgguuccgcgaggaccugaagaaaaccgucacgccgcagaacaucggccccgggugcuaccggacccugaaccuguuccgcuacaagagccggugcuacauacucaccauguggacccugcugcucaucaucgaguccauccugugggcugccagcgcggccgagaucccccuggugccccucuggaccgacaacgcccacggcgugggcuccgucccgaugcacacggaccuggagcuggacuucagccuccccuccucguccaaguacaccuacaagcgccaccugaccaaccccgugaacgaccagcagagcgugucccugcacaucgagaucgaaagccaggggauuggcgccgacguucaccaccucgggcacugcuaugacgcccgccugaacuugaagaccuccuuccacugcuacggcgcgugcacgaaguaccaguacccguggcacacagccaagugccacuucgagaaagacuacgaguacgagaacagcugggccugcaauccgcccgacugccccggcguggggaccggcugcaccgccugcgggcucuacuuggaccagcugaagcccgugggcacggcguucaagaucaucuccguccgguacagccgcaaggugugugugcaguucggggaggaguaccucugcaagacgaucgauaugaacgacugcuucgucacccggcacgccaagaucugcaucauuggaaccgugagcaaguucagccagggcgauacgcugcuguuccucgggcccauggaaggcgggggcaucaucuucaagcacuggugcaccagcacgugccacuucggggaccccggcgacgugaugggcccgaaggacaagcccuucauuugccccgaguuccccgggcaguuccgcaagaagugcaacuucgccaccacccccgucugcgaguacgacggcaacaucaucuccggguacaagaaagugcuggccaccaucgacaguuuccaguccuucaaccggagcuacauccacuucaccgacgagcgcaucgaguggcgggacccggacggcaugcugcgcgaccacaucaacaucgugaucuccaaggacaucgacuucgagaaucuagccgagaaccccugcaaggucgggcugcaggcggccaacaucgagggcgccuggggccucggggugggcuucacccucacgugccaggugagccugaccgaaugccccaccuuccugaccuccaucaaggccugcgacauggcuaucugcuacggggcggagagcgucacgcucucccggggucaaaacaccgugaagaucaccgggaagggcggccacagcggguccagcuucaaguguugccacggcaaggagugcuccagcaccgggcugcaggccuccgcgccccaccuggacaaggugaacggcaucucagagcuagagaacgagaaggucuacgacgauggcgccccggagugcgggaucacgugcugguucaagaaguccggcgagugggugauggggaucaucaacggcaacugggugguccugaucgugcugugcgugcuccuucuguucagccucauccugcugagcauccucugccccguccgcaagcacaagaaguccuga

SEQ ID NO: 15109 - RNA, 3402 nt, Artificial Sequence
  derived and/or modified CDS sequence (opt11) from SEOV(DPRK08)__JX853576.1__GP
auguggucucugcuccugcuggccgcccucguaggccagggguuugcacugaagaacgucuucgacaugcgaauccagugcccccacagcgugaacuucggugaaaccagcguguccggguauaccgagcugccgccgcucagccugcaggaggcggagcagcugguccccgaguccaguugcaacauggacaaucaccagucacucagcacgauuaacaaauuaaccaaggugaucuggaggaagaaggccaaccaggaguccgccaaccagaacagcuucgagguggucgaguccgaggugagcuuuaagggcuugugcaugcucaagcaccgcaugguggaggaauccuaccggaaccgccggagcguaauaugcuacgaucuggccugcaacucgaccuucugcaagcccaccguguacaugauugugccgauccacgcgugcaauaugaugaaguccugccugaucgggcucggccccuaccgcauccagguuguguacgagcgaacguacugcaccaccggcauccugaccgaggggaagugcuucgugcccgacaaggccgucguuagcgcccugaagcgcggaauguaugccaucgcgucgaucgagacgaucugcuucuucauccaccagaaggggaacaccuacaagaucgugaccgccaucaccuccgccaugggcucgaagugcaacaacacggacaccaagguccagggguacuacaucugcauaaucggcggcaacagcgcccccguguacgccccggcgggggaggauuuccgggccauggaaguguucaguggcaucaucaccagcccccacggggaggaccacgaccuccccggagaggagaucgccaccuaccagaucuccggccagaucgaggccaagaucccccacacggucagcuccaagaaccugaagcugaccgccuucgcagggaucccgucuuacaguagcaccucaauauuagccgccagcgaggacggccgcuucauauucucccccgggcuguuccccaaccugaaccagagcgugugcgacaacaacgcccucccccugaucuggcggggccugaucgaccucaccggcuacuacgaggccgugcacccgugcaacgucuucugcguguuaagcggccccggcgcaagcugugaggccuucuccgaaggcgggaucuucaacaucacuagccccaugugccuggucuccaagcagaaccgcuuccgggccgccgagcaacaaaucagcuucgugugccagcgcguggacauggacaucaucgucuacugcaacgggcagaagaagaccauccucaccaaaacccuugugaucggccagugcaucuacaccaucaccucccuguucagccuccugcccgggguggcccacagcaucgcgaucgagcugugcgugccgggcuuccacggaugggccaccgccgcccuccugaucaccuucugcuucgggugggugcugaucccggcgugcacgcuggccauacugcuggugcucaaguucuucgcaaacauccugcacaccuccaaccaggagaaccgguucaaggccaucuuacgcaagaucaaggaggaguucgagaagaccaagggcagcauggucugcgagaucugcaaguacgagugcgagacccucaaggagcugaaggcccacaaccuguccugcgugcagggagagugucccuacugcuucacgcauugcgagcccacugagaccgcgauccaggcccacuacaaggugugccaggccacccaccgguuccgcgaggaccucaagaagacggucacuccgcaaaacauuggccccgggugcuaccggacccugaacuuauuucgcuacaagagccggugcuacauccugaccauguggaccuugcugcucauaaucgaguccauccucugggccgccagcgcggccgagaucccccuggugcccaucuggacggacaacgcccacggcgugggcuccgucccgaugcacaccgaccuggagcucgacuucagccugcccuccagcuccaaguacacguacaagcgccaccugaccaaccccgugaacgaccagcagucggugucccuccacaucgagaucgagagccaggggaucggcgcggacguccaccaccuggggcacugguacgacgcccgccugaaccucaagacauccuuccacugcuacggcgccugcaccaaguaccaguacccguggcacaccgccaagugccacuucgagaaggacuacgaguaugagaacucaugggccugcaauccgcccgacugccccggcgucgggaccggcugcacggccugcgggcuguaccuggaccagcugaagcccguggggaccgcguucaaaaucaucuccgucagguacagccgcaaggugugcaugcaguucggggaggaauaucuguguaagaccaucgacaugaacgacugcuucgugacccggcacgccaaaaucuguaucaucggcacgguaagcaaauucucccagggcgacacucuccucuuccuggggcccauggagggcgggggcaucauauucaagcacugguguaccagcacgugccacuucggggaccccggcgacgugaugggccccaaggacaagccguucaucugccccgaguuccccgggcaguuccgcaagaagugcaacuucgcaaccacuccggugugcgaguacgacggcaacaucaucuccggcuacaagaagguccuggccaccauagacagcuuccaguccuucaacaccagcaacauccacuucacggacgagaggaucgaguggcgcgacccugacgguaugcuccgggaccacaucaacaucgugauauccaaggacaucgacuucgagaaccuggccgagaaccccugcaagguggggcugcaggcggccaacauagagggcgcuuggggcucuggagucggcuucacccuaaccugccaggugucccugaccgagugucccacguuccugaccaguaucaaggccugcgacauggccaucugcuacggggcggaguccgugacccucagccgcggccagaacaccgucaagaucacggggaagggcggccacuccgggagcuccuucaagugcugccacggcaaagagugcagcuccaccgggcugcaggccuccgcuccacaccuggacaagguuaacggcaucuccgagcucgagaacgagaagguguacgacgacggagccccggaguguggcguaaccugcugguucaaaaaguccggcgagugggucaugggaaucaucaacggcaacugggugguccugaucguccugugcguguugcugcuguucagccucauccugcugagcaucuuaugccccguccggaagcacaagaaguccuga

SEQ ID NO: 15110 - RNA, 3402 nt, Artificial Sequence
  derived and/or modified CDS sequence (opt11) from SEOV(Fj372/2013)__KP645197.1__GP
auguggagccugcuccugcuggccgcccucgugggcccgggguucgcacugaagaacgucuucgacaugcgcauccagugcccccacagcgugaacuucggcgagaccagcguguccggguacaccgagcugccgccccucagccugcaggaggccgagcagcugguccccgaguccagcugcaacauggacaaccaccagucccucagcaccaucaacaaacugacgaaggugauauggcagaagaaggccaaccaagaguccgccaaccagaacagcuucgagguggucgaauccgaggugagcuucaagggccugugcaugcucaagcaccggaugguggaggaguccuaccgcaaccggcgcagcgucauuugcuacgaccuggccugcaacuccaccuucugcaagcccaccguguacaugaucgugcccauccacgcgugcaacaugaugaaguccugccugaucgggcucggccccuaccggauccaggucguguacgagcgcacguacugcaccaccggcauccugaccgaggggaagugcuucgugccagacaaggccgucgugagcgcccugaagcggggcauguacgccaucgcgaguaucgagacgaucugcuucuucauacaccagaaggggaacaccuacaagaucgugaccgccaucaccuccgcaaugggcagcaagugcaacaacacggacaccaagguccagggguacuacaucugcaucaucggcggcaacagcgccccgguguacgcccccgcgggggaggacuuccgcgccauggagguguucucgggcaucaucaccucuccccacggggaggaccacgaccuccccggcgaggagaucgcgacuuaccagaucuccggccagauugaggccaagaucccgcacacggucagcuccaagaaccugaagcugaccgccuucgcggggauccccuccuacucaagcaccuccauccucgccgccagcgaggacggccgguucaucuucucccccgggcuguuccccaaccugaaccagagcgugugcgacaacaacgcccucccgcugaucuggcgcggcuuaaucgaccucaccggguacuacgaggccgugcaccccugcaacgucuucugcgugcuguccggccccggcgcgagcugcgaggccuucuccgagggcgggaucuucaacaucacgagccccaugugccuggucuccaagcagaaccgguuccgcgccgccgagcagcagaucagcuucgugugccagcggguggacauggacaucaucgucuacugcaacgggcagaagaagaccauccucaccaagacccuggugaucggccagugcaucuacacgaucaccucccuguucagcuugcugccgggggucgcccacagcaucgcgaucgagcugugcguccccggcuuccacggcugggccaccgccgcccuccugaucaccuucugcuucgggugggugcugauccccgcgugcacgcucgccauccugcuggugcucaaguucuucgcaaacauccuucacaccuccaaccaggagaaccgcuucaaggccauccugcggaagaucaaggaggaguucgagaagacgaaggguagcauggucugcgagaucugcaaguacgagugcgagacccucaaggagcugaaggcccacaaccuguccugcgugcagggggagugccccuacugcuucacgcacugcgagccgaccgagaccgcgauccaggcccacuacaaggugugccaggccacccaccgcuuccgggaggaccucaagaagacggucacgccucagaacaucggccccgggugcuaccgcacccugaacuuguuccgguacaagagccgcugcuacauccugaccauguggacccuccugcugaucaucgagucaauacucugggccgccagcgcugccgagaucccccuggugccgcuguggaccgacaacgcccacggcgugggcuccguccccaugcacaccgaccucgagcuagacuucagccugcccaguuccuccaaguacaccuacaagcggcaccucaccaacccggugaacgaccagcagagcgugucccugcacaucgagaucgagagccaggggaucggcgccgacguccaccaccucgggcacugguacgacgcccgccucaaccugaagacguccuuccacugcuauggcgcgugcaccaaguaccaguaccccuggcacaccgccaagugccacuucgagaaggacuaugaguacgagaacuccugggccugcaacccgcccgacugccccggaguggggaccggcugcacggccugcgggcucuaccucgaccaacugaagcccgugggcaccgcguucaagaucaucuccguccgcuacagccggaaggugugcgugcaguucggugaggaguaccugugcaagaccauagacaugaacgacugcuucgucacccgccacgccaaaaucugcaucaucggcacggugagcaaguucucccagggcgacacacuccuguuccuggggcccauggagggcgggggcaucaucuucaaacacuggugcaccagcacgugccacuucggagaccccggcgaugugaugggcccgaaggacaagcccuucaucugccccgaguuccccgggcaguuccggaagaagugcaacuucgccaccaccccggucugcgaguacgacggcaacaucaucuccggguacaagaaggugcucgccaccaucgacagcuuccaguccuucaacaccagcaacauccacuucacggacgagcgcaucgaguggcgggaccccgacggcaugcugcgcgaccacaucaauaucgugaucuccaaggacaucgacuucgagaaccuggccgagaaccccugcaaggucgggcuccaggcggccaacaucgagggcgccuggggaagcgggguggguuucaccuuaaccugccaggugucccugaccgagugccccacguuccucaccagcaucaaggcaugcgacauggccaucugcuacggggcagaguccgucacccugagccggggccagaacaccgugaagauuaccggcaagggcggccacuccgggagcuccuucaagugcugccacgguaaggagugcagcuccaccgggcugcaggccagcgccccgcacuuagacaaggugaacgggaucuccgaacuggagaacgagaaggucuacgacgacggcgccccugagugcgggaucacgugcugguucaagaaguccggcgagugggugauggggaucaucaacggcaacugggugguccugauugugcucugcgugcugcuccuguucagccugauccugcucagcauccugugccccguccgcaagcacaagaaguccuga

SEQ ID NO: 15111 - RNA, 3402 nt, Artificial Sequence; identical to SEQ ID NO: 11825
  derived and/or modified CDS sequence (opt11) from SEOV(HeB38)__JN377554.1__GP

SEQ ID NO: 15112 - RNA, 3402 nt, Artificial Sequence
  derived and/or modified CDS sequence (opt11) from SEOV(JiangxiXinjianRn-07-2011)__KP859513.1__GP
auguggucacugcuccuucucgccgcccucgugggccagugcuucgcacugaagaacgucuucgacaugcgcauccagugcccccacagcgugaacuucggggagaccucugugucaggcuauaccgaacugccgccccucucuuugcaggaggcugagcagcugguccccgaguccucuugcaacauggacaaccaccagucccucagcaccaucaauaagcugaccaaggugaucuggcgaaagaaggcgaaccaggaguccgccaaucagaacagcuucgagguggucgaauccgaggugagcuucaaggggcugugcaugcucaagcaccgaaugguagaagaguccuaccggaaccgccggagcgucaucugcuacgaccuggccugcaacuccaccuucuguaagcccacgguguacaugauugucccgauacacgcguguaacaugaugaaguccugccugaucggccucgggccauaccgcauccaggucguguacgagcggaccuauugcaccacuggcauucugaccgagggcaagugcuucgugcccgacaaggccgucgugagugcccugaaacgcggaauguacgccaucgcgagcaucgagaccaucugcuucuucauccaucagaagggcaacaccuauaagaucgugaccgccaucaccucagccauggggucgaagugcaacaacacggacaccaaaguccagggcuacuacaucuguaucaucgggggcaacagcgcucccguguacgccccggcuggcgaggacuuccgugccauggagguguucuccgggaucaucacgagcccucacggcgaggaucacgaccuccccggugaggagaucgccacguaccaaaucuccggccagaucgaggccaagaucccccacacggugagcuccaagaaucugaagcugaccgccuucgcggggauuccgucguacuccagcaccuccauccucgccgccagcgaggaugggagauuuaucuuuuccccaggccucuuccccaaccugaaccaguccgugugugacaacaaugcccucccccugaucuggcgggggcugauagaccuaaccggcuauuacgaggccgugcauccaugcaacgucuucugcgugcuuuccgggcccggcgcgagcugcgaggccuucuccgagggagggaucuucaacaucacgagccccaugugccuggucuccaagcagaaccgcuuccgagccgccgagcagcaaauuagcuucgugugccagcgcguggacauggacaucaucgucuacuguaacggccagaaaaagacaauucucaccaagacccuggugauugggcagugcaucuacacgaucaccucccuguucagccuccugcccggcguggcccacucgaucgcgaucgagcugugcgucccgggguuccacggcugggccacugccgcccuccugaucacuuucugcuuuggcugggugcugauccccgccugcacgcucgcgauccugcuggugcucaaguucuucgccaacauccugcacacuuccaaccaggagaaucgguucaaggccauacugcgcaaaaucaaggaggaguucgaaaagaccaaggggagcauggucugcgagaucugcaaguacgaaugcgagacccugaaggagcugaaggcccacaaccuguccugcguccagggcgagugccccuauugcuucacgcacugcgagcccaccgagaccgcgauucaagcccacuacaagguaugccaggccacccaucgguuccgcgaggaccucaagaagacggucaccccucagaacaucgggcccggcugcuaccggacccugaaccuguuucgcuacaagagccggugcuacauccugaccauguggacucuccugcucauaaucgaauccauccucugggcggccucugcggccgagaucccauuggugccccuguggacggacaacgcucacggagucggcuccgucccgaugcacaccgaccucgagcuggacuucucacugcccuccagcuccaaguacaccuacaagaggcaccucaccaacccggugaacgaccagcagagcgugucacugcacaucgagaucgagagccagggaaucggggccgacgugcaccacuugggccacugguacgacgcccgccucaaccugaagacauccuuccacuguuacggggcguguaccaaguaccaguacccguggcacaccgcgaagugucacuucgagaaggacuacgaguacgagaacagcugggccugcaacccgccggacugccccggcgugggcacaggcugcacggccugcggccuguacuuagaccaguugaagcccgugggaaccgcguucaagaucaucuccguccgguacagucguaaggucugcgugcaguucggcgaagaauacuucugcaagaccaucgacaugaacgauugcuucgucacucggcacgccaagaucugcaucaucgggacagugagcaaguucucccaaggcgacacccuccucuuccuuggacccauggaaggcggcgggaucaucuucaagcacuggugcaccagcacgugucacuucggggaccccggggacguaaugggccccaaggacaagccguuuaucugccccgaguuccccggccaguuccgcaagaaauguaacuucgccaccacccccgucugcgaauacgacgggaacaucauuuccggcuacaagaaggugcuggccacaaucgacuccuuccaauccuucaacaccagcaacauccacuucacggacgagcggauugaauggcgcgacccggacgggaugcuccgggaccacaucaacaucgucaucuccaaggauauagacuucgagaaccuggccgagaaccccugcaaggucggccugcaggcggcaaacaucgagggggccuggggcagcggcgugggguucacccugacaugccaagugucccucaccgagugccccacguucuuaaccagcauuaaggccugcgacauggccaucugcuauggcgcggaguccgucacccucagccgcgggcagaacacagugaagaucacaggcaagggcgggcacucgggcagcuccuucaagugcugccacggaaaggagugcagcuccaccggcuugcaggccagcgcgccccaccuggacaaggugaacgggaucuccgagcucgaaaacgaaaagguguacgacgauggcgccccggaaugcggcauaaccugcugguucaagaagucaggggaaugggugaugggcaucaucaaugggaacugggugguccugaucgugcugugcgugcuccugcuguucagccucauccugcugucgauucucugccccguccggaagcacaagaagucguga

SEQ ID NO: 15113 - RNA, 3402 nt, Artificial Sequence
  derived and/or modified CDS sequence (opt11) from SEOV(LYON/Rn/FRA/2013/LYO852)__KF387724.1__GP
auguggagccuccuccuccuggccgcccuugccggacagggguucgcgcugaagaacguguucgacaugcgcauccagugcccccacagcgucaacuucggcgagaccagcguguccggguacaccgagcugccgccccuuagccugcaggaggccgagcaguuggugccggaguccagcugcaacauggacaaccaccagucccucagcaccaucaacaagcugaccaaggucaucuggcggaagaaggccaaccaggaguccgcgagccagaacuccuucgaggugguggagagcgaggucucauucaagggccugugcaugcuccgccaccggaugguggaagagagcuacaagaaccgccgguccgugaucugcuacgaccuggcgugcaacagcaccuucugcaagcccaccgucuauaugaucguaccgauccacgccugcaacaugaugaaguccugccugaucgggcucgggcccuaccgcauucaggugguuuacgaacggacguacugcacaacuggcauccugaccgaggggaagugcuucgugcccgacaaggccguggucagcgcccugaagcgcggcauguacgcgaucgccuccaucgagacgaucugcuucuucauccaccagaaggggaacaccuacaagaucgugacggccaucaccagcgccaugggcagcaagugcaacaacacggacaccaaggugcagggguacuacaucugcaucauugguggcaacuccgcccccguauacgcgccggccggggaggacuuccgggccauggaaguguucagcggcaucaucaccagcccccacggggaggaccacgaucuccccggcgaggagaucgccaccuaccagaucagcggccagaucgaggccaagaucccccacacgguguccagcaagaacuuaaagcugaccgcguucgccgggaucccguccuacagcaguaccagcauccucgccgcuuccgaggacggccgcuucaucuucagccccggacuguuccccaaccugaaccaguccgucugcgacaacaacgcccucccccugaucuggcggggccugaucgaccucaccggguauuacgaggcggugcacccgugcaacguguucugcguccugagcggccccggcgccuccugcgaggccuucagcgagggcgggaucuucaacaucacgucgcccaugugccuggugagcaagcagaaccgcuuccgggcugccgagcagcagaucuccuucgucugccagcgcguggacauggauaucaucguguacugcaacgggcagaagaagaccauccucaccaagacccuggucaucggccagugcaucuacacgaucaccagccuuuucagccuccuacccgggguggcgcacuccaucgccaucgagcuuugcgugccgggcuuccacggcugggccaccgccgcgcuccugaucaccuucugcuucggguggguccugauccccgccugcacgcucgccauccugcuggugcucaaguuuuucgccaacauccugcacaccagcaaccaggagaaccgguucaaggccauccugcgcaagaucaaagaagaguucgagaagaccaagggcuccauggugugcgagauuugcaaguacgagugcgagacccucaaggagcugaaggcgcacaaccugagcugcguucagggggagugccccuacugcuucacgcacugcgagcccaccgagaccgccauccaggcccacuacaaggugugccaggccacccaccgguuccgcgaggaccucaagaagacggugaccccgcagaacaucggccccgguugcuaccgaacccugaaccuguuccgcuacaagucacggugcuacauccugaccauguggacccuccugcugaucaucgagagcauccucugggccgcguccgccgccgagaucccccuagucccccuguggacggacaacgcccacggcgugggcagcgugccgaugcacaccgaccucgagcuggacuucucccugcccagcuccagcaaguacaccuacaaacgccaccucacgaaccccgucaacgaccagcaguccgugagccugcacaucgagaucgagucccaggggaucggcgccgacgugcaccaccuggggcacugguacgacgcacgccucaaccugaagacgagcuuccacugcuacggcgccugcaccaaguaccaguacccguggcacaccgccaaaugccacuucgagaaggacuacgaguacgagaacuccugggccugcaacccgcccgacugccccggcgucgggaccggcugcacggcgugcgggcuguaccucgaccagcugaagcccgugggcaccgcuuucaagaucaucagcgugcgguacagccgcaaggucugcgugcaguucggggaggaguaccugugcaagaccaucgacaugaacgacugcuucgugacccggcacgccaagaucugcaucaucggcacggucuccaaguucagccagggcgauacccuccuguuccuggggcccauggagggcgggggcaucaucuucaagcacuggugcaccuccacgugccacuucggggaccccggcgacgugaugggccccaaggacaagccguucaucugccccgaguuucccgggcaguuccgcaagaagugcaacuucgccaccacccccgugugcgaguacgacggcaacaucaucagcggguacaaaaagguccucgccaccaucgacuccuuccagagcuucaacaccuccaacauccacuucacggacgagcggaucgaguggcgcgaccccgauggcaugcugcgugaccacaucaacaucaucaucagcaaggacaucgacuucgagaaccuggcggagaaccccugcaagguggggcuccaggccgccaacaucgagggcgccuggggcuccggggugggcuucacccugaccugccaggucagccugaccgagugccccacguuccuuaccuccaucaaggccugcgacauggcgaucugcuacggggccgagagcgugacccugucccgcggccagaacaccgugaagaucacggggaagggcggccacagcgguuccagcuucaagugcugccacggcaaggagugcucccugaccgggcuccaggccagcgcuccccacuuagauaaggucaacggcaucuccgagcuggagaacgagaagguguacgacgacggcgccccggagugcgggaucacgugcugguucaagaaauccggcgagugggugauggggaucaucaacggcaacugggucgugcucaucgugcugugcgucuuccuucuguucagccugaucuuacucuccauacugugccccguccggaaacacaagaaguccuga

SEQ ID NO: 15114 - RNA, 3402 nt, Artificial Sequence
  derived and/or modified CDS sequence (opt11) from SEOV(Seoul-Baxter/NYC-D1_M)__KJ950863.1__GP
auguggagccugcuccugcuggccgcccucgugggccagggguuugcccugaagaacguguucgacaugaagauccagugcccccacagcgugaacuucggcgagaccagcguguccggguauaccgagcugccgccccuuagccugcaggaggccgaacagcuggucccggaguccagcugcaacauggacaaccaccagucccucagcaccaucaacaaacugaccaaggugaucuggcgcaagaaggccaaccaggaguccgccaaccaaaacagcuucgagguugccgaguccgaggucagcuucaagggccugugcaugcucaagcaccggaugguugaggaguccuaccgcaaccggcgcagcgugaucugcuacgaccuggcgugcaacuccaccuucugcaagcccaccguuuacaugauagugccgauccacgccugcaacaugaugaaguccugccugaucgggcucggccccuaccggauccagguggucuacgagcgcacguacugcaccacaggcauccugaccgaggggaagugcuucguacccgacaaggccguggucagcgcacugaagcgggguauguacgcgaucgccucgaucgagacgaucugcuucuucauccaccagaaggggaauaccuacaagauagugaccgccaucaccuccgccaugggcagcaagugcaacgacacggacaccaagguucagggguacuacaucugcauaaucggcggcaacagcgcccccgucuacgcgccggccggggaggauuuccgcgccauggagguguucagcggcaucaucaccagcccccacggggaggaccacgaccucccuggcgaggagaucgccaccuaccagaucuccggccagaucgaggccaagaucccccacacggugagcagcaagaaccugaagcugaccgcguucgccggaaucccgagcuacuccucgaccuccauccucgccgccagcgaggacggccguuucauuuucucccccgggcuguuccccaaucugaaccagagcgucugugacaacaacgcccucccccugguguggcgcggccugaucgaccucaccggguacuacgaggcggugcacccgugcaacgucuucugcgugcuguccggccccggcgccagcugcgaggccuuuuccgagggcgggaucuucaacaucacgucgcccaugugccuggucuccaagcagaaccgguuccgcgccgccgagcagcagaucagcuucgugugccagcggguggacauggacaucaucgucuacugcaacgggcagaagaagacuauccucaccaagacacuggugaucggccagugcaucuacacgaucaccucccuguucagccuccugcccgggguagcgcacagcaucgccaucgagcugugcgucccgggcuuccacggcugggccaccgccgcgcuccugaucaccuucugcuucgggugggugcugauccccgccugcacgcucgccaucuuacugguguugaaguucuucgccaacauccugcacacguccaaccaggagaaccgcuucaaggccauccugcggaagaucaaggaggaguucgagaagaccaagggcagcauggucugcgagaucugcaaguacgagugcgagacccucaaggagcugaaggcgcacaaccuguccugcgugcagggggagugccccuacugcuucacgcacugcgagcccaccgagaccgccauccaggcacacuacaaggugugucaggccacccaccgcuuccgggaggaccucaagaaaacggucacgccgcagaacaucgggcccgggugcuaccgcacucugaaccuguuccgguacaagagccgcugcuacauccugaccauguggacccuccuccugaucaucgaauccauccucugggccgcgagcgccgccgagaucccccuggugccccuguggacggacaacgcccacggcgugggcuccgucccgaugcacaccgaccucgagcuggacuucagccugcccuccagcuccaaguacaccuauaaacggcaccucaccaacccagugaacgaccagcaaagcgugagucugcacaucgagaucgagagccaggggaucggcgccgacguccaccaccuggggcauugguacgacgcgcgccucaaccugaagacguccuuccacugcuacggcgccugcaccaaguaccaguacccguggcacaccgccaaaugccacuucgagaaggacuacgaguacgaaaacagcugggccugcaacccgcccgacugccccggcguggggaccggcugcacggcgugcgggcuguaccucgaccagcugaagcccgugggcaccgccuucaagaucaucuccguccgcuacagccggaaggugugccugcaguucggggaggaguaccucugcaagacaaucgauaugaacgauugcuucgugacccgccacgucaagauaugcaucaucggcacggugagcaaguucucccagggcgacacccugcuguuccucgggcccauggagggcgggggcaucauauucaagcacuggugcaccagcacgugccacuucggggaccccggcgacgugaugggccccaaagacaagccguucaucugccccgaguuccccgggcaguuccggaagaagugcaauuucgccaccacccccgucugcgaguacgacggcaacaucaucuccggguacaagaaggugcuggccacgaucgacagcuuccaguccuucaacaccagcaacauccacuucacggacgagcgcaucgaguggcgggacccggacggcaugcugcgcgaccacaucaacaucgugaucuccaaggacaucgacuucgagaaccucgccgagaacccuugcaaggucgggcugcaggcggccaacaucgaaggcgccuggggcagcggggugggcuucacccugaccugccaggugucccucaccgagugccccacguuccugaccagcaucaaagccugcgacauggccaucugcuacggggcggaguccgucacccugagccggggccagaacaccgugaagaucacggggaagggcggccacuccggaagcuccuucaagugcugccacggcaaggagugcagcuccaccgggcuccaggccagcgcgccccaccuggacaaggugaacggcaucuccgagcuggagaacgagaaggucuacgacgacggcgccccggagugcgggaucacgugcugguucaagaaguccggcgagugggugauggggaucaucaacggcaacugggugguccucaucguguugugcgugcugcuccuauucagccugauccuccugagcauccugugccccguccgcaagcacaagaaguccuga

SEQ ID NO: 15115 - RNA, 3402 nt, Artificial Sequence
  derived and/or modified CDS sequence (opt11) from SEOV(Singapore/06(RN41))__GQ274942.1__GP
auguggagcuuacuccugcuggccgcccucgccggccagggguucgcccugaagaacguguucgacaugcgcauccagugcccccacuccgucaauuucggcgagaccagcguguccggguacacagagcugccaccccucagccugcaggaggccgagcagcuggugcccgaguccagcugcaacauggacaaccaccagucacucagcaccaucaacaagcugaccaaggucaucuggcggaagaaggccaaccaggaguccgccagccagaacuccuucgaggugguggagagcgagaucuccuucaagggccugugcaugcucaagcaccgcauggucgaggagagcuaccggaaccgucgguccgugaucugcuacgaccuggcaugcaacagcaccuucugcaagcccaccguguacaugaucgucccgauccacgcuugcaacaugaugaaguccugccugauagggcucggccccuaccgcauccaagugguguacgagcggacguacugcaccacaggcauccugaccgaggggaagugcuucguccccgacaaggccguggugagcgcucugaagcgcggcauguacgcgaucgccuccaucgagacgaucugcuucuucauccaccagaaggggaacaccuacaagaucgucaccgccaucaccagcgccaugggcucaaagugcaacaacacggacaccaaggugcagggguacuacaucugcaucaucggcggcaacuccgcccccguguacgcgccggcgggggaggacuuccgggccauggaggucuucagcggcaucaucaccagcccccacggggaagaccacgaccuccccggcgaggagaucgccaccuaccaaaucagcggccagaucgaggccaagaucccccacacgguguccagcaagaaccugaaacuuaccgcguucgccgggaucccguccuacagcuccaccagcauccucgccgccuccgaggacggccgcuucaucuucagccccggccuguuccccaaccugaaccaguccgugugcgacaacaacgcccucccccugaucuggcggggccugaucgaccucaccggguacuacgaggcgguccacccgugcaacguguucugcgugcugagcggccccggcgccuccugcgaggccuucagcgaaggugggaucuucaacaucacgucccccaugugccuggucagcaagcagaaccgcuuccgggccgccgagcagcagaucuccuucgugugccagcgcgucgacauggacaucaucguguacugcaacgggcagaagaagaccauccucaccaagacccuggugaucggccagugcaucuacacgaucaccagccuguucagccuccugcccggagucgcgcacuccaucgccauugagcugugcgugcccggcuuccacggcugggccaccgccgcgcuccugaucaccuucugcuuugggugggugcugauccccgccugcacgcucgccauccugcugguccucaaguucuucgccaacauccugcacaccagcaaccaggagaaccgguucaaggccauccugcgcaagauuaaggaggaguucgagaagaccaagggcuccauggucugcgagaucugcaaguacgagugcgagacccucaaggagcugaaggcgcacaaccugagcugcgugcagggggagugccccuacugcuucacgcacugcgagcccaccgagaccgcgauccaggcccauuacaaggucugccaggccacgcaccgguuccgcgaggaccucaagaaaacggugaccccgcagaacaucggccccgggugcuaccggacccugaaccuguuccgcuacaagucccggugcuacauccugaccauguggacccuccugcugaucaucgagagcauccucugggccgcguccgccgccgagaucccccuggugcccuuauggaccgacaacgcccacggcgucggcagcgugcccaugcacaccgaccucgagcuggacuucucccugcccagcuccagcaaguacaccuacaagcgccaccucacuaaccccgugaacgaccagcaauccgucagccugcacaucgagaucgagucccaggggaucggugccgaugugcaccaccuggggcacugguacgacgcgcgccucaaccugaagacgagcuuccacugcuacggcgccugcaccaaguaccaguacccguggcacacugccaagugccacuucgagaaggacuacgaauacgagaacuccugggccugcaacccgcccgacugccccggcguggggaccggcugcacggcgugcgggcucuaccucgaccaguugaagcccgucggcaccgccuucaagaucaucagcgugcgguacagccgcaagguguguguccaguuuggggaggaguaccugugcaagaccaucgacaugaacgacugcuucgucacccggcacgccaaaaucugcaucaucggaacgguguccaaguucagccagggcgacacccuccuguuccuagggcccauggagggcgggggcaucaucuucaagcacuggugcaccuccacgugccacuucggggaccccggcgacgucaugggccccaaggacaagccguucaucugccccgaguuccccgggcaguuucgcaagaagugcaacuucgccaccaccccugugugcgaguacgacggcaacaucaucagcggguacaagaaggugcucgccaccauagacuccuuccagagcuucaacaccuccaacauccacuucacggaugagcggaucgaguggcgcgacccggacggcaugcugcgggaccacaucaacaucgucaucagcaaggacaucgacuucgagaaucuggcggagaaccccugcaaaguggggcuccaggccgccaacauagagggcgccugggguuccggggugggcuucacgcugaccugccaggucagccugaccgagugccccacguuccucaccuccaucaaggccugcgacauggcgaucugcuacggggccgagagcgugacccugucccgaggccagaacaccgugaagaucacggggaagggcggccacagcggguccagcuucaagugcugucacggcaaggagugcuccagcaccgggcugcaggcguccgcgccccaccucgacaaggucaacggcaucagcgagcuggagaacgagaagguguacgacgacggcgccccggagugcgggaucacgugcugguucaagaaguccggcgagugggucauggggaucaucaacggcaacugggugguccugaucgugcucugcguccugcuccuguucuccuugauccugcucagcauccugugucccgugaggaagcacaagaaguccuga

SEQ ID NO: 15116 - RNA, 3402 nt, Artificial Sequence; identical to SEQ ID NO: 11830
  derived and/or modified CDS sequence (opt11) from SEOV(11CSG)__AB618131.1__GP

SEQ ID NO: 15117 - RNA, 3402 nt, Artificial Sequence
  derived and/or modified CDS sequence (opt11) from SEOV(5CSG)__AB618130.1__GP
auguggagccugcuccugcuggccgcccucgccggccaggguuucgcccugaagaacguguucgacaugcgcauccagugcccccacuccgucaacuucggcgagaccagcguguccggguacaccgagcuuccgccccucagccugcaggaggccgagcagcuggugcccgaguccagcugcaacauggacaaccaccagucccucagcaccaucaacaaguuaaccaaggucaucuggcggaagaaggccaaccaggaguccgccagccagaacuccuucgaggugguggagagcgaagucuccuuuaaaggccugugcaugcucaagcaccgcaugguggaggagagcuaccggaaucgccgguccgugaucugcuacgaccuggcgugcaacagcaccuucugcaagcccaccgucuacaugaucgugccgauccacgccugcaacaugaugaaguccugccugaucgggcucggccccuaccgcauccagguggucuacgagcggacauacugcaccaccggcauccugaccgaggggaagugcuucguucccgacaaggccguggucagcgcccuaaagcgcggcauguacgcgaucgccucgaucgagacgaucugcuucuucauccaccagaaggggaacaccuacaagaucgugaccgccaucaccagcgccaugggcagcaagugcaauaacacggacaccaaggugcagggguacuacaucugcaucaucggcggcaacuccgcccccgucuacgcgccggccggggaggacuuccgggccauggagguguuuagcggcaucaucaccagcccccacggggaggaccacgaccuccccggcgaggagaucgccaccuaccagaucagcggccagaucgaggccaagauaccccacacaguguccagcaagaaccugaagcugaccgcguucgccgggaucccguccuacagcuccaccagcauccucgccgccuccgaggacggccgcuucaucuucagccccggguuauuccccaaccugaaccaguccgucugcgacaacaacgcccucccccugaucuggcggggccugaucgaccucaccggguacuacgaggcgauccauccaugcaacguguucugcgugcugagcggccccggcgccuccugcgaggccuucagcgagggcgggaucuucaacaucacuucccccaugugucucgucagcaagcagaaucgcuuccgggccgccgagcagcagauauccuucgugugccagcgcgucgauauggacaucauuguguacuguaacgggcagaagaagaccauccucaccaagacccuggugaucggccagugcaucuacacgauaacgagccuguucagccuccugcccggggucgcgcacuccaucgccaucgagcugugcgugcccggcuuccacggaugggccaccgccgcgcuccugaucaccuucugcuucgggugggugcugauccccgccugcacgcucgcuauucugcugguccucaaguucuucgccaacauccugcacaccagcaaccaggagaaccgguucaaggcuauccugcgcaagaucaaggaggaguuugagaagaccaagggauccauggugugcgagaucuguaaguacgagugcgagacccucaaggagcugaaggcgcacaaccugagcugcgugcagggggaaugccccuacugcuucacgcacugcgagccuaccgagaccgccauccaggcccacuacaaggucugccaggccacccaccgguuccgcgaggaccucaagaagacggugaccccgcagaauaucgggcccgggugcuaccggacccugaaccuguuccgcuacaagucccggugcuacauccugaccauguggacccuccugcugaucaucgagaguauccucugggccgcguccgccgccgagaucccccuggugccccuguggacggacaacgcccacggcgucggcagcguuccgaugcacaccgaccucgagcuggacuucucccugcccagcuccagcaaguacaccuacaagcgccaccucacaaaucccgugaacgaccagcaguccgucagcgugcacaucgagaucgagucccaggggaucggcgcugacgugcaucaccugggucacugguacgacgcgcgccugaaccucaagacgagcuuccacugcuacggagccugcaccaaguaccaguacccguggcacaccgccaaaugccacuucgagaaggacuacgaguacgagaacuccugggccugcaacccgccggacugccccggcgucggaaccggcugcacggcgugcgggcuguaccuggaucagcucaagcccguaggcaccgccuucaagaucaucagcguacgguacagccgcaaagucugcgugcaguucggggaggaguaccugugcaagaccaucgacaugaacgacugcuucgugacccggcacgccaagaucugcaucaucggcacggucuccaaguucagccagggcgacacccuccucuuccuggggcccauggagggcggcgggaucaucuucaagcacuggugcaccuccacuugccacuucggggaccccggggacgugaugggccccaaggacaagcccuucaucugccccgaguuccccgggcaguuccgcaagaagugcaacuucgccaccacccccgugugcgaguacgacggcaacaccaucagcggguacaagaagguccuggccaccaucgauuccuuccagagcuucaacacguccaacauccacuucaccgacgagcggaucgaguggcgcgacccggacggcaugcuccgggaccacaucaacaucgugaucagcaaggacaucgacuucgagaaccuggcggagaaccccugcaaaguggggcugcaggccgcgaacaucgagggcgccuggggcuccggggucggcuucacccugaccugccaggugagccugacggagugccccaccuuccugaccuccaucaaggccugcgacauggcgaucugcuacggggccgagagcgugacccucucccgcggccagaauacggucaagaucaccggaaagggcggccacagcggguccagcuucaagugcugccacggcaaggagugcuccagcaccgggcugcaagccuccgcgccccaccuggacaaggugaacggcaucucggagcucgagaacgagaaggucuacgacgacggcgccccggagugcgggaucacgugcugguucaagaaguccggcgagugggucauggggaucaucaacggcaacuggguggugcugaucgucuuaugcgugcuccugcuguucucccucauccugcugagcauccucugccccgugcggaagcacaaaaaguccuga

SEQ ID NO: 15118 - RNA, 3402 nt, Artificial Sequence
  derived and/or modified CDS sequence (opt11) from SEOV(80-39)__S47716.1__GP
auguggucacuguuacugcuggccgcauuggugggccagggguucgcccugaagaacgucuucgacaugcgcauccaaugcccgcacuccgucaaguucggcgaaacaagcguguccggguacaccgagcuuccgccucucagccugcaggaggccgagcaacuggucccugaguccagcugcaacauggauaaccaccaaucccucagcaccaucaacaaacugaccaaagugaucuggagaaagaaagccaaccaggagagcgccaaccagaacagcuucgaguuaauggagucagaggucagcuucaagggccucugcaugcuaaagcaccgcauggucgaggaguccuaccggaaccgccgaagcgugaucugcuacgaucuggccugcaacaguaccuucugcaagcccaccguguacaugauagucccgauccacgcgugcaacaugaugaaguccugcuuaaucgggcugggccccuaccgcguccaggugguguacgaaaggacguacugcaccaccggaauccugaccgaagggaagugcuuuguccccgacaaggccguagucuccgcgcucaagcgcggcauguaugccauagcgagcauagagacgaucugcuucuucauccaccagaaagggaacaccuacaaaauugugaccgcuaucacauccgccaugggcaguaagugcaacaacacagacaccaaggugcagggguacuacauauguaucaucggcgggaacagcgcccccguguacgccccggcaggggaggacuuucgggccauggaaguguucucaggcauaaucaccagcccccacggggaagaccacgaccugcccggcgaggagauagccaccuaccagaucucgggccaaaucgaggccaagaucccucauacgguuagcuccaagaaucucaagcucaccgccuucgcggggaucccuagcuacuccagcaccuccauacuuaccgcuagcgaggauggccguuucaucuucagucccgggcuguuuccgaacuugaaccagagcgucugcgacaacaacgcccugccgcugaucuggcggggccucauugaccuaaccggguacuacgaggccgugcacccgugcaauguguucugcguccucucuggcccgggggccagcugcgaagcguucuccgagggcggcauuuucaacauuaccucgccgaugugccucgucuccaagcagaaucgcuuccgggcagccgagcaacaaaucucguucgucugccagcgcguugacauggacaucauaguguauugcaacgggcagaagaagacgauacugaccaagacgcucgucaucggccagugcaucuacaccauuaccucacucuucagccuucugcccggaguggcccacagcaucgccaucgagcucugcgugccgggcuuccacggcugggccaccgccgcccugcuuaucacguucugcuuuggguggguccucauccccgccugcacccuggcgauccugcugguguugaaguucuucgccaacauccugcacaccuccaaucaagaaaaccgguucaaggccauccuccgaaagaucaaggaggaguucgagaagaccaagggcagcauggugugcgagaucugcaaguacgaaugcgagacuuugaaggagcugaaggcacacaaccucaguugcgugcagggggagugcccauauugcuucacacauugcgagccuaccgagacggccauucaggcgcacuacaaggugugccaggccacgcaccgguuucgcgaggaccugaagaagacggugacuccccagaauaucggcccaggaugcuaccggacccugaaccuguuccgcuacaagagccggugcuacauccuaaccauguggacgcugcugcucaucauagaguccauccugugggccgccagcgccgcggagauuccauuggucccccuguggaccgacaaugcccacggcgucggcuccguaccaaugcacaccgaccuggagcuggacuucagccuccccuccagcucccgcuauacguacaagcgccaucugacgaacccagucaacgaccagcagagcgugucccuccacaucgagaucgaaucgcaggggaucggcgccgacguucaccaccucgggcacugguacgacgcccgacucaaccugaagaccuccuuccacuguuacggagccugcacgaaguaccaguauccguggcacacggcgaagugccacuucgagaaggauuacgaguacgagaacagcugggcaugcaacccacccgacugcccuggcgucggcacgggcuguacggccugugggcucuaccuagaccagcugaagcccgugggcaccgccuucaagauaaucuccgugcgcuacagcaggaaggucugcgugcaguuuggggaggaguaccucugcaagacuaucgauaugaacgacugcuucgugacgcgucacgccaagauaugcaucauaggaacugucagcaaauucucccagggcgauacccuucuguucuuggggcccauggagggcggaggcaucaucuucaagcacuggugcaccagcacgugccauuucggcgaccccggcgaugugaugggccccaaggacaagccauuuaucugcccggaguuccccggucaauuccggaagaaguguaacuucgccaccacccccgugugcgaguacgacggcaacaucauuuccggauacaagaagguccuggccaccaucgauagcuuccaguccuucaacaccagcaacauccacuucaccgaugagcggaucgaguggcgggacccagacggcauguuacgcgaccacaucaauaucgugauuuccaaggacaucgacuucgagaaccucgccgagaacccuugcaagguggggcugcaggccgcgaauaucgagggcgccuggggcagcggggugggcuucacgcugacgugccaggugucccucacggagugccccacauuuuuaaccagcauaagagccugcgauauggccauuugcuacggggccgaguccgugacccugagccgcggccagaacacagucaagauuacugggaagggcggacauagcgggagcuccuucaagugcugccacggcaaggagugcagccucaccgggcugcaagcguccgcgccccaccuggacaaggugaacggcaucagcgagcuagagaacgaaaaaguguacgacgauggcgccccggagugcggcaucacgugcugguucaagaaauccggcgagugggucaugggcaucaucaauggcaauuggguggugcugaucguccugugcguacuccuacuguucagccucauccugcugagcauccucugccccgugcggaagcacaaaaagagcuga

SEQ ID NO: 15119 - RNA, 3402 nt, Artificial Sequence
  derived and/or modified CDS sequence (opt11) from SEOV(93HBQ3)__KM115585.1__GP
auguggagcuugcuccugcuggccgcccucgugggucaaggguucgcccugaagaacgucuucgacaugcgcauccagugcccccacagcgugaaauuuggcgagaccagcgucucgggguauaccgagcugccgccccucagcuugcaagaggccgagcaacuggucccugaguccagcugcaacauggacaaccaccaaucccucagcaccaucaacaagcugaccaaggugaucuggcagaagaaggcaaaccaggaguccgccaaccaaaacucauuugagguggccgaauccgaggugagcuucaagggccugugcaugcucaagcaccgaaugguggaagaauccuaccgcaaucgccgcagcgugaucugcuacgaccuugcgugcaacucaaccuuuugcaagcccacugucuacaugaucguaccgauacacgccugcaacaugaugaaguccugccugaucggguugggccccuacagaauccagguggucuacgaacgcacguacuguaccaccggcauccugaccgaggggaagugcuucguuccagacaaggccgugguauccgcccuaaaacggggcauguacgcgaucgccagcaucgagacuaucugcuucuucauacaccagaaggggaacaccuacaagaucgugaccgccaucaccuccgcaaugggcagcaagugcaacaacacggauaccaaggugcagggguacuacaucugcauaauaggcgggaacagcgcacccgucuacgccccgucuggggaagacuuccgcgccauggaggucuucagcggcaucaucaugagcccccacggggaggaucacgaccuccccggagaggagauagccaccuaccaaauuucaggccagaucgaggccaagaucccccacaccguaagcucaaagaaccugaaacuuacggccuucgcgggaauaccguccuacagcuccaccagcauccucgccgccuccgaggauggaagauucaucuucucucccggguuauuccccaaccuaaaccaguccguuugcgacaacaacgcccuccccuugaucuggcggggccugaucgaccucacaggguacuacgaggccgugcacccuugcaaugucuucugcguccugagcggccccggcgcguccugcgaggccuuuagcgagggcgggaucuuuaacaucacguccccuaugugccuggugagcaaacagaaucgguuccgcgccgcggaacagcaaaucucuuucgucugccaacggguggacauggacaucaucguguauuguaacggacagaagaagacgauccucaccaagacccuggucaucggccaaugcaucuacaccaucacgaguuuguucagccuccugcccgggguggcccacuccaucgcgaucgagcugugcgugccgggcuuccacgguugggccaccgccgccuugcugaucaccuucugcuucgguuggguccugauccccgcgugcacucucgccauuuuacuggugcucaaguucuucgccaacauccugcacacaagcaaccaggagaaccguuucaaggccaucuuacggaaaauaaaggaagaguuugaaaagaccaagggcuccauggugugcgagauuugcaaguacgagugcgaaacccucaaagagcugaaagcccacaaccugagcugcguccaaggggagugccccuacugcuucacccacugcgagcccacggagaccgcuauccaggcacacuacaaggugugccaggcaacccacagauuccgggaggaucucaagaagaccgugacaccccagaacaucggacccggguguuauagaacccugaaccuguuccgguacaagucuagguguuacauccugaccauguggacgcuccucuugaucaucgagagcauccucugggccgcguccgcggccgagaucccccuggucccccuauggaccgacaacgcacacggcgugggcucagugccgaugcacacggaucucgagcucgacuucucccugcccagcuccagcaaguacacuuacaagcgccaccucacgaaccccgucaacgaccagcaguccgugucacugcacaucgagaucgagucgcaggggaucggcgcggacgugcaccaccugggucauugguacgacgcucgccucaaccugaagaccagcuuccacugcuacggugcgugcacgaaguaccaauacccguggcacaccgccaaaugccacuucgagaaggacuacgaguacgagaacuccugggcuugcaacccgcccgacugucccggggucgggaccggcugcaccgcuugcgggcuguaccucgaccagcugaagcccgugggcacggcccugaagaucaucagcgugcgcuauagccggaaggugugcguacaguucggagaggaguaucucugcaagaccaucgacaugaaugacugcuucgugacgcgccacgccaagauaugcaucaucggaaccgucuccaaauuuucccagggcgauacgcuucuguuccucgggccgauggagggcggugggaucaucuucaagcacuggugcacuucgacgugccacuucggggaccccggcgacguuaugggccccaaggacaagccguucauuugccccgaguuucccgggcaguuccggaagaagugcaacuuugccaccacccccgugugcgaguacgacggaaacaucaucagcggguacaagaagguccucgccaccaucgacuccuuccagagcuucaauacuucuaacauccacuucaccgacgagcgcaucgaauggcgagacccugacggcaugcugcgcgaccacaucaacaucguaaucucaaaggacaucgacuucgagaaccuugccgagaacccgugcaagguggggcugcaggcggccaacaucgagggcgccuggggguccggggucggcuucacgcugaccugccaggugagcuuaaccgagugccccaccuuccucacguccauaaaggccugcgacauggccaucugcuacggggcggaguccguaacucugcugcggggccaaaacacggucaagaucaccgggaagggaggccacucagggagcuccuucaagugcugccacggcaaggagugcagcuccacggggcugcaggccagcgcuccccaccuggacaagguaaacggcaucuccgaauuagagaacgagaaaguguaugaugacggcgccccugaaugcgggauaacgugcugguucaagaaguccggcgagugggucauggggauuaucaacggcaacuggguggugcuaaucguccugugcguucucuuacuguucucuuuaauccuguuaaguauccucugucccguuaggaagcacaagaagaguuag

SEQ ID NO: 15120 - RNA, 3402 nt, Artificial Sequence
  derived and/or modified CDS sequence (opt11) from SEOV(93HBQ4)__KM115586.1__GP
auguggagccugcuccugcuggccgccuuagugggccagggguucgcccugaagaacgucuucgacaugcgcauccagugcccccacagcgugaacuucggcgagaccagcguguccggguacaccgagcugccaccccucagcuugcaggaggccgagcaguugguccccgaguccagcugcaacauggacaaccaccaguccuuaagcaccaucaacaagcugaccaaggugaucuggcguaagaaggccaaccaggaguccgccaaccagaacagcuuugagguggcugaguccgaggucucguucaagggccugugcaugcucaagcaccgcaugguagaggaauccuaccggaaccgccggagcgugaucugcuacgaccuggcgugcaacuccaccuucugcaaacccacggucuacaugaucgugccgauacacgccugcaacaugaugaaguccugccugaucggucucggccccuaccguauccagguggucuacgagcggacguacugcaccaccggcauccugaccgaggggaagugcuucguacccgacaaggccgugguguccgccuuaaagcgcggaauguaugcgaucgccagcaucgagacgaucugcuucuucauucaccagaaggggaacaccuacaagaucgugaccgccaucaccuccgccaugggcagcaagugcaacaacacggauaccaaggugcagggcuacuacauaugcaucaucggcggcaacagcgcccccgucuacgcgccguccggggaggacuuccgggccauggaggucuucagcggcaucaucaugagcccccacggggaggaccacgacuuacccggcgaagagaucgccaccuaucagaucagcggccagaucgaggccaagaucccccacaccguguccagcaagaaccugaagcugacggccuucgccgggaucccguccuacagcuccaccaguauccucgccgccuccggcgacagcagauucaucuucucccccggucuguucccuaaccugaaccaaagcguaugcgauaacaacgcccucccccugaucuggcggggccugaucgaccucaccggguacuacgaggccgugcacccaugcaacguguucugcgugcuguccggccccggcgcgagcugcgaggccuucuccgaaggcgggaucuucaacaucaccagccccaugugccugguguccaagcaaaaccgcuucagagccgccgagcagcagaucagcuucgucugccagcgcguggacauggacaucaucguguacugcaacgggcagaagaagacgauccucaccaagacccugguuaucggccaguguaucuacaccaucacgucacuuuucagucuccugcccgggguggcccacagcaucgcgaucgaguuaugcguuccgggcuuccacggcugggccacugccgcccuccugaucaccuucugcuucgggugggucuugauccccgcgugcacccucgccauccugcuggugcucaaguucuucgccaacauucugcacacguccaaucaggagaaccgguucaaggccauccugcgcaaaaucaaggaggaguucgaaaagaccaagggcagcauggugugcgaaaucugcaaauacgagugcgagacccuuaaggagcugaaggcccacaaccuuuccugcguccagggggagugccccuacugcuucacccacugcgagcccaccgaaaccgcgauucaggcacacuacaaggugugccaggccacccaccgguuccgcgaggaccucaagaagaccgugacgccgcagaauaucggccccgggugcuaccggacccugaaccuguuccgcuacaagagccggugcuacaucuugaccauguggacccuccugcugaucaucgaguccauccucugggccgccagcgcggcagagaucccccuggucccccuguggaccgacaacgcccacggcguugguuccguuccgaugcacacggaccucgagcucgacuucagccugcccuccagcuccaaguacaccuacaagcgccaucucaccaaccccgugaacgaccagcagagcgugucucugcacaucgagauugagagccagggcaucggcgccgacgugcaccaucugggacacugguaugacgcccgccucaaccugaagaccagcuuccacugcuacggcgcguguacgaaguaccaguaccccuggcacaccgccaagugccacuucgagaaggacuacgaguacgaaaacagcugggccuguaacccgcccgacugccccggcgucgggaccggcugcaccgccugcgggcuguaccucgaccagcugaagcccgugggcacggcguucaagaucaucagcguacgguacucccgcaaggucugcgugcaauuuggggaggaguaccugugcaagaccaucgacaugaacgacugcuucgugacccggcacgcuaagaucugcaucaucggaacugugagcaaguucucccagggcgacacgcugcuguuccugggacccauggagggcggcggcaucaucuucaagcacuggugcaccucgacgugucacuucggggaccccggcgacgugaugggccccaaggacaagccguucaucugcccagaguuccccgggcaauuccgcaagaagugcaacuucgccacuacccccguaugcgaguacgacggaaacaucaucuccggguacaagaagguccucgcuaccaucgacagcuuucaguccuucaacacaagcaacauacacuucaccgacgagacgaucgaguggcgggacccggacggcaugcugcgugaccacaucaauaucguaaucuccaaggacaucgacuucgaaaaccuggccgagaaccccugcaagguggggcuccaggcggccaacauagagggcgccuggggcagcggggucggcuucacccugaccugccaggugucccucaccgagugccccacauuuuuaaccagcaucaaggccugcgacauggccaucugcuacggggcggaguccgugacccugagccggggccagaacacugucaagauaacugggaagggcggccacuccgggagcuccuucaaguguugccacggcaaggaaugcagcucuaccgggcugcaggccucagcgccccaccuagacaaggugaacgggauauccgagcuggagaacgagcgcguguacgacgacggcgccccggagugcgggaucacgugcugguucaagaaguccggugagugggucauggggaucaucaacggcaacuggguggugcugauaguccucugcgugcugcuccuguucagccuaauccugcucuccauccucugccccgugcggaaacacaagaaguccuga

SEQ ID NO: 15121 - RNA, 3402 nt, Artificial Sequence; identical to SEQ ID NO: 11835
  derived and/or modified CDS sequence (opt11) from SEOV(B1)__AB457790.1__GP

SEQ ID NO: 15122 - RNA, 3402 nt, Artificial Sequence; identical to SEQ ID NO: 11836
  derived and/or modified CDS sequence (opt11) from SEOV(B1)__AB457791.1__GP

SEQ ID NO: 15123 - RNA, 3402 nt, Artificial Sequence; identical to SEQ ID NO: 11837
  derived and/or modified CDS sequence (opt11) from SEOV(B1)__AB457792.1__GP

SEQ ID NO: 15124 - RNA, 3402 nt, Artificial Sequence
  derived and/or modified CDS sequence (opt11) from SEOV(B1)__AB457793.1__GP
auguggagccuacuccugcucgccgcgcucgucggccagggguucgcgcugaagaacgucuucgacaugcgcauccagugcccccacagcgugaacuucggcgagaccagcgucuccggguacaccgagcugccgccccucagccugcaagaggccgagcagcucguccccgaguccagcugcaacauggauaaccaccaaucccucagcacgaucaacaagcugaccaaagucaucuggcagaagaaagccaaccaggaguccgccaaccagaacagcuucgaggugguugagucagaggugagcuucaaaggcuugugcaugcucaagcaccggaugguggaggaguccuaccgcaaucggcgcagcgugauaugcuacgaccuugccugcaacuccaccuucugcaagccaaccguguacaugauagugccgauccacgcgugcaacaugaugaaauccugucugaucgggcucggcccauaucggauccaaguggcuuacgagcgcacguacugcaccaccgggauccugaccgaggggaaaugcuucgugcccgacaaggccguggucucugcccuuaagcggggcauguacgcgauagccagcaucgaaacgaucuguuucuucauccaucaaaaggggaacaccuacaagaucgugaccgccaucaccuccgccaugggcagcaagugcaacaacaccgacaccaaggugcagggguacuacaucugcaucaucggcggcaacagcgcccccgucuacgcgccggccggagaggauuuccgcgccauggagguguucuccgguaucaucaccagcccccacggugaggaucacgaccuccccggcgaggagauugcaaccuaccagaucaguggccagauagaagccaagauuccccacacggugagcuccaagaaccuccggcugaccgcguucgccggaaucccgagcuacuccuccaccuccauccucgccgccagcaaggauggccauuucauauucucccccgggcuguucccuaaucugaaccagucagucugcgacaacaacgcccuccccuuaaucuggcgcggccugaucgaccucaccggguauuacgaggcggugcaccccugcaacguguucugcgucuuauccggcccgggcgcaagcugcgaggccuucuccgagggcgggauuuucaacaucacgucucccaugugccuggucuccaagcagaaucgguuucgcgccgccgagcagcagaucucguucgucugccagcgggucgacauggacaucauaguguacugcaacgggcagaagaagaccauucucacuaagaccuuagucaucggccagugcaucuauacgauuacaucccuguucucacuccugcccgggguggcgcacagcauagccaucgaacugugugugccgggcuuccaugggugggcgaccgccgcgcuccugaucaccuucugcuucggguggauccugauccccgcgugcacgcucgcaauccuauuaguccucaaguucuucgcgaacaucuugcacaccuccaaccaggagaacagauucaaggccauccugcggaagaucaaagaggaguucgaaaagacaaaaggcagcauggugugcgagaucugcaaauacgagugcgagaccuuaaaggagcugaaggcgcacaauuuauccugcgugcagggggagugccccuacugcuucacgcacugcgaacccaccgagaccgccauccaggcccacuacaagaucugccaggccacccaccgcuuccgggaggaccucaagaagacggucacuccgcagaacaucggcccggggugcuaucgcacccugaacuuguuccguuacaagucgcgcugcuauauccugaccauguggacccuccuguugaucaucgagucgauccuuugggccgcaagcgccgccgagaucccccuggugccccuguggacagacaacgcccacggcgugggcuccgugccgaugcauaccgaccucgagcuggacuucagccugccgaguagcaguaaguacaccuacaagcggcaccucaccaaccccgugaacgaucagcagagcgugucccugcacaucgagaucgagagccaggggaucggcgcugacguccaccaccuggggcacugguacgacgcgcgccucaaucugaaaacguccuuccacugcuacggcgccugcaccaaguaccaguacccguggcacaccgccaagugucacuucgagaaggacuacgaauacgaaaauuccugggccugcaacccgcccgacugccccggcguggggaccggcugcacagcaugcggccuguaccucgaucagcugaaacccgugggcaccgccuucaaaaucaucucuguccgcuauagccgaaaggugugugugcaguucggggaggaauaccugugcaagaccaucgacaugaacgacugcuucgucacccgccacgccaaaauuuguaucaucgggaccguuagcaaguucucccagggcgacacccuccuguuucuggggcccauggagggcggcggcaucaucuucaagcacuggugcaccuccacgugccacuuuggugacccgggcgacgugaugggccccaaggacaagccguucaucugccccgaguuccccgggcaguuccggaagaagugcaacuucgccaccacccccgucugugaguacgacgguaacaucaucuccggauacaagaagguguuggccaccaucgacucguuccaguccuucaacaccagcaacauccacuucacggaugagcgcaucgaguggcgggacccggacggcaugcugcgcgaccauaucaacaucguuaucucgaaggacaucgacuucgaaaaccucgcggagaaccccugcaaggucggguuacaggccgccaacauagagggcgccugggggagcggggugggcuuuacccugaccugccaggugucccuaaccgaaugucccacuuuccucacgagcaucaaggcgugcgacauggcgaucugcuacggggccgaguccgucacccugucgagaggacagaacacagugaagauuacggggaagggcggccacuccgggagcucauucaaguguugccacggcaaggagugcagcuccaccgggcuucaggccucagcgccccaucucgacaaggugaacggcaucuccgagcuggagaacgagaaggucuacgacgacggcgccccggaguguggugugaccugcugguucaagaaguccggagagugggugauggggaucaucaacgggaacugggucgugcugaucgugcucugccugcugcuccuauucucccugauccuccugagcauccugugcccuauccgcaagcacaagaaguccuga

SEQ ID NO: 15125 - RNA, 3402 nt, Artificial Sequence
  derived and/or modified CDS sequence (opt11) from SEOV(B1)__AB457794.1__GP
auguggagccugcuccugauggccgcccuggugggccagggguucgcccucaagaacgucuucgacaugcgcauccagugcccccacagcgugaacuucggcgagaccagcguguccggguacaccgagcugccgccccugagccuccaggaggcugagcagcuagugcccgaguccagcugcaacauggauaaccaccagucccugagcacaaucaacaagcucaccaaggugaucuggcaaaagaaggccaaccaggaguccgccaaccagaacagcuucgagguggucgaguccgaggugagcuucaagggccugugcaugcugaagcacagaaugguggaggaguccuaccgcaaccgacgcagcgucaucugcuacgaccucgccugcaacuccaccuucugcaagcccaccguguacaugaucgucccgauccacgcgugcaacaugaugaaauccugccugaucgggcugggccccuaccggauccaggucgccuacgagcgcacguacugcaccaccgggauccucaccgaggggaagugcuucgugcccgacaaggccguggucucggcccugaagcggggcauguacgcgaucgccagcaucgagacgaucugcuucuucauccaccagaaggggaauaccuacaagaucgugaccgccaucaccuccgccaugggcagcaagugcaacaacacggacaccaaggugcagggguacuacaucugcaucaucggcggcaacagcgcccccgucuacgcgccggccggggaggacuuccgcgccauggagguguucuccggcaucauaaccagcccccacggggaggaccacgaccugcccggcgaggagaucgccaccuaccagaucuccggccagaucgaggccaagaucccccacacggucagcuccaagaaccuccggcugaccgcguucgccgggaucccuagcuacuccagcaccagcauccuggccgccagcaaggacggccacuucaucuucucccccgggcuguuccccaaccugaaccagagcguaugcgacaacaacgcccugccccucaucuggcgcggccugaucgaccugaccggguacuacgaggcggugcacccgugcaacguguucugcguccucuccggcccaggcgccagcugcgaggccuucuccgagggcggaaucuucaacaucacgagccccaugugccugguguccaagcagaaucgguuccgcgccgccgagcagcagaucagcuucgucugccagcggguggacauggacaucaucguguacugcaacgggcagaagaagaccauccugaccaagacccucgucaucggccagugcaucuacacgaucaccucccuguucagccugcuccccgggguggcgcacagcaucgccaucgagcuaugcgugccgggcuuccacggcugggccaccgccgcacugcucaucaccuucugcuucggguggauccugauccccgccugcacgcuggccaucuuacugguccucaaguucuucgccaacauccuccacaccuccaaccaggagaaccgcuucaaggccauccugcggaagaucaaggaggaguucgagaagaccaagggcagcauggugugcgagaucugcaaguacgagugcgagacccugaaggagcucaaggcgcacaaccuguccugcgugcagggggagugccccuacugcuucacgcacugcgagccgaccgagacggccauccaggcccacuacaagaucugccaggccacccaccgcuuucgggaggaccugaagaagacggucaccccgcagaacaucggccccgggugcuaccgcacccucaaccuguuccgguacaagagccgcugcuacauccugaccauguggacccuacuccugaucaucgaguccauccugugggccgcgagcgccgccgagaucccccucgugccccuguggacggacaacgcucacggcguaggguccgucccgaugcacaccgaccuggagcucgacuucagccugcccuccagcuccaaguacaccuacaagcggcaccuaaccaaccccgugaacgaccagcagagcgugucccuccacaucgagaucgagagccaggggaucggcgcugacguccaccaccuggggcacugguaugacgcucggcucaaccucaagacguccuuccacugcuacggcgccugcacaaaguaccaguacccguggcacaccgccaagugccacuucgagaaggacuacgaguacgagaacagcugggccugcaacccgcccgacugccccggcguggggaccggcugcacggcgugcgggcuguaccuggaucagcucaagcccgugggcaccgccuucaagauaaucuccguccgcuacagccggaaggugugcgugcaguucggggaggaguaccugugcaagaccaucgacaugaacgacugcuucgucacucgccaugccaagauuugcaucaucggcacggugagcaaauucucccagggcgacacccuccucuuccuggggcccauggagggcgggggcauaaucuucaagcacuggugcaccagcacgugccacuucggggaccccggcgacgugaugggccccaaggacaagccguucaucugccccgaguuccccgggcaguuccggaagaagugcaacuucgcuaccacccccgucugcgaguacgacggcaacaucaucuccggguacaagaaggugcuagccacgaucgacagcuuccaguccuucaauaccagcaacauccacuucacggacgagcgcaucgaguggcgggacccggacggcaugcuccgcgaccacaucaacaucgugaucuccaaggacaucgacuucgagaaccuugcggagaaccccugcaaggucggucugcaggccgccaacaucgagggcgccuggggcagcggggugggcuucacccugaccugccaggugucccugacggagugccccacguuccugaccagcaucaaggccugcgacauggcgaucugcuauggggccgagucugucacccucagccggggccagaacaccgugaagaucacggggaagggcggccacuccgggagcuccuucaagugcugccacggcaaggagugcagcuccaccgggcugcaggccagcgcgccccaccuggacaaggugaacggcaucuccgagcuggagaacgagaagguauacgacgacggcgccccggagugcggggugaccugcugguucaagaaguccggcgagugggugaugggcaucaucaacggcaacugggucgugcugaucgugcugugcuugcugcuccucuucagccugauccugcucagcauccugugccccauccgcaagcacaagaaguccuga

SEQ ID NO: 15126 - RNA, 3402 nt, Artificial Sequence; identical to SEQ ID NO: 11840
  derived and/or modified CDS sequence (opt11) from SEOV(B-1)__X53861.1__GP

SEQ ID NO: 15127 - RNA, 3402 nt, Artificial Sequence; identical to SEQ ID NO: 11841
  derived and/or modified CDS sequence (opt11) from SEOV(BjHD01)__DQ133505.1__GP

SEQ ID NO: 15128 - RNA, 3402 nt, Artificial Sequence
  derived and/or modified CDS sequence (opt11) from SEOV(Cherwell)__KM948593.1__GP
auguggagccugcucuugcuggccgcccucgugggccaggggagugcguugaagaacgucuuugacaugcgcauccagugcccccacagcgugaacuuuggcgagaccuccgugagcggguacaccgaacugccacccuugucccugcaggaggccgagcagcugguccccgagagcuccugcaauauggacaaccaccagagccucuccaccaucaacaagcugacuaaggugaucuggcggaagaaggccaaccaagagagcgccaaccagaacuccuuugagguggucgagagcgagguguccuucaagggccugugcaugcucaagcaccgcaugguggaggagagcuaccggaaccgccgguccgucaucugcuacgaccuggcuugcaacagcaccuucugcaagccuaccguguacaugaucguuccgauccacgcgugcaacaugaugaaauccugccugaucggucucggccccuaccgcauccaggucguguaugagcggacguacuguaccaccggcauccugaccgaggggaagugcuucgugcccgacaaggccgucgugagcgcccugaaaaggggcauguacgccaucgcguccaucgagacgaucugcuuuuucauccaccagaaggggaacaccuacaagaucgugaccgcaaucaccucagccaugggcagcaagugcaacaauacggacaccaagguccagggguacuacaucugcaucaucggcggcaacuccgcccccguguacgccccggcgggggaggacuuucgggccauggagguguucagcggcaucaucaccagcccccacggggaggaucacgaccuccccggggaggagaucgccaccuaccagauaagcggccagaucgaggccaagaucccccacacggucucgagcaagaaccugaagcugaccgcguucgcggguaucccguccuauagcuccaccucgauccuggccgccuccgaggacggccgcuucaucuucagccccggacuguuccccaaccugaaccaguccgugugcgacaacaaugcccucccccugauauggcggggacugaucgaccucaccggguacuacgaggccgugcacccgugcaacguguucugcguucugagcggccccggcgcguccugcgaggccuucagcgagggcgggaucuucaacaucacgucccccaugugcuuggucagcaagcagaaccgcuuccgggccgccgagcaacagaucuccuucgugugccagcgcguggacauggacaucaucgucuacuguaacgggcagaagaagaccauccucaccaagacccugguuaucggccaaugcaucuacacgauuaccagcuuauucagccuccugcccgggguggcccacuccaucgcaaucgagcugugcgucccgggcuuccauggcugggccaccgccgcccuccucaucaccuucugcuucgggugggugcugauccccgcgugcacgcucgccaucuugcugguacucaaguucuucgcaaacauccugcacaccagcaaucaggagaaccgcuucaaggccauccugcgcaagaucaaagaggaguucgagaagacuaaaggcuccauggucugcgagaucugcaaauacgaaugcgagacccucaaggagcugaaggcccacaaccugagcugugugcagggggagugccccuacugcuucacccacugcgagcccaccgagaccgcgauccaggcccacuacaaggugugccaggcuacccaccgguuccgggaggaccucaagaaaacagucaccccgccaaauaucggccccgguugcuaccggacccugaaccuguuccgcuacaagucccgcugcuacauccugaccauguggacccuacugcuuaucaucgagagcauccucugggccgccuccgcggccgagaucccauuggugccgcuguggacugacaacgcccacggcgugggcagcguccccaugcacaccgaccucgagcuugacuucucacugcccagcuccagcaaguacaccuacaagcgccaccucaccaacccggugaacgaccagcaauccgugagccugcacaucgagaucgagucccaggggaucggggccgacgugcaucacuuagggcacugguacgacgcccgccucaaccugaagacgagcuuccacugcuacggcgcgugcaccaaguaccaguaccccuggcauaccgccaagugccacuucgagaaggacuacgaauacgagaacagcugggccugcaacccacccgacuguccaggcguggggaccggcugcacggccugcgggguauaucuggaccagcuaaagcccguaggcaccgcguucaagaucguuagcgugcgguacagccgcaaggucugcgugcaguucggggaggaguaccugugcaagaccaucgacaugaacgacugcuucgugacccggcacgcuaagaucugcauaaucggcacggucuccaaguuuagccagggcgacacccuccuguuccuggggcccauggagggcgggggcaucaucuucaaacacuggugcaccagcacgugccacuucggggaccccggcgacgugaugggcccaaaggacaagcccuucaucugccccgaguuucccgggcaguucaggaagaagugcaacuucgccaccaccccgguaugcgaguacgacggaaacaucaucagcggcuacaagaagguccuggccaccaucgacuccuuccagagcuucaacacuuccaacauccacuucacggacgagcgaaucgaguggcgcgaccccgacggcaugcuccgggaccacaucaacauugugaucagcaaggacauagacuucgagaaccuggccgagaaccccugcaagguggggcugcaggcggccaacauugagggcgccuggggcuccggggucggcuucacccugaccugccagguuagccugaccgagugccccacguuccugaccuccaucaaggccugcgacauggccauaugcuacggggcggaaagcgugacccucucccgcggccagaacaccgucaagaucacggggaagggcggccacagcggguccagcuucaaguguugccacggcaaggagugcuccagcaccgggcugcaggccuccgccccgcaccuggacaaggugaacggcaucagcgagcucgagaacgagaagguauacgacgacggcgcccccgagugcggggugaccugcugguucaaaaagagcuccgagugggucaugggcaucauuaacgggaacugggugguccugaucguguuaugugugcuccugcuguucagccucauacugcugucaauccucugccccguccggaagcacaagaaguccuga

SEQ ID NO: 15129 - RNA, 3402 nt, Artificial Sequence
  derived and/or modified CDS sequence (opt11) from SEOV(HaixingRn40)__GU592924.1__GP
auguggagccuccucuuccuggccgcccuggugggccaaggguucgcccucaagaacgucuucgacaugcgcauccagugcccccacucagugaacuucggcgagaccagcguguccggguacaccgagcugccgccucuaucccuccaggaggccgagcaacugguccccgaguccagcugcaacauggacaaccaccaaucccugagcacgaucaacaagcucaccaaggugaucuggcggaagaaggccaaccaggaguccgccaaccagaacagcuucgaaguggucgaguccgaggugagcuucaagggccugugcaugcuuaagcaccgcaugguggaggaguccuaccggaaccgccggagcgucaucugcuacgaccucgccugcaacuccaccuucugcaagcccaccguguacaugaucgugccgauccacgcgugcaauaugaugaaguccugccugaucgggcugggccccuaccgcauccaggucguguacgagcggacguauugcaccaccggcauccucaccgaggggaagugcuucgugcccgacaaggccguagugagcgcccugaagcgcggcauguacgccauagcgagcaucgagacgaucugcuucuucauccaccagaaggggaacaccuacaagaucgugaccgccaucaccuccgccaugggcagcaagugcaacaacacggacaccaagguccagggguacuauaucugcaucaucggcggcaacucugcccccguguacgccccggcgggggaagacuuccgggcgauggagguguucuccggcaucaucaccagcccccacggggaggaccacgaucugcccggcgaggagaucgccaccuaccagaucuccggccagaucgaggcaaagaucccccacacggucagcuccaaaaaccucaagcugaccgccuucgcggggaucccgagcuauagcagcaccucaauccuggccgccagcgaggacggccgcuucaucuucucccccgggcuguuccccaaccugaaccagagcgugugcgacaacaacgcccugccccucaucuggcggggccugaucgaccugaccggguacuacgaggccgugcacccgugcaacgucuucugcgugcucuccggccccggggcgagcugcgaggccuucuccgagggcgggaucuucaacaucacgagccccaugugccuggucuccaagcaaaaccgcuuccgggccgccgagcagcagaucagcuucgugugccagcgcguggacauggacaucauagucuacugcaacgggcagaagaagaccauccugacccggacccucgugaucggccagugcaucuacacgaucaccucccuguucagccugcuccccgggguggcacacagcaucgcgaucgagcugugcgucccgggcuuccacggcugggccaccgccgcgcugcucaucaccuucugcuucgggugggugcugauccccgcgugcacgcuggccauccuccuggugcugaaguucuucgccaacauccuccacaccuccaaucaggagaaccgcuucaaggccauccugcggaagaucaaggaggaguucgagaagaccaagggcagcauggucugcgagaucugcaaguacgagugcgagacccugaaggagcucaaggcccacaaccugucuugcgugcagggggagugccccuacugcuucacgcacugcgagcccaccgagaccgcgauccaggcccacuacaaggugugccaggccacccaccgcuuccgggaggaccugaagaagacggucaccccucagaacaucggccccgggugcuaccguacccucaaccuguuccgguacaagucacguugcuacauccugaccauguggacccugcuccugaucauugaauccauccugugggccgccagcgcggccgagaucccccucgugcccuuguggacggacaacgcccacggcgugggcuccguccccaugcacaccgaccuggagcucgacuucagcuugcccuccagcuccaaguacaccuacaagcgccaccugaccaaccccgugaacgaccagcagagcgugucccuccacauugagaucgagagccaggggaucggcgccgacguccaccaccuggggcacugguacgacgcccggcugaaccucaagacguccuuccacugcuacggcgcgugcaccaaguaucaguacccguggcacaccgccaagugccacuucgagaaggacuacgaauacgagaacagcugggccugcaacccgcccgacugccccggcguggggaccggaugcacggccugcggguuauaccuggaccagcucaagcccgugggcaccgcguucaagaucaucuccguccgcuauagccggaaggugugcgugcaguucggggaggaguaccugugcaagaccaucgacaugaacgacugcuucgucacccgccacgccaaaaucugcaucaucggcacggugagcaaguucucccagggcgacacccuccucuuccugggccccauggagggcgggggcaucaucuucaagcacuggugcaccagcacgugccacuucggggaccccggcgacgugaugggacccaaggacaagccguucaucugccccgaguuccccgggcaguuccggaagaagugcaacuucgccaccacccccgucugcgaauacgacggcaacaucaucuccggguacaagaaggugcuggccaccaucgacagcuuccaguccuucaacaccagcaacauccacuucacggacgagcgcaucgaguggcgggacccggacggcaugcuccgcgaccacaucaacaucgugaucuccaaagacaucgacuucgagaaccuggggcagaaccccugcaaggucggccugcaggccgcgaacaucgagggcgccugggggucaggcgugggguucacccugacaugccaggugucccugaccgagugccccacguuccugaccagcaucaaggccugcgacauggccaucugcuacggugccgaguccgucaccuuaagccgcgggcagaauaccgugaagaucacgggcaagggcgggcacuccggcagcuccuuuaaaugcugccacgggaaggagugcagcuccaccggccugcaggcgagcgcgccccaccuggacaaggugaacggcaucuccgaccuagagaacgagaaggucuacgacgacggggccccggagugcggcgugaccugcugguucaagaaguccggggagugggugaugggcaucaucaacgggaacugggucguguugaucgugcugugcguccuccugcuguucagccucauccugcugucgauccucugccccgugcgcaagcacaagaaguccuga

SEQ ID NO: 15130 - RNA, 3402 nt, Artificial Sequence; identical to SEQ ID NO: 11844
  derived and/or modified CDS sequence (opt11) from SEOV(HBQ17)__KM233655.1__GP

SEQ ID NO: 15131 - RNA, 3402 nt, Artificial Sequence; identical to SEQ ID NO: 11845
  derived and/or modified CDS sequence (opt11) from SEOV(HBQ20)__KM233656.1__GP

SEQ ID NO: 15132 - RNA, 3402 nt, Artificial Sequence; identical to SEQ ID NO: 11846
  derived and/or modified CDS sequence (opt11) from SEOV(HBQ43)__KM233657.1__GP

SEQ ID NO: 15133 - RNA, 3402 nt, Artificial Sequence
  derived and/or modified CDS sequence (opt11) from SEOV(HBQ5)__KM233653.1__GP
auguggagccuccucuuccucgccgcccuggugggccagggguucgcccucaagaacgucuuugacaugcgcauccaaugcccccacagcgucaacuucggagagacuagcguguccggguacaccgagcugccgccccugagccuccaggaggccgagcagcuggucccggaguccuccugcaacauggacaaccaccagucccugagcacgauaaacaagcucaccaagguuaucuggcguaagaaagccaaccaggaguccgccaaccagaacagcuuugagguggucgaguccgagguuagcuucaagggccugugcaugcugaaacaccgcaugguggaggaguccuacagaaaccgccggagcgucaucugcuacgaccucgccugcaacuccaccuucuguaagcccaccguguacaugaucgucccgauccacgcgugcaacaugaugaaguccugccugaucgggcugggucccuaccgcauccaggucguguacgagcggacguacugcaccaccggcauccucacggaggggaagugcuucgugccugacaaggccguugugagcgcccugaagcgcggcauguacgccaucgcgagcaucgagacgaucugcuuuuucauccaccagaaggguaacaccuacaagaucgugaccgccaucaccuccgccaugggcagcaagugcaacaacacggacaccaagguccagggguacuacaucugcaucauaggcggcaacagcgcccccguguaugccccggcgggggaggacuuccgggccauggagguguucuccggcaucauaacuagcccccacggggaggaccacgauuuacccggcgaggagaucgccaccuaucagaucuccggccagaucgaggcaaagaucccccacacggucagcucgaagaaccucaagcugacugccuucgcggggaucccgagcuacuccucgacguccauucuggccgccagcgaggacggucgcuucaucuucuccccggggcuguuccccaaccugaaccagagcgugugcgacaauaacgcccugccccucaucuggcgaggccugaucgaccugacgggguacuacgaggccgugcacccgugcaacgucuucugcguacucuccggccccggcgcgagcugcgaggccuucuccgagggcgggaucuucaacaucacgagucccaugugccuggucagcaagcagaaccgcuuucgggccgccgagcaacagaucaguuucgugugccaacgcguggacauggacaucaucgucuacugcaacgggcagaagaagaccauccugacaaagacccucguuaucggccagugcaucuacacgaucaccucccuguucucacugcuccccgggguggcccacagcaucgcgaucgaguuaugcgucccgggcuuccacggcugggccaccgccgcucugcucaucaccuucugcuucggaugggugcugauccccgcgugcacgcuggccauccuccuggugcugaaauucuucgccaauauccuccacaccuccaaccaggagaaccgguucaaggccauccugcgcaagaucaaggaggaguucgagaagaccaagggcagcaugguaugcgagaucugcaaguacgagugcgagacccugaaagagcucaaggcccacaacuuauccugcgugcagggggagugccccuacugcuucacgcacugcgagcccaccgagaccgcuauccaggcccacuacaaaguaugccaggccacccaccgguuccgcgaagaccugaagaagacggucaccccgcagaauauaggccccgguugcuaccggacccucaaccucuucagauacaagucgcgguguuacauucugaccauguggacccugcuccugaucaucgaguccauccugugggccgccagcgcggccgagaucccccucgugccgcuguggacggacaacgcccacggcgugggcuccgucccgaugcacaccgaccuggagcucgacuucucacugccguccuccuccaaguacacguacaagcgccaccugaccaaucccgugaacgaccagcagagcgucucucuccacaucgagaucgaaagccaggggaucggcgcugacguccaccaucuggggcacugguacgacgcccgccugaaccucaagacguccuuccacugcuacggcgcgugcaccaaguaccaguacccguggcacacugccaagugccauuucgagaaggacuacgaguacgagaacagcugggccugcaacccgcccgacugcccaggcguggggaccggcuguacggccugcgggcuguaccuggaccagcucaagcccgugggaacagcguucaagaucaucuccguccgauacucccgcaaggugugugugcaguucggggaggaguaccugugcaagacuauugacaugaacgacugcuucgucacccggcacgccaagaucugcaucaucggcacggucaguaaguucucccaaggcgacacccuccucuuccuggggcccauggagggcgggggcauaaucuuuaagcacuggugcaccagcacgugccacuucggggaccccggcgaugugaugggccccaaggacaagccguucauaugccccgaguucccugggcaguuccgcaagaagugcaacuucgccaccacccccgucugugaguacgacggcaacaucaucuccggguacaagaaggugcuggccacgaucgacagcuuccaguccuuuaacaccagcaacauccacuucacggacgaacguaucgaguggcgcgacccggacggcaugcuccgggaucacauuaacaucgugaucuccaaggacauagacuucgagaauuuggccgagaaccccugcaaggucgggcugcaagcggccaacaucgagggcgccuggggcaguggggugggcuucacccugacgugccaggugagccugaccgagugccccacguuccugaccagcaucaaggccugcgacauggccaucugcuacggugcggaauccgucacccugagccgcggccagaacaccgugaagaucacggggaaggguggccacuccgggagcuccuuuaagugcugccacggcaaagaguguagcuccaccgggcugcaagccagcgcgccccaccuggacaaggugaacggcaucuccgagcucgagaacgagaaggucuacgacgacggcgccccggagugcggggugaccugcugguucaagaagucuggcgagugggugauggggauuaucaacggcaacugggucgugcugauuguccucugcguccuccugcuguucagccucauccuguugagcauccucugcccagugcguaagcacaagaaaagcuag

SEQ ID NO: 15134 - RNA, 3402 nt, Artificial Sequence; identical to SEQ ID NO: 11848
  derived and/or modified CDS sequence (opt11) from SEOV(HBT14)__KM233658.1__GP

SEQ ID NO: 15135 - RNA, 3402 nt, Artificial Sequence
  derived and/or modified CDS sequence (opt11) from SEOV(HBT-3)__KM233661.1__GP
auguggagccuccucuuccuggccgcccuggugggccagggguucgcgcucaagaacgucuucgacaugcgcauccagugcccccacagcgugaacuucggcgagaccagcguguccggguacaccgagcugccuccccugagccugcaggaggccgagcagcugguccccgaguccagcuguaacauggacaaccaccaaagccugagcacgaucaacaagcucaccaaggucaucuggcggaagaaggcgaaccaagaguccgccaaccaaaacagcuucgagguggucgagucugaggugagcuucaagggccugugcaugcugaagcaccgcaugguggaggagucauaccggaaccgccgguccgucauaugcuacgaccuccccugcaacuccaccuucugcaagccgaccguguacaugaucgugcccauccacgccugcaacaugaugaaguccugccugauagggcugggccccuaccgcauccaggucguguacgagcggacguacugcaccaccggcauccucaccgaggggaagugcuucgugcccgacaaggcggucgugagcgcccugaagcgcggcauguacgccaucgccagcaucgagacgaucugcuucuucauccaccagaaggggaauaccuacaagaucgugaccgcgaucaccuccgccaugggcagcaagugcaacaacacggacaccaagguccagggguacuacaucugcaucaucggcggcaacagcgccccgguguacgcccccgccggggaggacuuccgggcgauggagguguuuuccggcaucaucaccagcccccacggggaggaccacgaccugcccggcgaggagaucgccaccuaccagaucuccggccagaucgaggccaagaucccacacacggucagcuccaagaaccucaagcugaccgccuucgccgggauccccagcuacuccagcaccuccauccuggcagccagcgaggacggccgcuucaucuucucccccgggcuguuucccaaccugaaccagagcgugugcgacaacaacgcccugccgcucaucuggcggggccugaucgaccugacgggguacuacgaggccgugcacccaugcaacgucuucugcgugcucuccggccccggcgcaagcugcgaggcguucuccgagggcgggaucuucaacaucacgagccccaugugcuuggucuccaagcagaacagguuccgggccgccgagcagcagaucagcuucgugugccagcgcguggacauggacaucaucgucuacugcaacgggcagaagaagaccauccugaccaagacccucgugaucggccagugcaucuacacgaucaccucccuguucagccuacucccggggguggcccacagcaucgccaucgagcugugcguccccgguuuccacggcugggcgaccgccgcccugcuuaucaccuucugcuucgggugggugcugauccccgccugcacgcuggcgauccuccuggugcugaaguucuucgccaacauccuccacaccagcaaccaggagaaccgguucaaggccauccugcgcaagaucaaggaggaauuugagaagaccaaggguagcauggucugugagauaugcaaguacgagugcgaaaccuucaaggagcugaaggcccacaaccucuccugcgugcagggggagugccccuacugcuucacgcacugcgagccgaccgagaccgccauccaggcgcacuacaaggugugccaggccacccaccgguuccgcgaggaccugaaaaagacagucacgccccagaacaucgggcccgggugcuaccggacccugaaccucuuccgcuauaagagccggugcuacauccugaccauguggacccugcugcucaucaucgaguccauccugugggccgccagcgccgcggagaucccccuggugccgcucuggaccgacaacgcccacggcgucggcuccguccccaugcacaccgaccuggagcuggacuucagccuccccuccagcuccaaguacaccuacaagcgccaccugaccaacccggugaacgaccagcagagcgugucccugcacaucgagaucgagagccaggggaucggcgccgacguccaccaucucgggcauugguacgacgcccgccucaaccuuaagacguccuuccacugcuacggcgccugcaccaaguaccaguaccccuggcacaccgcgaagugccacuucgagaaggacuaugaguacgagaacagcugggccugcaacccgcccgacugccccggcguggggaccggcugcacggcgugcgggcucuaccuggaccagcugaagcccgugggcaccgccuucaagaucaucuccguccgguacagccgcaagguguguguucaguucggggaggaguaccucugcaagaccaucgacaugaacgacugcuucgucacccggcacgcuaagaucugcaucaucggcacggugagcaaguucagucagggcgacacccugcuguuccucgggcccauggagggcgggggcaucaucuucaagcacuggugcaccagcacgugccacuucggggaccccggcgacgugaugggcccgaaggacaagcccuucaucugcccggaguuccccgggcaguuccgcaagaagugcaacuucgcgaccaccccggucugcgaguacgacggcaacaucauuuccggguacaagaaggugcuggccaccaucgacagcuuccaguccuucaacaccagcaacauccacuucacggacgagcggaucgaguggcgcgaccccgacggcaugcugcgggaccacaucaacaucgugaucuccaaggacaucgacuucgagaaccucgccgagaaccccugcaaggucgggcugcaggccgcgaacaucgagggcgccuggggcagcggggugggcuucacccugaccugccaggugucccucaccgagugccccacguuccugaccagcaucaaggccugcgacauggccaucugcuacggggcugagagugucacccugagccgcgggcagaacaccgugaagaucacggggaagggcggccacuccgggagcucauucaagugcugccacggcaaggagugcagcuccaccgggcuccaggcgagcgccccgcaccuggauaagguuaacgguaucuccgagcuggagaacgagaaggucuacgacgacggcgcccccgagugcggggugaccugcugguuuaagaaguccggcgaaugggugauggggaucaucaacggcaacugggucgugcucaucguacugugcguccugcuccuguucagccugauccuccugagcauccucugccccgugcggaagcacaaaaaguccuga

SEQ ID NO: 15136 - RNA, 3402 nt, Artificial Sequence
  derived and/or modified CDS sequence (opt11) from SEOV(HBT49)__KM233659.1__GP
auguggagccuucucuuccuagccgcccuggugggccagggguuugcccucaagaacgucuuugacaugcgcauccagugcccccacagcgugaacuucggcgagaccagcguguccggguacaccgaguuaccgccccugagccuccaggaggccgagcagcugguccccgaguccagcugcaacauggacaaccaccagucccugagcacgaucaacaagcucaccaaaguuaucuggcggaagaaggcaaaucaggaguccgccaaccagaacagcuucgagguggucgaauccgagguaucuuucaagggacugugcaugcugaaacaccgcaugguggaggaguccuaccggaaccgccggagcgucaucugcuacgaccuagccugcaacuccaccuucugcaagcccaccguguacaugaucgugccgauccacgcgugcaacaugaugaaauccugccugaucgggcugggccccuaccgcauccaggucgucuacgagcggacguacugcaccaccggcauacucacugaggggaaguguuucgugcccgacaaggccgucgugagcgcccugaaacgcggcauguacgccaucgccagcauugaaacgaucugcuucuucauccaccagaaggggaacacguacaaaauugugaccgccaucaccuccgccaugggcagcaaguguaacaacacggacaccaagguccagggguauuacaucugcauaaucggcggcaacagcgcccccguguacgccccggcgggcgaggacuuccgggccauggagguguuuuccggcaucaucacgucgccccacggggaggaccaugaccugcccggcgaggagaucgccaccuaccagauaucgggccagaucgaggccaagaucccacacacggucagcuccaagaaccucaagcugaccgcguucgcggggaucccgagcuacucaagcaccuccauacuggccgccagcgaggacggccgcuucaucuucucccccgggcuguuccccaaccugaaccagagcgugugcgacaacaacgcccugccccuaaucuggcggggcuugaucgaccucacuggguacuacgaggccgugcacccaugcaacgucuucugcgugcucuccggcccgggagcuagcugcgaggccuucuccgagggcgggaucuucaacaucacgagccccaugugccuuguuuccaagcagaaccgcuuccgggccgccgagcaacagaucagcuucgugugccagcgagucgacauggacaucaucgucuacugcaacgggcagaagaagaccauccugaccaagacccucgugaucggccagugcaucuacacgaucacuucccuguuuagccugcuccccgggguggcccacucgaucgccaucgagcugugcgucccgggcuuccacggcugggccacugccgcccugcucaucaccuucugcuucgguugggugcugauccccgcgugcacgcuggccauauugcuggugcugaaguucuucgccaacauccuccacaccuccaaccaggagaaccgguucaaggccauccugcgcaagaucaaggaggaguucgagaaaaccaagggcagcauggucugcgagaucugcaaguacgagugcgagacccucaaggagcucaaggcccacaacuuauccugcgugcagggugagugccccuauugcuucacgcacugcgagccgaccgagaccgcgauccaggcccacuacaaggugugucaggccacccaucgguuccgcgaggaucugaagaagacggucaccccgcagaacaucggccccgggugcuaccggacccucaaccuguuccgcuacaaaagccggugcuacauccugaccauguggacccugcuccucaucaucgaguccauccugugggccgccagcgcggccgagaucccccucgugccccuguggacggacaacgcccacggcgugggcuccgucccgaugcacaccgaccuggagcucgacuucagccugcccuccagcuccaaguacaccuacaagcgccaccugaccaaccccgugaacgaccaacagagcgugucccuccacaucgagaucgagagccaggggaucggcgcggacgucuaccaccuagggcacugguacgacgcccgccugaaccuaaagacguccuuucacugcuacggcgcgugcaccaaguaccaguacccguggcacacggccaagugccacuucgagaaagacuacgaguacgagaacagcugggccugcaacccgcccgacugccccggcguggggaccggcugcacggccuguggccuguaccuggaccagcucaagcccgugggcaccgcguucaagaucaucuccguccgauacagccgcaaggugugcgugcaguucggcgaggaguaccugugcaagaccaucgacaugaacgauugcuucgucaccaggcacgccaagaucugcaucaucggcaccgugagcaaguucucccagggcgacacccuccucuuccuggggcccauggagggcgggggcaucaucuucaagcacuggugcaccagcacgugccacuucggggaccccggcgacgugaugggccccaaagacaagccguucaucugcccagaguuccccgggcaguuccgcaagaaguguaauuucgccaccacccccgucugcgaguacgacggcaacauuaucuccggguacaagaaggugcuggccaccaucgacagcuuccagagcuucaacaccagcaacauccacuucacggacgagcggaucgaguggcgcgacccggacggcaugcuccgggaccauaucaacaucgugaucuccaaggacaucgacuucgaaaaucuggccgagaaccccugcaaggucgggcugcaggcggccaacaucgaaggcgccuggggcagcggggugggcuucacccugaccugccagguuucacucaccgagugucccacguuccugaccucuaucaaagccugcgacauggccaucugcuacggagcggaguccgucacccucagccguggccagaacaccgugaagaucacggggaagggcggccacuccgggagcuccuucaagugcugccacggcaaggagugcagcuccaccgggcugcaggccuccgcgccccaccuggacaaggugaacggcaucuccgagcucgaaaacgagaaggucuacgacgauggugccccggagugcggggugaccugcugguucaagaagucaggcgagugggugauggguaucauaaauggcaacugggucgugcugaucguccugugcguauugcugcuguucagccucauccugcugagcauccucugccccgugcggaagcacaagaaguccuga

SEQ ID NO: 15137 - RNA, 3402 nt, Artificial Sequence
  derived and/or modified CDS sequence (opt11) from SEOV(HBT50)__KM233660.1__GP
auguggucucuccucuuccuggccgcccuggugggccagggguucgcccugaagaacgucuucgauaugcgcauccagugcccccacagcgugaacuucggcgagacuagcguguccggguacaccgagcugccgccccugagccuccaggaggccgagcaguugguccccgaguccagcugcaacauggacaaccaccagucccugagcacgaucaacaagcucaccaaggugauuuggcgcaagaaggccaaccaggaguccgccaaucagaacagcuucgagguggucgaguccgaggugagcuucaagggccugugcaugcugaagcaccgcaugguggaggaguccuaccggaaccgccggagcgucaucugcuacgaccucgccugcaacuccaccuucuguaagcccaccguguacaugaucgugccgauccacgcgugcaacaugaugaaguccugccugaucgggcugggccccuaccgcauccaagucguguacgaacggacguauugcaccacaggcauccucaccgaggggaagugcuucgugcccgacaaggccgucgugagcgcccugaagcgcggcauguacgccaucgcgagcaucgagacgauuugcuucuucauccaccagaaggggaacaccuacaagaucgugaccgccaucacguccgccaugggcagcaagugcaacaacacggacaccaagguccaggguuacuacaucugcaucauaggcggcaauagcgcccccguguacgccccggcgggggaggacuuccgggccauggagguguucuccggcaucaucaccagcccccacggggaagaccacgaccugcccggcgaggagaucgccaccuaccagaucuccggccagaucgaggccaagaucccccacacggucagcuccaagaaccucaagcugaccgccuucgcgggcaucccgagcuacuccagcaccuccauccuggccgccagcgaggacggccgcuucaucuuuucccccgggcuguuccccaaccugaaccagagcgugugcgacaacaacgcccuaccccucaucuggcggggccugaucgaccugacgggguacuacgaggcagugcacccgugcaacgucuucugugugcucuccggccccggcgccagcugcgaagccuucuccgagggcgggaucuucaacaucacgagccccaugugccuggucuccaagcagaaccgcuuccgggccgccgagcagcagaucagcuucgugugccagcgcguggacauggacaucaucgucuacugcaacgggcaaaagaagaccauccugaccaagacccucgugaucggccagugcauauacacgaucaccucccuguucagucugcuccccgggguggcccacagcaucgcgaucgagcugugcgucccgggcuuccacggcugggccaccgccgcccugcucaucaccuucugcuucgggugggugcucauccccgcgugcacgcuggccauccuccuggugcugaaguucuucgccaacauccuccacaccuccaaccaggagaaucgguucaaggccaucuugcgcaagaucaaggaggaguucgagaagaccaagggcagcaugguuugcgagaucugcaaguacgagugcgagaccuuaaaggagcucaaggcccacaaucuguccugcgugcagggggagugccccuacugcuucacgcacugcgagcccaccgagacggcgauccaggcccacuacaaggucugccaggccacccaccgguuccgcgaggaccugaagaagacggugaccccgcagaacaucggccccgggugcuaccggacccucaaccuguuccgcuacaagucacggugcuacauccugaccauguggacccugcuccugaucaucgaguccauccugugggccgccagcgcugccgagauacccuuagugccccuguggaccgacaacgcccacggcgugggcuccgucccgaugcacaccgaccuggagcucgacuucagccugcccuccagcuccaaguacaccuacaagcgccaccugaccaaccccgugaacgaccagcagagcgugucccuccacaucgagaucgagagccaggggaucggcgccgauguccaucaccuggggcacugguacgacgcccgccugaaccucaagacguccuuccacugcuacggcgcgugcaccaaguaccaguacccguggcacaccgccaagugccauuucgagaaggacuacgaguacgagaacagcugggccugcaacccgcccgauugucccggcguggggaccggcugcacggcuugcgggcuguaccuggaccagcucaagcccgugggcaccgcguucaagaucauuuccguccgguacagccggaaggugugcgugcaguucggagaggaguaccugugcaagaccaucgacaugaacgacugcuucgucacccggcacgccaagaucugcaucaucggcacggugucuaaguucucccaaggcgacacccuccucuuccuggggcccauggagggcgggggcaucaucuuccgucacuggugcaccagcacgugccacuucggggaccccggcgacgugaugggccccaaggacaagccauucaucugccccgaguuccccgggcaguuccggaagaagugcaacuucgccaccacccccgucugcgaguacgauggcaacaucauauccggguacaagaaggugcuggccaccauagacagcuuccaguccuucaacaccagcaacauccacuucacggacgagcgcaucgaguggcgggacccggacggcaugcuccgcgaccacaucaacaucgugaucuccaaagacaucgacuuugagaaccuggccgagaaccccugcaaggucgggcugcaggcggccaacaucgagggcgccuggggcagcggggugggcuuuacccugacgugccaagugucccugaccgagugccccacguuccugaccaguaucaaagccugcgacauggccaucugcuacggggcggaguccgucacccucagccggggccagaacaccgugaagaucacggggaagggcggccacuccgggagcuccuucaagugcugccacggcaaggagugcagcuccaccggucugcaggccagcgcgccccaccuugacaaggugaacggcaucuccgagcucgagaacgagaaggucuacgacgacggcgccccggaaugcggggugaccugcugguucaagaaguccggcgaaugggugauggggaucaucaacggcaacugggucgugcugaucgugcugugcguccuccuucuguucagccucauccugcugagcauccucugcccugugcgcaagcacaagaaguccuga

SEQ ID NO: 15138 - RNA, 3402 nt, Artificial Sequence
  derived and/or modified CDS sequence (opt11) from SEOV(HuludaoRn101)__GU592923.1__GP
auguggagccugcuccugcuggccgcccucgugggccagggguucgcccugaagaacgucuucgacaugcgcauccagugcccccacuccgugaacuuuggcgagaccagcgugucaggguacacugagcugccgccccucagccugcaggaggccgagcagcugguccccgaguccagcugcaacauggacaaccaccagucccucuccacgaucaacaagcugaccaaggugguauggcggaagaaggccaaccaggaguccgccaaccagaacagcuucgaggucguggaguccgaggugagcuucaagggccugugcaugcucaagcaccgcauggucgaggagucuuaccggaaccgccggagcgugaucugcuacgaccuggccugcaacuccaccuucugcaagcccaccguguacaugaucgucccgauccacgcgugcaacaugaugaaguccugccugaucgggcucggccccuaccgcauccaggugguguacgagcggacguacugcaccaccggcauccugaccgaggggaagugcuucguccccgacaaggccguggugagcgcccugaaacgcggcauguacgccaucgcgagcaucgagacgaucugcuucuucauccaccagaaggggaacaccuacaagaucgucaccgccaucaccuccgccaugggcagcaagugcaacaacacggacacuaaggugcagggguacuacaucugcaucaucggcggcaacagcgcccccguguacgcuccggcgggggaggacuuccgggccauggaggucuucuccggcaucaucaccagcccccacggggaggaccacgaccuccccggcgaggagaucgccaccuaccagaucuccggccagaucgaggccaagaucccccacacggugagcuccaagaaccugaagcugaucgccuucgcggggaucccgagcuacuccagcaccuccauucucgccgccagcgaggacucccguuucauauucagccccggccuguuccccaaccugaaccaguccgugugcgauaacaacgcccucccccugaucuggcggggacugaucgaccucaccggcuacuacgagacuguccacccgugcaacguguucugcguccugagcgggcccggcgccuccugcgaggcguucagcgagggcgggaucuucaacaucacgucccccaugugucuggugagcaagcaaaaccgcuuccgggccgccgagcagcagaucucuuucaucugccagcgcguggacauggacaucaucgucuacugcaacggacagaagaagaccaucuugaccaagacccugguuaucgggcagugcauuuacacgaucaccagccuguucagucucuugcccgguguggcccacuccaucgccaucgagcugugcgucccgggguuccacggcugggcgaccgccgcccugcugaucaccuucugcuucggcugggugcugauccccgccugcacgcucgcgauccugcuggugcucaaguucuucgccaacauccugcacaccagcaaccaagagaaccgguucaaggccauccugcgcaagaucaaggaggaguucgagaagaccaagggguccauggucugcgagaucugcaaguacgagugcgagaccuuaaaagaguuaaaggcccacaaccuuagcugcgugcagggcgaaugccccuacugcuucacucacugcgagcccaccgagaccgccauccaggcgcacuacaaggugugccaggccacccaccgguuccgcgaggaccucaagaagacgguaaccccgcagaacaucgggccaggcugcuaccggacccuaaaccuuuuccgcuacaagucccggugcuacauucugaccauguggacccuacugcugaucaucgagagcauccucugggcagcuuccgccgcggagaucccccuggugccccuguggacggacaacgcacacggugugggcagcaucccgaugcacaccgaccucgagcuggacuucucccugcccagcucaagcaaguacaccuacaagcgccaccucacgaaccccgucaacgaucagcaaucugugucgcugcacaucgagaucgagucccagggcaucggggccgacgugcaccaccugggccacugguacgacgcccgccucaaccugaagacgagcuuccacugcuacggggccugcaccaaguaucaguacccguggcacaccgcaaaaugccacuucgagaaggacuacgaguacgagaacuccugggccugcaacccgcccgacugccccggcgucgguaccgggugcacggcuuguggccuguaccucgaccagcugaagcccguggggaccgccuucaagaucaucagcgugagguacagccgcaaggucugcgugcaguucggcgaggaguaccuaugcaagaccaucgacaugaacgacugcuucgugacccggcacgcgaagaucugcaucaucgggacggucuccaaguucagccagggcgacacccuccuguuccugggccccauggagggcggcgggaucaucuucaagcacuggugcaccuccacuugucacuucggggaccccggggacgugaugggccccaaggacaagccguucaucugccccgaguuccccggccaguuccgcaagaagugcaacuucgccaccacccccaucugcgaguacgacgggaauaucaucagcggcuacaagaaggugcucgccaccaucgacuccuuccagagcuucaacaccuccaacauccacuucacggacgagcggaucgaguggcgcgacccggacgggaugcugcgggaccacaucaacgucgugaucagcaaggacaucgacuucgagaaccuggccgagaaccccugcaagguuggccuccaggccgcgaacaucgagggggccuggggcuccggcgucggguuuacucugaccugucaggugagccugaccgagugccccacguuccucaccuccaucaaggcuugcgacauggccaucugcuacggcgccgagucggugacccugucccgcggccagaacaccguccggaucacgggcaagggcgggcacagcggcuccagcuucaaaugcugccacgggaaggagugcuccagcaccggccugcaggcguccgcgccccaccucgacaaggugaacgggaucagcgagcuggagaacgagaagguguacgacgacggcgccccggagugcggcgugaccugcugguucaagaaguccggggagugggucaugggcaucaucaaugggaacugggugguccugaucgugcucugcgugcugcuccuguucagccugauccugcucagcauccugugccccguccgcaagcacaagaaguccuga

SEQ ID NO: 15139 - RNA, 3402 nt, Artificial Sequence
  derived and/or modified CDS sequence (opt11) from SEOV(Humber)__JX879768.1__GP
auguggagccugcuccugcuggccgcccucgugggccagggguucgcgcugaagaacgucuucgacaugcgcauccaguguccccacuccgugaacuuuggcgagaccagcguguccggguacaccgagcugccgccccucagccugcaggaagccgagcagcugguccccgaguccagcugcaacauggacaaccaccagucccucagcacgaucaacaagcugaccaaggugaucuggcguaagaaggccaaccaggaguccgccaaccagaacagcuucgagguggucgaguccgaggugagcuuuaagggccugugcaugcucaagcaccgcaugguggaggaguccuaccggaaccgccggagcgucaucugcuacgacuuagccugcaacuccaccuucugcaagcccaccguguacaugaucgugccgauccacgcgugcaacaugaugaaguccugccugaucgggcucggccccuaccgcauccaggucguguacgagcggacauacugcaccaccggcauccugacagaggggaaguguuucgugcccgacaaggccgucguguccgcccugaagcgcggcauguacgccauugcgagcaucgagacgaucugcuucuucgugcaccagaaagggaacaccuacaagaucgucacagccaucaccuccgccaugggcagcaagugcaacaacacggacaccaaggugcagggguacuacaucugcaucaucggcggcaacagcgcccccguguacuccccggccggggaggacuuccgggcgauggaggucuucagcggcaucaucaccagcccccacggggaggaccacgaccuccccggcgaggagaucgccaccuaccagaucagcggccagaucgaggccaagauaccccacacgguguccagcaagaaccugaagcugaccgccuucgccgggaucccguccuacagcuccaccagcauccuagcggccuccgaggacggccgcuucaucuucagccccgggcuguuccccaaucugaaccaguccgugugcgacaacaacgcccuaccccugaucuggcggggccugaucgaccucaccggguacuacgaggccguccacccgugcaacguguucugcguccugagcggccccggcgccuccugcgaggcuuucagcgagggcgggaucuucaacaucacgucccccaugugccuggugagcaagcagaaccgcuuccgggccgcagagcagcagaucuccuuuaucugucagcgcguggacauggacaucaucgucuacugcaacgggcagaagaagaccauccucaccaagacccuggugaucggccagugcaucuacacgaucaccagccuguuuucacuccugcccgggguagcccacucgaucgccaucgagcugugcgucccgggcuuccacggcugggcgaccgccgcccuccugaucaccuucugcuucgggugggugcugauccccgccugcacgcucgccgugcugcugguccucaaguucuucgccaacauccugcacaccagcaaccaggagaaccgguucaaggccauucugcgcaagaucaaggaggaguucgagaagaccaagggcuccauggugugcgagaucugcaaguacgagugcgagacucucaaggagcugaaggcccacaaccugagcugcauccaaggggagugccccuacugcuucacgcacugcgagcccaccgagaccgccauccaggcgcacuacaaggugugccaggccacccaccgguuccgcgaggaccucaagaagacggucacgccgcccaacauuggccccgggugcuaccggacccugaaccuguuccgcuacaagucccggugcuacauccugaccauguggacccuccugcugauaaucgagagcauccucugggccgccuccgccgcggagaucccccuggugccgcuguggacggacaacgcccacggcgugggcagcguccccaugcacaccgaccucgagcuggacuucucccugcccagcuccagcaaauacaccuacaagcgccaccucaccaauccggugaacgaccagcaguccgugagccugcacaucgagaucgaaucccaggggaucggcgccgacguccaccaccuggggcacugguacgacgcccgccucaaccugaagacgagcuuccacugcuacggcgccugcaccaaguaccaguaccccuggcacaccgcgaagugccacuucgagaaggauuacgaguacgagaacucgugggccugcaacccgcccgacugccccggcgugggaaccggcugcacggccugugggcuguaccucgaccagcugaagcccgugggcaccgccuucaagaucaucagcguccgguacagccgaaaggugugcguucaguucggggaggaguaccugugcaagacaaucgacaugaacgacugcuucgucacccggcacgcgaagaucugcaucaucggcacgguguccaaauucagccagggcgacacccuccuauuccuugggcccauggagggcgggggcaucaucuucaagcacuggugcaccuccacgugccacuucggggaccccggcgacgugaugggcccgaaggacaaacccuucaucugccccgaguuccccgggcaguuccgcaagaagugcaacuucgccaccaccccggucugcgaguacgacggcaacaucaucagcggguacaagaaggugcucgccaccaucgacuccuuccagagcuucaacaccuccaacauccacuucacggacgagcggaucgaguggagagaccccgacggcaugcugcgggaccacaucaacaucaucaucagcaaggacaucgacuucgaaaaccuggccgagaaccccugcaaggucgggcuccaggccgcgaacaucgagggcgccuggggcucaggggucggcuucacccugaccugccaggugagccugacagaaugccccacguuccucaccuccaucaaggccugcgacauggccauaugcuacggggccgagagcgugacccugucccgcggccagaacaccgucaagaucacggggaagggcggccacagcggguccagcuuuaagugcugccacggcaaggagugcucgagcaacgggcugcaggcguccgccccgcaccucgacaaggugaacggcaucagcgagcuggagaacgagaagguguacgacgacggcgcccccgagugcggugugaccugcugguucaagaaguccggcgagugggucauggggaucaucaacggcaacugggugguccugaucgugcucugcgugcugcuccuguucagccugauccugcucagcauccugugccccguccggaagcacaagaagaguuga

SEQ ID NO: 15140 - RNA, 3402 nt, Artificial Sequence; identical to SEQ ID NO: 11854
  derived and/or modified CDS sequence (opt11) from SEOV(Humber)__KM948597.1__GP

SEQ ID NO: 15141 - RNA, 3402 nt, Artificial Sequence
  derived and/or modified CDS sequence (opt11) from SEOV(K24-e7)__AF288652.1__GP
auguggucacugcuucuccuggccgcccucgugggccagggguucgcccuuaagaacgucuucgacaugagaauccaaugcccucacagcgugaacuucggcgagaccagcguuuccggguacacugagcuaccgccccucucgcugcaagaggccgagcaguuaguccccgaguccagcugcaauauggacaaucaccagucgcucagcacgauuaacaaguuaaccaaggugguguggcggaaaaaggcaaaccaggaauccgccaaccaaaacagcuucgaagucguagaguccgaggugagcuucaagggccugugcaugcucaaacaccgcauggucgaggagaguuaccggaaccgccggagcguaaucugcuacgaccuggccuguaacuccaccuucugcaagccuaccguguacaugaucgucccgauccacgcgugcaacaugaugaaguccugucugaucggucucggccccuaccgcauccaggugguguacgagcggacguacugcaccaccggcauccuuaccgaagggaaguguuuuguaccgggcaaggccguggugagcgcccugaagcgugggauguacgccaucgcgagcaucgaaacgauauguuucuucauccaccagaagggcaacaccuauaagaucgucaccgccauuaccagcgccauggggucaaagugcaacaacacggacacaaaggugcagggcuacuacaucugcaucauaggcgggaacagcgcgcccguguacgccccggcgggcgaggacuuccgggccauggaggucuucuccgggaucaucaccaguccccacggcgaggaccacgaccugcccggcgaggaaauagccaccuaccagaucuccggucaaauagaggcaaagaucccucacacggugagcuccaagaaccugaaacuuaucgccuucgcaggcaucccgaguuacuccagcaccuccauccucgcugccagcgaggacgggcgcuucaucuucucccccggauuauucccgaacuugaaccagagcguaugcgacaacaacgcccugccccugaucuggcgggggcugaucgaccuaaccggcuacuacgaggccguccaucccugcaaugucuuccgcguccuguccggccccggggcgagcugcgaggccuucuccgagggcgggaucuucaacaucaccagccccaugugccugguguccaagcagaaccgguuccgcgccgccgagcagcagaucucauucaucugccagcggguagacauggauauuaucgucuacugcaacggccagaagaagacgauacucaccaagacucuggugauagggcagugcaucuacaccaucacgucccuguucagccuccuacccggcguugcgcauaguaucgcgaucgaguugugcgucccggguuuucacgggugggccaccgccgcccucuugauuaccuucugcuucggcugggugcugauucccgcgugcacgcucgccauccugcuggugcucaaguucuucgcgaauauccugcacacuucaaaccaggagaaccgcuuuaaggcaauccugcggaagauaaaggaggaguucgaaaagaccaaggggaguauggucugcgagaucugcaaguacgaaugcgagacccucaaggagcugaaggcccacaaucuguccugcgugcagggagagugucccuacugcuuuacccacugcgagccgacggagaccgcaauccaggcucacuacaaggugugucaagccacccaccgcuuccgggaggaccucaagaagaccgucacgccgcagaacaucgggcccggcugcuaccgcacccugaaccuguuccgguacaagagccgcuguuacaucuuaaccauguggaccuuacugcugaucaucgaguccauccucugggccgcaagcgcugccgaaaucccucuggugccccuguggaccgacaaugcccacggcgugggauccgucccaaugcacacggaccucgagcuggacuucagccugccauccuccucaaaguacaccuacaagcgccaccucaccaacccagugaacgaccagcagagcgugucccugcacaucgaaaucgagagccagggcaucggggccgacguacaccaucugggccacugguacgacgcccggcucaaccugaagaccuccuuccacuguuacggcgcgugcaccaaauaccaguacccguggcacacugcuaagugccauuucgagaaggauuaugaauacgagaacaguugggccugcaacccgcccgacugcccaggggugggcaccgggugcaccgccuguggccuguaccucgaccagcuaaagcccguggggacggcguucaagaucaucuccguccgcuacagccggaaggucuguaugcaguucggggaggaguaccugugcaagaccaucgacaugaaugauugcuucgugacccgccacgccaagaucugcaucaucggcaccguuagcaaguucucccagggagacacacuauuauuuuuaggacccauggagggcggcggcaucaucuuuaagcacuggugcaccagcacgugccacuucggugaccccggcgacgugaugggucccaaggacaagccguucaucugucccgaguuccccggccaguuccgaaagaagugcaacuucgccaccacccccaucugcgaguacgacgggaacaucauauccggguacaagaagguucucgccacaaucgacagcuuccaguccuucaacaccagcaacauccacuucaccgacgagcgcaucgaguggcgggauccggacgguaugcugcgcgaccacauuaacauagucauauccaaagacaucgacuucgagaaccuggccgagaaccccugcaaggugggccuccaggcggcaaacaucgagggcgccugggggucuggcgugggguucacacugaccugccaggucucccugaccgagugccccaccuuccuaacgucaaucaaggccugcgacauggccaucugcuacggagcggagagugugacccugagcagagggcagaacaccgugcgcaucaccgggcgaggcggacacuccggaagcuccuucaaaugcugccacgguaaggagugcagcuccacgggccugcaggccagcgcgccccacuuggacaaagucaauggcauauccgagcuggagaacgagaagguauacgacgacggagccccugaguguggcgugaccugcugguucaagaaguccggggagugggucaugggcauaaucaacgggaacuggguggugcugaucguccucugcguguuacuccuguucagccugaucuugcucagcauccugugccccgugcgcaagcacaagaaguccuga

SEQ ID NO: 15142 - RNA, 3402 nt, Artificial Sequence
  derived and/or modified CDS sequence (opt11) from SEOV(K24-v2)__AF288654.1__GP
auguggagccugcuccugcuggccgcccucgugggccagggguucgcgcugaagaacgucuucgacaugcgcauccagugcccccacagugugaacuucggcgagaccagcguguccggguacaccgagcugccgccccucagccugcaggaggccgagcagcugguccccgaguccagcugcaacauggacaaccaccagucccucagcacgaucaacaagcugaccaaggugguguggcggaagaaggccaaccaggaguccgccaaucagaacagcuucgaggucguggagucugaggugagcuucaagggccugugcaugcucaagcaccgcauggucgaggaguccuaccggaaccgccggagcgugaucugcuacgaccuggcaugcaacuccaccuucugcaagcccaccguguacaugaucgucccaauccacgcgugcaacaugaugaaguccugccugaucgggcucggccccuaccgaauccaggugguguacgagcggacguacugcaccaccggcauccugaccgaggggaaguguuucguccccgacacggcgguggugagcgcccugaagcgcggcauguacgccaucgcgagcaucgagaccaucugcuuuuucauccaccagaaggggaacacguacaagaucgucaccgccaucaccuccgccaugggcagcaagugcaacaacacugacaccaaggugcaaggguauuacaucugcaucaucggcggcaacagcgcccccguguacgccccggcgggggaggacuuccgggccauggaggucuucuccggcaucaucaccagcccccacggggacgaccacgaccuuccgggcgaggagaucgcccccuaccagaucuccggccagaucgaggccaaaaucccgcacacggugagcucgaagaaccugaagcugaucgccuucgcggggauccccagcuacuccucgaccuccauccucgccgccagcgaggacggccgcuucaucuucucccccgggcuguuccccaaccugaaccagagcgugugcgacaacaacgcccucccgcugaucuggcgcggccugaucgaccucaccggguacuacgaggccguccaccccugcaacguguucugcguccuguccggccccggggcgagcugcgaggccuucuccgagggcgggaucuucaacaucaccagccccaugugccugguguccaagcagaaccgcuuccgggccgccgagcagcagaucagcuucaucugucagcgcguggauauggacaucaucgucuacugcaacgaccagaagaagacgauccucaccaagacccuagugaucgggcagugcaucuacaccaucacgucccuguucagccuccugccgggaguggcccacucaaucgcgaucgagcugugcguccccggguuccauggcugggccaccgccgcccuccugaucaccuucugcuucggcugggugcugauccccgcgugcacccucgccauccugcuggugcucaaguucuucgccaacauccugcacacguccaaccaggagaaccgauucaaagccauccugcgcaagaucaaggaggaguuugagaagaccaaggggagcauggucugcgagaucugcaaguacgagugcgagacccucaaggagcugaaggcccacaaccuguccugcgugcagggcgagugccccuacuguuucacccacugcgagccgacggagaccgcgauccaggcccacuacaaggugugccaggccacccaccgguuccgcgaggaccucaagaagaccgucacgccccagaacaucgggcccggcugcuaccggacacugaacuuguuccgcuacaagagccggugcuacauccugaccauguggacccuccugcugaucaucgaguccauccucugggccgccagcgcggccgagaucccacuggugccgcuguggaccgacaacgcccacggggugggcuccguccccaugcacacggaccucgagcuggacuucagccugcccuccagcuccaaguacaccuacaagcgccaccucaccaacccggugaacgaccagcagagcgugucccugcacaucgagaucgagagccagggcaucggugcggacguccaccaccugggccacugguacggggccaggcucaaccugaagaccuccuuccacugcuacggcgcgugcacgaaguaccaauaccccuggcacaccgccaagugccacuucgaaaaggacuacgaguacgagaacagcugggccugcaacccgcccgacugccccggcguggggaccggcugcacggccugcgggcuguaccucgaccagcugaagccagugggcacggcguucaagaucaucuccguccgguacagccgcaaagugugcaugcaguucggcgaggaauaccugugcaagaccaucgacaugaacgacugcuucgugacccgucacgccaagauaugcaucauaggcacagucagcaaguucucccagggcgacacgcuccuuuuccuggggcccauggagggcgggggcaucauuuucaagcacuggugcaccagcacgugccacuucggggaccccggcgacgugaugggcccgaaggacaagcccuucaucugucccgaguucccggggcaguuccgcaagaagugcaacuucgcaaccaccccgaucugcgaguacgacggcaauaucaucuccggguacaagaaggugcucgccaccaucgacagcuuccaguccuucaacaccagcaacauccacuucaccgacgagcggaucgaguggcgcgaccccgacggcaugcugcgggaccacaucaacaucgucaucuccaaggacaucgacuucgagaaccuggccgagaaccccugcaagguggggcuccaggcggccaacaucgagggcgccuggggcagcggggugggcuucacgcugaccugccaggucucccugaccgagugccccaccuuccucacgagcaucaaggccugcgacauggccaucugcuacggggcggaguccgugacccugagccgcggccagaacaccgugcggaucaccgggaagggcggccacuccgggagcagcuucaagugcugccacggcaaggagugcagcuccacggggcugcaggccagcgccccacaccucgacaaggucaacggcaucuccgagcuggagaacgagaagguguacgacgacggcgcccccgaguguggggugaccugcugguucaagaaguccggcgagugggucauggggaucaucaacggcaacuggguggugcugaucguccucugcgugcugcuccuguucagccugauccugcucagcauccugugccccgugcgcaagcacaagaagucguga

SEQ ID NO: 15143 - RNA, 3402 nt, Artificial Sequence
  derived and/or modified CDS sequence (opt11) from SEOV(KI-83-262)__D17592.1__GP
auguggagccugcuccugcuggccgcccucgugggacagggguucgcccugaagaacgucuucgacaugcgcauccagugcccccacuccgugaacuucggcgagaccagcguguccggguacacggagcugccgccccucagccugcaggaagccgagcagcugguccccgaguccagcugcaacauggacaaccaccagucccucagcaccaucaacaagcugaccaaggugaucuggcggaagaaggccaaccaggaguccgcgaaccagaacagcuucgagguggucgaguccgaggugagcuucaagggccugugcaugcucaagcaccgaaugguggaggaguccuaccggaaccgccggagcgucaucugcuacgaccuggccugcaacuccaccuucugcaagcccaccguguacaugaucgugccgauccacgcgugcaacaugaugaaguccugccugaucgggcuaggccccuaccgcauccaggucguguacgagcggacguacugcaccaccggcauccugaccgaggggaagugcuuugugcccgacaaggccgucgugagcgcccugaagcgcggcauguaugccaucgcgagcaucgagacgaucugcuucuucauccaccagaaggggaacaccuacaagaucgugaccgccaucaccuccgccaugggcucuaagugcaacaacacggacaccaagguccagggguacuacaucugcaucaucggcggcaacagcgcccccguguacgccccggcgggggaggacuuccgggccauggagguauucuccggaaucaucaccagcccccacggggaggaccaugaccuccccggcgaggagaucgccaccuaccagaucuccggccagaucgaggccaagaucccccacacggucagcuccaagaaccugaagcugaccgccuucgcagggauaccgagcuacucaagcaccuccauccucgccgccagcgaggacggccgcuuuaucuucucccccgggcuguuccccaaccugaaccagagcgugugcgacaacaacgcccucccccugaucuggcggggccugauugaccucaccggcuacuacgaggccguccacccgugcaacgucuucugcgugcuguccggccccggcgcgagcugcgaggccuucuccgagggcgggaucuucaacaucacgagccccaugugccuggucuccaagcagaaucgcuuccgggccgccgagcagcagaucagcuucgucugccagcgcguggacauggacaucaucguguacugcaacgggcagaagaagaccauccucaccaagacccuggugaucggccaaugcaucuacacgaucaccucgcuguucagccuccugcccgggguggcccacagcaucgcgaucgagcugugcgucccgggcuuucacggcugggccaccgccgccuugcugaucaccuucugcuucgggugggugcugaucccagcgugcacgcucgccauccugcuggugcugaaguucuucgccaacauccugcacaccuccaaccaggagaaccgguucaaggccauccugcgcaagaucaaggaggaguucgagaagaccaagggcucgauggucugcgagaucugcaaauacgagugcgagacccucaaggagcugaaggcccacaaccugucgugcgugcagggggagugccccuacugcuucacgcacugcgagcccaccgagaccgcgauccaggcccacuacaaggugugccaggccacccaucgguuccgcgaggaccucaagaagacagucaccccgcagaacaucggccccgggugcuacaggacccugagccuguuccgcuacaagucccggugcuacauacugaccauguggacccuccugcugaucaucgaguccauccucugggccgccuccgcggccgagaucccccuggugccccuguggaccgacaacgcccacggcgugggcagcgucccgaugcacacagaccucgagcuggacuucucccugcccagcuccucgaaguacaccuacaagcgccaccucaccaaccccgugaaugaccagcaguccgugagccugcacaucgagauagagucccaggggaucggcgccgacguccaccaccugggacacugguacgacgcccgccucaaccugaaaacgagcuuccacugcuacggcgcgugcaccaaguaccaguacccguggcacaccgccaagugccacuucgagaaggacuacgaguacgagaacuccugggccugcaacccgcccgacugccccggaguggggaccggcugcacggccugcgggcuguaccucgaccagcugaagcccgugggcaccgcguucaagaucaucagcguccgguacagccggaaagugugcgugcaguucggggaggaguaccugugcaagaccauagacaugaacgacugcuucguuacccggcacgccaagaucuguaucaucggcacggugucgaaguucagccagggcgacacccugcuguuccuggggcccauggagggugggggcaucaucuucaagcacuggugcaccuccacgugccacuucggugaccccggcgacgugauggggcccaaggacaaaccguucaucugccccgaguuccccgggcaguuccgcaagaagugcaacuucgccaccacccccgucugcgaauacgacggcaacaucaucagcggguacaagaaggugcucgccaccaucgacuccuuccagagcuucaacaccuccaacauccacuucacggacgagcggaucgaguggcgcgacccggauggcaugcuucgggaccacaucaacaucgugaucagcaaggacaucgacuucgagaaccuggccgagaaccccugcaaggucgggcuccaggccgccaauaucgagggcgcguggggcuccggggugggcuucacgcugaccugccaggugagccugaccgagugccccacguuccucaccuccaucaaggccugcgacauggccaucugcuacggcgcggagagcgucacccugucccgcggccagaacaccgugaagaucacggggaagggcggccacagcggguccagcuucaagugcugccacggcaaggagugcuccagcaccgggcugcaggccuccgcgccccaccucgacaagguaaacggcaucagcgagcuggaaaacgagaaggucuacgacgacggcgccccggagugcgggaucacgugcugguucaagaaguccggcgaguggguuauggggaucaucaacggcaacugggugguccugaucgugcucugcgugcugcuacuguucagccugauccugcucagcauccugugccccguccggaagcacaagaaguccuga

SEQ ID NO: 15144 - RNA, 3402 nt, Artificial Sequence
  derived and/or modified CDS sequence (opt11) from SEOV(KI-85-1)__D17593.1__GP
auguggagccugcuccugcuggccgcucucgugggccagggguucgcacugaagaacgucuucgacaugcgcauccagugcccccacagcgugaacuucggcgaaaccagcguguccggguacacugagcugccgccccucagccugcaggaggccgagcagcuggugcccgaguccagcugcaacauggacaaccaccagucccucagcaccaucaacaagcugaccaaggugaucuggcggaagaaagcaaaccaggaguccgccaaccagaacagcuucgagguggucgaguccgaggugagcuuuaagggccugugcaugcucaagcaccgaaugguagaggaauccuaccggaaucgccggucagucaucugcuacgaccuggccugcaacuccaccuucuguaagcccaccguguacaugaucgucccgauccacgcgugcaacaugaugaaauccugccugaucgggcucggccccuaucgcauccaggucguguacgaacggacguacugcaccaccggcauccugaccgagggcaagugcuucgugccugacaaggcagucgugagcgcccugaagcgcggcauguacgccaucgcgagcaucgagacgauaugcuucuucauccaccagaaggggaacaccuacaaaaucguuaccgccaucaccagugccauggggagcaagugcaacaacacugacaccaagguccagggguacuacaucugcaucaucggcggcaacagcgcccccguguacgccccggcgggggaggacuuccgggccauggagguguucuccggcaucaucaccagcccucacggugaggaccacgaccuccccggcgaggagaucgccaccuaccagaucaguggacagaucgaggccaagaucccccacacggucagcaguaagaaccugaagcugaccgccuucgccgggaucccgagcuacuccagcaccuccauccucgccgccagcgaggauggcagguuuaucuucucccccggucuguuccccaaucugaaccagagcgugugcgacaacaacgcccucccccugaucuggcggggccugaucgaccucaccggauacuacgaggcagugcacccgugcaacgucuucugcgugcuguccggccccggcgcgagcugcgaggccuucuccgagggcgggaucuucaacaucacgagccccaugugccuggucuccaagcaaaaccguuuccgggccgccgagcagcagaucuccuucgugugccagcgcguugacauggacaucauugucuacugcaacgggcagaagaagaccauccucaccaagacccuggugaucggccagugcaucuacacgaucaccucccuuuucagccuccugcccgggguggcccacucuaucgcgauagagcugugcguuccgggcuuccacggcugggccaccgccgcccucuugaucaccuuuugcuucggaugggugcuaauccccgcgugcacgcucgccauccugcugguacucaaguucuucgccaacauccugcacaccuccaaccaggagaaccgguucaaggccauccugcgcaagaucaaggaggaguucgagaagaccaagggcagcauggucugcgagaucugcaaguacgagugcgagacccucaaggagcugaaggcccacaaccuguccugcgugcagggggagugccccuacugcuucacgcacugcgagcccaccgagaccgcgauccaggcccacuacaagguaugccaggccacccacagauuccgcgaggaccucaagaagacggucaccccgcagaacauaggcccggggugcuaccggacccugaacuuauuccgcuacaagagccgguguuacauucugaccauguggacccuccuguugaucaucgaauccauauuaugggccgccagcgcggccgagauaccccugguaccacuguggaccgacaacgcccacggcguuggcuccgucccgaugcauaccgaccuugagcuggacuucagccugcccuccagcuccaaguacaccuacaagcgccaccucaccaaccccguuaacgaccagcagagcgugucccugcacaucgaaaucgagucucaggggaucggggccgauguccaccaccuggggcacugguacgacgcccgccucaaccugaagacguccuuccacugcuauggcgcgugcgccaaguaccaguacccguggcacaccgccaagugccacuucgagaaggacuacgaguacgagaacagcugggccugcaacccgcccgacugccccggcgugggcaccggcugcaccgcgugugggcuguaccucgaccagcugaagcccgugggcacggccuucaaaaucaucuccguccgguacagccgcaaggugugcgugcaguucggggaggaguaccugugcaaaaccaucgacaugaacgacugcuucgucacacggcacgccaaaaucuguaucaucggcaccgugagcaaguucucucagggcgacacgcuccuguuccuggggcccauggagggcggggguaucaucuucaagcacuggugcaccagcacgugccacuucggggaccccggcgacgugaugggccccaaggacaagccguucaucugucccgaguuccccgggcaguuccgcaagaagugcaacuucgccaccacccccgucugcgaauacgacggcaacaucauuuccggguacaagaaggugcucgccaccaucgacagcuuccagucuuucaacaccagcaacauccacuucaccgacgagcggauugaguggcgcgauccggacggcaugcugcgcgaccacaucaacaucgugaucuccaaggacaucgacuucgagaaccuggcggagaaccccugcaaggucgggcuccaggcggccaacaucgagggcgccuggggcagcggugugggcuucacgcucaccugucaggugagucugacugagugccccaccuuccucacgucgaucaaagccugcgacauggcgaucugcuacggggcugaaucgguuacccugagccgcggccagaacaccgugaagaucaccgggaagggcggccacuccgggaguuccuuuaagugcugccacgggaaggagugcagcucaacggggcugcaggccagcgcgccccaccucgacaaggugaacggcaucucagagcucgagaacgagaaggucuacgacgacggcgccccggagugcgggauaacgugcugguucaagaaguccggcgagugggugauggggaucaucaacggcaacuggguuguccugaucgugcucugugugcuucucuuauucagcuucauccugcuaaguauucucugccccguccggaaacacaaaaagucuuga

SEQ ID NO: 15145 - RNA, 3402 nt, Artificial Sequence
  derived and/or modified CDS sequence (opt11) from SEOV(KI-88-15)__D17594.1__GP
auguggagccuucuccugcuggccgcccucgugggacaaggcuucgcccugaagaaugucuucgacaugcgcauucagugcccccauagcguaaacuucggagagaccuccguguccggguacaccgagcugccgccccucagccugcaggaggcggaacaacugguccccgaguccagcugcaacauggacaaccaccagucccucagcacuaucaauaagcucaccaaggugaucuggcggaagaaggccaaccaggaguccgccaaccagaacagcuucgagaucguggaguccgaggucagcuucaagggccuguguaugcucaagcaccgcaugguggaggaauccuaccggaaccgccggagcgucaucugcuacgaccucgccuguaacuccaccuucuguaagcccaccgucuacaugaucgugccgauccacgcgugcaacaugaugaaguccugccugaucgggcucggccccuaccgcauacagguggucuaugagcggacguacugcaccaccggcauccuuaccgaggggaaaugcuucgugccagacaaggccguggucagcgcccucaagcgcggcauguacgccaucgcgagcaucgagacgauaugcuucuucauccaucagaaggggaauaccuacaagaucgugaccgccaucaccuccgccaugggcagcaagugcaacaacacggacaccaaggugcagggguacuacaucugcaucauaggcggcaacagcgcgcccgucuacgccccugcgggcgaggacuuccgggccauggagguguucuccggcauaaucaccagcccccacggagaggaccacgaccuccccggcgaggagauagccaccuaccaaaucucaggccagaucgaggccaagaucccccauaccgugagcaguaagaaccugaagcugacggcguuugcggggaucccgagcuacuccagcaccagcaucuuggccgcaagcgaagauggccgcuucaucuucaguccuggacuguuccccaaccucaaccaaagcgucugugacaacaacgcccuaccccugaucuggcggggccugaucgaccucacuggguacuacgaggccgugcacccgugcaacguguucugcgucuuguccggccccggcgcgagcugugaggccuucuccgagggcggcaucuucaacauaacgagccccaugugccugguguccaagcagaaccgcuuccgggccgccgagcagcagaucagcuucgucugccagcgcguggauauggacaucaucguguauugcaacggacagaaaaagacaauccucacaaagacccugguaaucggccagugcauauauacgauuaccucccuguucagccucuuacccgggguggcacacucaaucgcaaucgagcugugcgugccgggcuuccacgguugggccaccgccgcccuccugaucaccuucugcuucggguggguccugauccccgcgugcacgcucgccauccuucuagugcucaaguucuucgccaacauccugcacacguccaaccaggagaaccgguucaaggccauccuucgcaagaucaaggaggaguucgaaaagaccaagggcagcauggugugcgagauuugcaaguacgagugcgagacccuaaaggagcugaaggcccacaaccuguccuguguccaaggugagugccccuacugcuuuacgcacugcgagcccaccgagacagcgauacaggcccauuacaaggugugccaggccacccaccgguuccgcgaggaccucaagaagacggugacgccccagaauaucggacccgggugcuaccggacccugaauuuguuccgcuacaagagccgguguuacauccugaccauguggacccuccugcugaucauagaguccauacucugggccgccagcgcggccgagauuccccuggucccuuuauggacggacaacgcccacggcguggguucaguucccaugcacacagaccucgagcuggacuucagccuucccuccagcuccaaguacaccuauaagcgccaccucacaaaccccgucaacgaccagcagucggugucccuacacaucgagaucgagagccaagggaucggcgccgacguccaccaccuggggcacugguacgacgcccgccucaaucuaaagacguccuuucacugcuauggcgcgugcaccaaguaccaguacccguggcacaccgccaagugccacuucgagaaggauuacgaguacgagaacucaugggcuugcaacccaccggacugccccggagucgggaccggcugcacggccugcggccuguaccucgaccagcugaagcccgucggcaccgcuuucaagauuaucagcgugcgguacagccgcaagguaugcgugcaguucggggaggaguaucugugcaagaccaucgacaugaacgacugcuucgugacccgacacgccaagaucugcaucaucggcacggucagcaaguucucccagggggacacccuccuguuccuggggcccauggagggcgggggaaucauuuucaagcacuggugcaccagcacaugccacuucggggaccccggugacgugauggguccaaaggacaagccguucaucugccccgaguuccccgggcaguuccgcaagaagugcaacuucgccaccaccccugugugcgaauacgacgggaacaucaucuccggguacaagaagguccucgccaccaucgauucuuuccaguccuucaacacgagcaacauccacuuuacggacgagcggaucgaguggcgcgacccggacggcaugcugcgggaccacaucaacauugugaucuccaaggauaucgacuucgagaaccuggcggagaaccccugcaaaguggggcuccaggcggccaacauagagggggccugggguagcggggucggcuucacccugaccugccagguuucccugaccgaaugcccaacguuccucaccagcauaaaggccugcgacauggccaucugcuacggggcggagucugugacucugagccgcggccagaauaccgugaagaucacggggaaaggcggccacucagggagcuccuucaagugcugucacggaaaggagugcagcuccaccggccugcaggccagcgcgccccaccucgacaagguuaacggcaucuccgagcugaagaacgagaagguguacgacgacggcgccccggagugugggauuacgugcugguuuaaaaaguccggcgagugggucauggggaucaucaacggcaacuggguggugcugaucguccucugcgugcugcuccuuuucuccuucauucugcugagcauccucugucccgugcggaagcauaagaagucuuga

SEQ ID NO: 15146 - RNA, 3402 nt, Artificial Sequence
  derived and/or modified CDS sequence (opt11) from SEOV(LongwanRn581)__GU592930.1__GP
auguggagccugcuccugcuggccgcccucgugggccagggguucgcgcugaagaacgucuucgacaugcgcauccagugcccccacuccguuaacuucggggagaccagcguguccggguacaccgagcugccgccccucagccugcaggaggccgagcagcugguccccgaguccagcugcaacauggacaaccaccagucccucagcacgaucaacaaacugaccaaggugaucuggcggaagaaggccaaccaggagagcgccaaccagaacagcuucgaggucgucgaguccgaggugagcuuuaagggccuuugcaugcucaagcaccgcaugguggaggaguccuaccggaaccgccggucagucaucugcuacgaccuggccugcaacuccaccuucugcaagcccaccguguacaugaucgugccaauccacgcgugcaacaugaugaaguccugccugaucgggcuuggccccuaccgcauccaggucguguacgagcggacguacugcaccaccggaauccugaccgaggggaaaugcuucgugccagacaaggccgucgugagcgcccugaagcgcggcauguaugccaucgcgagcaucgagacgaucugcuucuucauccaccagaaggggaacaccuauaagauugugaccgccaucaccuccgccaugggcagcaagugcaacaacacggacaccaagguccagggguacuacaucugcaucaucgggggcaacagcgcccccguguacgcccccgcgggggaagacuuccgggccauggagguguucuccggcaucaucaccagcccgcacggggaggaccacgaccuccccggcgaggagaucgccaccuaucagaucuccggccagaucgaggccaagaucccccacacggucagcuccaagaaccugaagcugaccgccuucgcggggaucccgucuuacuccagcaccagcauccucgccgccagcgaggacggccgcuucaucuuuucccccgggcuguuccccaaccucaaccagagcgugugcgacaacaacgcccuccccuugaucuggcggggccugaucgaccucaccggguacuacgaggccgugcacccgugcaacgucuucugcgugcuguccggccccggcgcuagcugcgaggccuucuccgagggcgggaucuucaacaucacgagccccaugugccuggucuccaagcagaaccgcuuccgggccgccgagcaacagaucagcuucgugugccagcgcguggacauggacaucaucgucuauugcaacgggcagaagaagaccauccucacuaagacccuggugaucggccagugcaucuacacgaucaccucccuguucagccuccugcccgggguggcccacagcaucgcgaucgagcugugcgucccgggcuuccacggcugggccaccgccgcccuccugaucaccuucugcuucgggugggugcugauccccgcgugcacgcucgccauccugcuggugcucaaguucuucgccaacauacugcacaccuccaaccaggagaaccgguucaaggccauucugcgcaagaucaaggaggaguucgagaagaccaagggcagcauggucugcgagaucugcaaguacgagugcgagacccucaaggagcugaaagcccacaaucuguccugcgugcagggugagugucccuacugcuucacgcacugcgagcccaccgagaccgcgauccaggcccacuacaaggugugccaggccacccaccgguuccgcgaggaccucaagaagacggucaccccgcagaacauuggccccgggugcuaccggacccugaaccuguuccgcuacaaaagccggugcuacauccugaccauguggacccuacugcugaucaucgagagcauccucugggccgccagcgcggccgagauaccccuggugccgcucuggacggacaacgcccacggcgugggcucagucccgaugcacaccgaccucgaguuagacuucagccugcccuccagcuccaaguacaccuacaagcgccaccucacaaaccccgucaacgaccagcagagcgugucccugcacaucgagaucgaaagccaggggaucggcgccgacguccaccaccuggggcacugguacgacgcccgccucaaccugaaaacguccuuccacugcuacggcgcgugcaccaaguaucaguacccguggcacaccgccaagugccacuucgagaaggacuacgaguacgagaacagcugggccugcaacccgcccgacugccccggcguggggacuggcugcacggccugcgggcuguaccucgaccagcugaagcccgugggcaccgcguucaagaucaucucuguccgguacagccgcaaggugugcgugcaguucggggaggaguaccucugcaagaccaucgacaugaacgacugcuucgucacccggcaugccaagaucugcaucaucggcacggugagcaaguucucccagggcgacacccuccuguuccuggggcccauggagggcgggggcaucaucuucaagcauuggugcaccagcacaugccacuucggggaccccggcgacgugaugggccccaaggacaagccguucaucugccccgaguuccccgggcaguuccgcaagaagugcaacuucgccaccacccccgucugcgaguacgacggcaacaucaucuccgguuacaagaagguguuagccaccaucgacagcuuccaguccuucaacaccagcaacauccacuucacggacgagcggaucgaguggcgcgacccggacggcaugcugcgggaccacaucaacaucgugaucuccaaggacaucgacuucgagaaccuggcugagaaucccugcaaggucgggcuccaggcggcgaacaucgagggcgccuggggaagcggggugggcuucacccugaccugccaggugagucugaccgagugccccacguuccucaccagcaucaaggccugcgacauggccaucugcuacggggcggaguccgucacccugagccgcggccagaacaccgugaagaucacggggaagggcggccacuccgggagcuccuuuaagugcugccacggcaaggagugcagcucgaccgggcugcaggccaacgcgccccaccucgacaaggugaacggcaucagcgaacuggagaacgagaaggucuacgacgacggcgccccggagugcggggugaccugcugguucaagaagucaggcgaguggguuauggggaucaucaauggcaacugggucgugcugaucgugcucugcguccugcuccuguucagccugauccugcucagcauccugugccccgugcggaagcacaagaaguccuga

SEQ ID NO: 15147 - RNA, 3402 nt, Artificial Sequence
  derived and/or modified CDS sequence (opt11) from SEOV(RuianRn180)__GU592931.1__GP
auguggagccugcucaucguggccgcccuggucggccagggguucgcccugaagaacguguucgacaugcgcauccaaugcccacacagcgugaauuucggcgagaccagcgucuccggguacaccgaacugcccccgcucagccugcaggaggcagagcagcucgugcccgagucuagcugcaacauggacaaccaccagucccugucgacgaucaacaagcugaccaaggugauuuggcgaaagaaggccaaccaggaauccgccaaccaaaacagcuucgaggucguggaguccgagguuagcuucaagggccucugcaugcugaagcaccgcauggucgaggaguccuaccggaaucgccgauccgugaucugcuacgaccuggcaugcaacuccaccuucugcaagcccaccguguacaugauugucccgauccacgcgugcaacaugaugaaguccugccucaucgggcuggggcccuaccgcauccaggugguguacgagcggacguacugcaccaccggcaucuugaccgaggggaagugcuucgucccggacaaggccgucgugagcgcccucaagcgcggcauguacgcaaucgcgagcaucgagacgaucugcuucuucauccaccagaaggggaacaccuacaagaucgucaccgccaucacaucagccauggguuccaagugcaacaacacggacacaaaggugcagggauacuauaucugcaucaucggcggcaacagcgcccccguguacgccccggcgggggaggacuuccgggccauggaggucuucuccggcaucauaaccucgccccacggggaagaccacgaucugcccggcgaggagaucgccaccuaccaaaucuccggccagaucgaggccaagaucccccacacgguguccuccaagaaucugaagcucaccgccuucgcggggauuccgagcuacuccagcacguccauccuggccgccagcgaggacggccgcuucaucuucagccccgggcuguuucccaaccucaaccagagcgucugcgacaacaaugcccugccccugaucuggcguggccucaucgaccugaccgguuacuacgaggccguacacccgugcaacguguucugcguucuauccggccccggagcgagcugcgaggccuucucagagggugggaucuucaacaucacgagcccgaugugccucgucuccaagcagaaccgcuuccgggccgccgagcagcagaucagcuucaucugccagcgcguggacauggacaucauagucuacugcaacgggcagaagaagaccauccugaccaagacucugguaaucggccagugcaucuauacuauuacaucccucuucagccugcugcccggggucgcccacagcauagcgaucgagcucugcgucccgggcuuccauggcugggccaccgccgcccugcugaucaccuucuguuucggguggguccucauccccgcgugcacgcuggccaucuuacucgugcugaaguucuucgccaacauccugcacaccuccaaccaggagaacagauucaaggccauccuccgcaagaucaaggaggaguucgagaagaccaagggcagcauggucugcgagaucugcaaguacgagugcgagacccugaaggagcuaaaggcccauaaccucuccugcgugcagggcgagugccccuacugcuucacgcacugcgagcccacggagaccgcgauucaggcccacuauaaggugugccaggccacccaucgguuccgagaggaccugaagaagacggucaccccgcagaacaucggccccggcugcuaccggacccugaaccucuuccgcuacaagagccggugcuacauccugaccauguggacccuacugcucaucaucgaguccauacugugggccgccagcgcggcagagauaccccuggugccccucuggacggacaacgcccacggcgugggcucugucccgaugcacaccgaccuggagcuggacuucagccuccccaguagcuccaaguacaccuacaagcgccaccucaccaaccccgugaacgaccagcagagcgugucccugcacaucgagaucgagagccaggggauaggcgcagacguccaccaccucgggcacugguacgacgcccgccugaaccugaagacguccuuccacugcuacggcgcgugcaccaaguaccaguacccguggcacaccgccaagugucacuuugagaaggauuacgaguacgagaacagcugggccugcaauccgccugacugccccggcguggggaccggcugcacggccugcgggcucuaucuggaccagcugaagcccgugggcaccgcguucaagaucaucuccguccgguacagccgcaaggugugugugcaguuuggcgaggaguaccucugcaagaccaucgacaugaacgacuguuucgucacccggcacgccaagaucugcaucaucggcacugugagcaaguucucccagggcgacacccuccuguuccucgggcccauggagggugggggcaucaucuuuaagcauuggugcaccagcacgugccacuucggagaccccggcgacgugaugggccccaaggacaagccguucaucugccccgaguuccccgggcaguucagaaagaaaugcaauuucgccaccacacccgucugcgaguacgacggcaacaucaucuccggguacaagaagguguuagccaccaucgacagcuuucaguccuucaacaccagcaacauccacuucacggacgagcggaucgaguggcgcgacccggacggcaugcugcgggaccacaucaacaucgugaucuccaaggacaucgacuucgagaaccucgccgagaacccuuguaaggucgggcugcaggcggccaacaucgagggcgccuggggcagcggggugggcuucacccugaccugccaggucucccucacugagugccccacguuccugaccagcauaaaggccugcgacauggccaucugcuacggggcggagagcgucacccugagccgcggccagaauaccgugaagauuacagggaagggcggccacuccggcagcagcuucaagugcugccacgguaaggagugcucguccaccgggcuccaagccagcgcgccccaccucgacaaggugaacggcauuuccgaacuggagaacgagaagguguacgacgacggcgccccggagugcggggugaccugcugguucaagaaguccggcgagugggucauggggaucaucaacggcaacugggucgugcucaucgugcugugcguccugcuccuguucagucugauccuccugagcauccugugcccugugcggaagcauaaaaagagcuga

SEQ ID NO: 15148 - RNA, 3402 nt, Artificial Sequence
  derived and/or modified CDS sequence (opt11) from SEOV(ShuangyangRn470)__GU592925.1__GP
auguggagccuccucuuccuggccgcccugguaggacagggguucgcccucaagaacgucuucgacaugcgcauccagugcccccacagcgugaacuucggcgagaccagcguguccggguacaccgaguuaccgcccuugagccuccaggaguccgagcagcuuguccccgagagcuccugcaacauggacaaccaccagagccucaguacgaucaacaagcucacgaaggugauuuggcggaagaaggccaaccaggagagcgccaaucagaacuccuucgaggugguggagagcgagguguccuucaagggccugugcaugcuuaagcacaggaugguggaggagagcuaccggaaccgccgguccgucaucugcuaugaccucgccugcaacagcaccuucugcaagcccaccguguauaugaucgugccgauccacgcuugcaacaugaugaaguccugccugaucgggcugggccccuaccguauccaggucguguacgagcggacguacugcaccaccggcauuuugaccgaggggaagugcuucgugcccgacaaggcggucgugagcgcccugaagcgcggcauguacgccaucgccuccaucgagacgaucugcuucuucauccaccagaaggguaacaccuacaagaucgugaccgcgaucaccagcgccaugggcagcaagugcaacaacacugacaccaaaguccagggauacuacaucugcaucaucggcggcaauuccgcccccguguacgccccggccggggaggauuuccgagcgauggagguguucagcggcaucaucaccagcccccacggggaggaccacgaccugcccggugaggagaucgcaaccuaccaaaucagcggccagaucgaggccaagaucccccacacggucuccagcaaaaacuuaaagcugaccgccuucgccgggauuccuuccuacagcuccaccagcauccuggcggccuccgaggacggccgcuucaucuucagccccgggcuguuccccaaccucaaccaguccguguguaacaacaacgcucugccccuaaucuggcggggccugaucgaccucaccggguacuacgaggccgugcacccgugcaacgucuucugcgugcucagcggccccggcgccuccugugaggcauucagcgagggcgggaucuucaacaucacaucccccaugugccuggugagcaagcaaaaccguuuccgggccgcagagcagcagaucuccuucgugugccagcgcguggacauggacaucauagucuacugcaacgggcagaagaagaccaucuugaccaagacccucgugaucggccagugcaucuacacgaucaccucucuguucagccugcuccccgggguggcccacagcaucgccaucgagcucugcgucccgggcuuccacggcugggcgaccgccgcccugcucaucaccuucugcuucggguggguucugauccccgccugcacgcuagcaauccuacuggugcugaaguucuucgccaacauccugcacacaagcaaccaggagaaccgguucaaggccauccuccgcaagaucaaggaggaguuugaaaagaccaagggcuccauggucugugagaucugcaaguacgagugcgagacccuuaaggaguugaaggcccacaaccugagcugugugcagggggagugccccuacugcuucacgcacugcgagcccaccgagaccgccauccaggcgcacuacaagguuugccaggcaacccaccgguuccgcgaggaccugaagaaaacggucaccccgcagaauaucggccccgggugcuaccggacccucaaccuguuccgcuauaaaucccggugcuacauccugaccauguggacccugcuccugauagucgaaagcauccugugggccgccuccgccgcggagaucccccucgugccccuguggacggacaacgcccauggcgucggcucagugccgaugcacaccgaccuggagcuugacuucucccugccaagcuccaguaaguacaccuacaagcgccacuuaaccaaccccgugaacgaccagcaguccgucagccuccacaucgagaucgagucccaggggaucggcgccgacgugcaccaccuggggcacugguacgacgcgcgcuuaaaccucaagacgagcuuccacugcuacggcgccugcaccaaguaucaguacccguggcacacugcgaaaugccacuucgagaaggacuaugaguacgagaacagcugggccugcaacccgccagacugccccggcgugggcacaggcugcacggccugcgggcuguaccuggaccaacucaagcccguuggcacagccuucaagaucaucagcgugcgguacagccgcaaggugugcgugcaguucggggaggaguaccugugcaagaccaucgacaugaacgacugcuucgugacccggcacgccaagauaugcaucaucggcacaguguccaaauucagccagggcgacacccuccucuuccuggggccuauggagggcgggggcaucauuuucaagcacuggugcaccuccacgugccacuucggcgaccccggcgacgucaugggcccgaaagacaagccguucaucugccccgaguuccccgggcaguuccguaagaccugcaacuucgcuaccacccccgugugcgaguacgacggcaacaucaucagcggguacaagaaggugcuggccaccaucgacuccuuucagagcuucaacacguccaacauccacuucaccgacgagcggaucgaguggcgcgacccggacggcaugcuccgggaccacauaaacaucgucaucagcaaggacaucgacuucgagaaccuggccgagaaccccugcaaagugggccugcaggccgcgaacaucgagggcgccuggggcucuggggugggcuucacccuaaccugccaggucagccugacggagugccccaccuuccugaccagcaucaaggccugcgacauggccaucugcuacggggccgagagcgugacccucucccggggccagaacacggugaagaucaccgggaagggcggccacagcgguucgagcuucaagugcugccauggcaaggaauguuccagcaccggacugcaggcguccgcaccccaccucgauaaagucaacggcaucagcgagcucgaaaacgagaagguguacgacgacggcgccccggagugcgggguaaccugcugguucaagaaguccggcgagugggucauggggaucauaaacggcaacuggguggugcugaucguccugugugugcuccugcuguuuucccucauccugcugucuauccucugccccgugcggaagcacaagaaguccuga

SEQ ID NO: 15149 - RNA, 3402 nt, Artificial Sequence
  derived and/or modified CDS sequence (opt11) from SEOV(WuhanMm13)__JQ665886.1__GP
auguggucgcuucuucuuuuagccgcccucguaggacagggcuuugcacuuaaaaacguauucgacaugcgcauucagugcccgcauuccgucaacuucggcgaaaccucuguauccggcuacacugaguuaccuccccucagccuccaagaggcagagcaacucgucccagaguccaguuguaacauggauaaccaucaaucacuauccaccauaaacaaacuaaccaaagucauauggcgcaagaaagcaaaccaggaguccgccaaccaaaacagcuucgaagucaucgaaucagaagucagcuucaaagggcucuguaugcucaaacaccggauggucgaagaaucauaucgcaaccggcggagcguaaucuguuacgaccuagcauguaauucgaccuuuugcaaacccaccguauacaugaucguccccauccacgccugcaauaugaugaaaagcugccucauaggauuaggaccauaccgcauccaagucguuuacgagcgcacauacuguacuaccggaauacucacagagggcaaaugcuuuguccccgacaaagccguagugucggcucuaaagcggggcauguacgcaguagcauccauagaaacuauaugcuucuucauacaccaaaagggaaacaccuacaaaauaguaaccgcgaucaccuccgccaugggauccaagugcaacaacaccgacaccaaaguucagggcuacuacaucugcauaaucggcgggaacucagccccuguguacgccccugcgggagaggacuuuagggccauggaagucuucucgggcaucauaaccuccccacacggcgaggaccacgaccuaccaggcgaagaaaucgccaccuaccagauuucaggacaaaucgaagccaaaauaccacauacagucuccuccaaaaaccugaaacucacagccuucgccgggaucccaucauacuccagcacauccauccuagcugcuucagaagacgggcgauuuauuuucagcccagggcuguuccccaaccucaaccaauccgucugcgacaacaacgcccucccacucauauggcguggacugauagaccucacaggcuacuaugaggccguccacccaugcaacgucuucugcguccucucgggaccaggagcauccugcgaagcauuuuccgaaggcgggauuuucaacaucacaagucccaugugccucguaaguaagcaaaacagauuccgcgccgccgagcaacaaauaucauuugucugccaacgcgucgacauggauauuaucguuuacugcaacgggcaaaagaaaacaauacuuaccaaaacgcuagucaucggucaauguauuuacaccauuaccucccucuuuagccuccuaccaggcgucgcccacuccaucgccaucgagcugugcguacccggauuccacggaugggcgaccgccgcccucuuaacaaccuucugcuucggcuggguacuaauccccgcaugcacccucgcgauccuccuaguucucaaauucuucgccaacauccuucacaccuccaaccaggaaaaccgcuucaaagccauccuccggaagauaaaagaagaguucgagaaaaccaaaggguccaugguaugcgaaauuuguaaauacgaaugcgaaacacugaaggaacugaaagcacacaaucucagcugcguccaaggcgaaugccccuacugcuucacccacugcgaacccacagaaaccgcgauacaagcgcacuacaaaguaugucaagcgacucacagauuccgugaagaucuaaagaaaaccguaaccccacaaaacauaggcccaggaugcuaucgcacccuaaacuuauuccgcuacaaaucacgcugcuacauacuaacgauguggaccaucuugcucauuaucgaauccauccucugggccgcuucagcagccgaaauaccccuagucccccucuggaccgauaacgcacauggcgucggauccguccccaugcacaccgaccuugaacucgacuucagccucccaucauccuccaaauauacguacaaaaggcaccuaacuaaccccguaaacgaccaacaaagcguuucacuacacaucgaaauugaaucacaagggaucggcgcggacguucaucaccucgggcacugguacgaugcucgccuuaauuuaaagaccagcuuccacugcuacggcgccugcaccaaguaccaguaucccuggcacaccgccaaaugccacuucgagaaagacuacgaguacgagaacuccugggccuguaacccgcccgacugccccgggguaggcaccggcuguacagccuguggccucuaucucgaccaacuaaaaccagucggaaccgccuucaaaaucaucuccguccguuacucacgcaaaguaugcguacaauucggcgaggaauaccucugcaagacaauugacaugaacgacugcuucgucacgcggcacgcgaagauuugcaucauaggaacagucuccaaauucagccaaggugacacacuccuauuccuuggaccaauggaaggaggcgguauaaucuuuaaacacugguguacauccacuugccacuucggggacccaggggacgucauggguccuaaggacaagccauucauaugccccgaguuccccggccaauucagaaagaaaugcaacuucgccacaacacccguaugcgaauacgacgguaacauaaucucaggauacaagaaaguccucgccaccauugacucauuucagagcuucaacaccucaaauauccauuucacugacgaaagaaucgaauggagagacccagacggaaugcucagagaucacaucaacauuguaauauccaaagacaucgacuucgaaaacuuagccgaaaaccccugcaaagucggcuugcaagcugcaaauauagaaggcgcuuggggcuccggagucggauucacccucacaugccaagucucccucaccgaaugccccaccuuccucaccucgauaaaagcgugcgacauggcgaucugcuacggcgccgaaagcgucacccuaucccguggccagaacacagugaaaauaaccggcaaggguggccacuccggaucauccuucaaaugcugccacggcaaggaaugcucaagcacgggccuccaagccuccgcuccccaccucgacaaaguaaacggaauaucagaacuagaaaacgaaaaagucuacgacgacggagcccccgaaugcggaauuacaugcugguucaagaaaucgggugaaugggugaugggcaucaucaacggcaacugggugguacuuaucgcccucuguguacuccuccucuucucccucauccuacucucgauccucugccccguacgcaaacacaagaaaucauaa

SEQ ID NO: 15150 - RNA, 3402 nt, Artificial Sequence
  derived and/or modified CDS sequence (opt11) from SEOV(WuhanMm24)__JQ665887.1__GP
auguggagcuugcuccugcucgccgcccucgugggccagggguuugcuuuaaagaacgucuucgacaugcgcauccaguguccccacagcgucaauuucggcgagacuagcguuuccggguacaccgagcugccgccccuuagccugcaggaggccgagcagcugguccccgaguccucaugcaacauggacaaccaccaaucccucucaaccaucaacaagcucaccaaggugaucuggcgcaagaaggccaaccaggagucagccaaccagaacagcuucgagguuauggaauccgaggucucauucaagggccugugcaugcucaagcacagaaugguggaggaguccuaucggaaccgccggagcgugauuugcuacgaccuagccugcaacuccaccuucugcaagccgaccgucuacaugaucgugccgauccacgcgugcaacaugaugaaguccugccucaucgggcucggccccuaccgcauccagguggucuaugagaggacguacugcaccaccggcauccugaccgaaggcaagugcuucgugcccgacaaggccguggucagcgccuugaagcgcggcauguacgccaucgcgucaaucgagacaaucugcuucuucauccaccagaaggggaacacauacaagauagugaccgccaucaccuccgccaugggcagcaagugcaacaacacggacaccaaggugcagggguacuacauaugcaucaucggcggcaacagcgccccagucuacgccccggcuggggaggacuuccgggccauggagguauucuccggcaucaucaccagcccacacggggaggaccacgaccuccccggcgaggagaucgccacauaccagaucuccggccagaucgaagcuaagaucccgcacacggugagcuccaagaaucugaaauugaccgccuucgcggggaucccgagcuacuccagcaccuccaucuuagccgccagcgaggacggccgcuucaucuucucccccgggcuguuccccaaccugaaucagagcgucugcgacaacaacgcccuaccccugaucuggcggggccugaucgaccucaccggcuacuacgaggccgugcacccgugcaacguguucugcguccuguccggccccggggcguccugcgaggccuucuccgagggcgggaucuucaacaucacgagccccaugugccugguguccaagcagaacagguuccgggccgccgagcagcagaucagcuucgucugccagcgcguggacauggacaucaucguguacugcaacgggcagaagaagaccauccucaccaagacccuggucauugggcaaugcaucuacacuaucaccucccuguucagccuccugcccgggguggcccacagcaucgcuaucgaacugugcgugccgggauuccacggcugggccacagccgccuugcugaucaccuucugcuuuggguggguccuuauccccgcgugcacgcucgccauucugcuggugcucaaguucuucgcaaacaucuugcacaccuccaaccaggaaaaccgguucaaggccauccugcgcaagaucaaggaggaguucgagaagaccaagggcagcauggucugcgagaucugcaaguacgagugcgagacccucaaggaacugaaggcccacaaccuguccugcguccagggggagugccccuacugcuucacucacugcgagcccaccgagaccgcgauccaggcccacuacaagguaugccaggccacccacagauuccgcgaggaccucaagaagacggugacgccccagaacaucggccccgguugcuaccggacccugaacuuauuccgcuacaagagccggugcuauauccugaccauguggacccuccugcugauuaucgagucuauccucugggcugccagcgcggccgagaucccccucgucccccuguggaccgacaacgcccacggcgugggcuccguaccgaugcacaccgaccucgaacuugacuucagccugcccuccagcucccgcuauaccuacaagcgccaucucaccaaccccgucaacgaccagcagagcgugucccugcacaucgagaucgagagccaggggaucggcgccgacgugcaccaccuggggcacugguacgacgcccgccucaaccugaagacguccuuccacugcuacggcgccugcaccaaguaccaguacccguggcacaccgcgaaaugccacuucgagaaggauuacgaguaugagaacagcugggcaugcaacccgcccgacugucccggcgucgggacgggcugcacggccugcggguuauaccucgaccagcuuaagcccgugggcaccgcguuuaagaucaucagugugcgcuacagccggaaggugugcgugcaauucggggaggaguaccugugcaagaccaucgacaugaacgacugcuucgugacccgccacgccaagauuugcaucaucggcacggucagcaaauucucccagggcgacacccuccuguuccuggggcccauggagggcggcgggaucaucuucaaacacuggugcaccucgacgugccacuucggggaccccggggacgugaugggccccaaggacaagccguucaucugccccgaguuccccggacaguuccggaaaaagugcaacuucgcaacuucccccgugugcgaguacgacggcaacaucaucagcggguacaagaagguacuagccaccaucgauuccuuccagagcuucaacaccuccaacauccacuucaccgacgaacgcaucgaguggcgagauccggacggcauguuacgcgaucacaucaauaucgugaucagcaaggacaucgacuucgagaaccuggccgagaaccccugcaaggucgggcuccaagcggccaacaucgagggcgccuggggcuccggggucggcuuuacgcugaccugccaggugagccugaccgagugccccaccuuucucacguccauuaaggccugcgacauggccaucugcuacggggcggagagcgugacgcugucccggggccagaacaccgucaagaucacggggaaaggcggccacagcggguccagcuucaagugcugccacgguaaggagugcucccugacgggacuacaggccagcgcgccccaccuggacaaggugaacggcaucuccgagcucgagaaugagaagguguacgacgacggcgccccggagugugggaucacgugcugguucaagaaauccggcgagugggucauggguaucaucaacgggaacugggucgugcucaucgcccugugcguccugcuccuguucagccugauccuccugagcauccugugccccgugcgcaagcacaagaaguccuga

SEQ ID NO: 15151 - RNA, 3402 nt, Artificial Sequence
  derived and/or modified CDS sequence (opt11) from SEOV(WuhanRf02)__JQ665888.1__GP
auguggagccugcuucuccucgccgcucugguuggucagggauucgcccucaaaaacguauucgauaugaggauccagugcccucauuccguuaacuucggcgaaacauccgucuccggguacaccgaacuaccaccccuaucacuacaagaagccgagcagcucgugccggaaucuuccugcaauauggacaaccaucaaucacucuccaccaucaacaaacucaccaaagucaucuggcgaaagaaagccaaucaagaauccgccaaccaaaauuccuucgaaguuaucgaaucagaaguauccuucaaaggauuaugcaugcucaagcaccgcaugguagaagaauccuacaggaaccgccgauccgucauaugcuaugaccuagcaugcaacucuacuuucugcaaaccaaccguguacaugauagucccaauccacgccuguaacaugaugaaaucgugccucaucggccuuggccccuaccgaauccaagucguauacgaacguaccuauugcaccacaggaauacugaccgaaggaaagugcuucguaccggacaaagccguaguaucggcccuaaaacgcggaauguacgccgucgccucaauugaaaccauaugcuucuucauacaccaaaaaggaaacaccuacaaaauagucacggcaaucacaucagccaugggcuccaaaugcaacaacaccgacaccaagguacagggcuacuacauuugcaucauaggaggcaacagcgcccccgucuaugcgcccgcgggugaagacuuccgcgcaauggaagucuucuccggaauaauaacaaguccccacggagaagaccaugaccugcccggugaagaaauugccaccuaccaaaucuccggacagauagaggcaaaaaucccccacacugucagcuccaaaaaccuuaaacucaccgccuuugccggaauaccaagcuacagcagcacaagcauccucgccgccuccgaggacggacgcuucauauucaguccaggacucuuccccaacuuaaaccaaucagucugcgacaacaacgcccucccacucaucuggcgagggcugaucgaccucacaggauacuacgaagcuguccauccuugcaacgucuucugcguccuauccggccccggugcuagcugcgaggccuucagugaagggggcauauucaacauaaccucacccaugugccuaguuucuaaacaaaacagauuccgggcugcagaacaacgcauuucauucgugugccaacgaguugacauggacaucaucguauacugcaacggccagaagaaaaccauacucaccaaaacacucguaaucggucaaugcaucuacacgauaacaucucuguuuucccuccuaccuggcguggcccacuccaucgcaauugaacucugcguuccggguuuccacggaugggcuaccgcggcucucuuaacgacuuuuuguuucggcuggguacuaauucccgcauguacucuagcaauacuccuugugcucaaauucuucgccaacaucuugcacacauccaaccaagaaaaccgcuucaaagcuauacuacgcaaaauaaaagaagaauuugaaaagaccaaaggcagcgucguaugcgagaucugcaaauacgagugcgagacgcucaaagaacucaaagcccacaaucugagcugcguccaaggagaaugccccuacugcuucacccacugcgaacccacugaaaccgccauccaggcacacuacaaggucugucaagccacacaccgauuccgugaagaccucaagaaaacagucacaccccaaaacaucggcccagguugcuaucggacccuaaaucuauucagauauaacagccggccugauggccuuaccauguggacucuacuacuaauaaucgaauccauccucugggccgccagcgccgcggaaaucccccuggucccacuuugggcugacaaugcacacggaguuggcucagucccgaugcacaccgaccuagaacucgacuucucucuuccaagcagcucaaaauacacuuacaagcgacaccucacgaaccccgucaacgaccaacagagcgugucccuccauaucgagauugaaucccaaggaaucggcgccgauguccaccaccuuggucacugguacgacgcccgacugaaccucaaaaccucauuccacugcuacggcgccuguacaaaauaccaauacccauggcacacagcaaagugccacuucgaaaaagacuacgaauacgaaaacucaugggcauguaacccaccagacugccccggagucggcaccggcugcaccgccugugggcucuaucuagaccaacugaaacccgugggcacugccuucaagaucaucucaguccgauacuccaggaaagucugcguucaguucggggaagaauaccuguguaaaacaaucgauaugaacgauugcuuuguaacgcgccacgcgaaaauaugcauuaucggcacgguccccaaauucucccaaggcgacacccucuuauuccucggaccuauggaagguggcgguauuauuuucaaacacuggugcacauccacgugccacuucggagacccaggcgauguaauggggccgaaggacaagcccuucauccgcccggaguucccggggcaauuccggaagaaaugcaacuucgcgaccaccccagucugcggcuaugacggcaacauuaucucaggcuacaagaaaguacucgcgaccauagauagcuuccagucuuuuaacacuucaaacauccauuucacagacgaaaggauagaauggcgugacccggacggcaugcuucgcgaccacaucaacaucgucaucagcaaagacaucgacuucgaaaaccucgcggaaaaccccugcaaaguaggccuccaggcggccaauaucgaaggcgccuggggcuccggcguaggcuucacgcucacgugccaggucucccucacagaauguccuaccuuccugacauccauaaaggcuugcgacauggcaaucuguuacggggccgaaucugucacccucucuagaggccaaaacacggucaaaauuacaggcaaaggaggacacucaggaagcuccuucaaaugcugucacgguaaagaaugcucaagcaccggccugcaggccuccgcuccccaccucgacaaagugaacggcauaagcgaacucgaaaacgaaaaagucuacgacgauggcgcuccggagugcggaaucacaugcugguucaagaaaagcggugaaugggugaugggcaucauuaacggaaacuggguuguacugaucgcccucugcguacuccuccucuuuagccugauccugcucucaauccuuugcccgguccggaaacacaagaaauccuga

SEQ ID NO: 15152 - RNA, 3402 nt, Artificial Sequence
  derived and/or modified CDS sequence (opt11) from SEOV(WuhanRf07)__JQ665889.1__GP
auguggagccugcuccugcuggccgcccucgugggccagggguucgcgcugaagaacgucuucgacaugcgcauccaauguccccacagcgugaacuucggcgagaccagcguguccggguauaccgagcugccgccccucucuuugcaggaggccgagcagcugguccccgaguccuccugcaacauggauaaccaucaaucccucagcaccaucaacaagcugacuaaggugaucuggcggaagaaggcaaaccaggaaucugcaaaccagaacagcuucgaggugaucgaguccgaggucagcuucaagggccuaugcaugcucaagcaucguaugguggaggaauccuacaggaaccgccggagcgugauauguuacgaccuggccugcaacuccaccuucugcaaacccaccgucuacaugaucgugccgauucacgcgugcaacaugaugaaguccugccugaucgggcucggccccuaucgcauccaggucguauacgagcggacguacugcaccaccgguauccuuacagaggggaagugcuucgugcccgacaaggccguggucagcgcucucaagcgcggcauguacgccguggcgagcaucgagacgaucugcuucuucauccaccagaaggggaacaccuacaagaucgugaccgccaucaccuccgccaugggcagcaagugcaacaacacagacaccaagguccagggguacuacauaugcauaaucggcggcaacagcgcccccgucuacgcaccggcgggggaggacuuccgggccauggagguguuuuccggcaucaucaccucaccccacggggaggaccacgaccucccaggcgaggagaucgccacuuaccagaucuccggccagaucgaggccaagaucccccacacggucuccuccaaaaaccugaagcugaccgccuucgcggggaucccgagcuacuccagcaccuccauccucgccgccagcgaggacggccgcuucaucuuuucccccgggcuguuucccaacuugaaccagagcgugugcgacaacaacgcccucccccugaucuggcggggccugauugaccugacgggguacuacgaggccgugcacccgugcaacgucuucugcgugcuguccggccccggcgcgagcugcgaagccuucuccgagggcgggaucuucaacaucacgagccccaugugccuggucuccaaacagaaccgcuuccgggccgccgagcagcagaucagcuucguaugccagcgcguagacauggacaucaucgucuacugcaacggccagaagaagacaauucugaccaagacccuggugaucggccagugcaucuacacgaucaccucccuguucagccuccugcccgggguggcucacagcauagcgaucgagcugugcgucccaggcuuccacggaugggccaccgccgcccuccugaccacguucugcuuugggugggugcugauccccgcgugcacccucgccauccugcuggugcucaaguucuuugccaacauccugcacaccuccaaccaggagaaccgguucaaggccauucugcgcaagaucaaggaggaguucgaaaagacaaagggcagcauggucugcgagaucugcaaguaugagugcgagacacucaaggagcugaaggcccacaaccuguccugcgugcagggcgagugccccuacugcuucacccacugcgaacccaccgagaccgcgauccaggcccacuacaaaguuugccaggccacgcaccgguuccgcgaagaccuuaagaagaccgucaccccgcagaacaucggccccggguguuaccggacccugaaccuguuccgcuacaagagccggccguacauacugaccauguggacgauccuccugaucaucgaauccauucugugggccgccagcgcggccgagaucccccuagugccgcucuggaccgacaacgcccacggcguggguuccguccccaugcacaccgaccuggagcuagacuucagccugcccuccagcuccaaguacaccuacaaacgccaccugacgaacccggugaacgaccagcaguccgugucccuccauaucgagauugagucgcagggcaucggcgccgacguccaccaccuggggcacugguacgacgcccgucugaaccucaagaccuccuuccacugcuacggggcguguaccaaguaccaguaccccuggcacaccgccaagugccacuucgagaaggacuaugaguacgagaacagcugggccugcaacccgcccgacugccccgggguggggacgggcugcaccgccugcgggcuauaucuggaccagcucaagcccguggguacugcguucaagaucaucagcguccgguacagccgcaaggucugcgugcaguucggggaggaguaccuuugcaagacgaucgacaugaacgacugcuucgucacgcggcacgccaagaucugcaucaucggcaccguaagcaaguuuucccagggcgacacccuccucuuccuagggccgauggagggcgggggcaucaucuucaaacacugguguaccagcacgugccacuucggggaccccggcgacgugaugggcccgaaggacaagcccuucaucugccccgaguucccggggcaguuccguaagaagugcaauuucgcgacgaccccggucugcgaauacgacggcaacaucaucuccggguacaagaagguguuagccaccaucgacagcuuccaguccuucaacacgagcaacauccacuucaccgacgagcggaucgaguggcgcgaucccgacggcaugcuccgggaccacaucaauaucgugaucuccaaggacaucgacuucgagaaccuggccgagaaccccugcaaggucgggcugcaggcggccaacauugaaggcgccuggggcagcggggugggcuucacccugaccugccaggugucccugacggagugcccuaccuuccugaccagcaucaaggccugcgacauggccaucugcuauggcgcggaguccgucacccuuagccgcggccagaacacggugaagaucaccgggaagggcggucacuccggcagcuccuucaagugcugccacgguaaggagugcucauccaccgggcugcaggccagcgccccgcaccuggacaaggugaacggcaucuccgagcuagagaacgagaaggucuacgacgacggcgcccccgagugcgggauaacgugcugguucaagaaguccggcgaguggguuauggggaucaucaacggcaacugggugguccugaucgcccugugcgugcuccuccuguucagccucauucugcugagcauccucugcccugugcggaagcacaagaaauccuaa

SEQ ID NO: 15153 - RNA, 3402 nt, Artificial Sequence
  derived and/or modified CDS sequence (opt11) from SEOV(WuhanRf18)__JQ665893.1__GP
auguggagccugcuccugcuggccgcccucgugggccaggguuucgcccuaaagaacgucuucgauaugcgcauccagugcccccacucagugaacuucggagagaccuccgugucaggguacaccgagcugccgccccucucccuacaagaggccgaacagcugguccccgaguccuccuguaacauggacaaccaccagucccucaguaccaucaacaagcugacuaaagugaucuggcggaagaaggccaaccaggaauccgcgaaccagaacagcuucgaggugauagaguccgaggucaguuucaagggccugugcaugcuaaagcaucgcaugguggaggaguccuaucggaaccgccggagcgucaucugcuacgaccuggccugcaacuccacguucugcaagcccaccgucuacaugaucgucccgauccacgcgugcaacaugaugaaguccugccugaucgggcucgggcccuaccgcauacaggugguuuacgagagaacguacugcaccacgggcauccugacagaggggaagugcuucgugcccgacaaagccguggucuccgcccugaagcgcggcauguaugccguggcgagcaucgagacgaucugcuucuucauccaccaaaagggaaacaccuacaagauuguaaccgcgaucaccuccgccaugggcagcaaguguaauaacacagacaccaagguccagggguacuacaucugcaucaucgguggcaacagugccccaguguacgcacccgcgggggaagacuuccgggccauggaagucuucuccggcaucaucaccagcccccacggugaggaccacgaccuccccggcgaggaaaucgccacguaccagaucuccggccagaucgaggccaagaucccccacacggucagcuccaagaaucuaaaguugaccgccuucgcggggaucccgagcuacuccagcaccagcauacucgccgccagugaggauggacgcuucauuuucucccccgggcuguuccccaaccugaaucagagcgugugcgacaacaacgcgcucccccugauuuggcggggucuuaucgaccucaccggguacuacgaggccgugcacccgugcaacgucuuuugcguccucuccggccccggcgcgagcugcgaggcauucuccgagggcgggauuuucaauaucacgagcccgaugugccuggucuccaagcagaaccgcuuccgggccgccgagcagcgcaucagcuucgugugccagcgcguggacauggacauaaucgucuacugcaacgggcaaaagaagaccauccucaccaaaacccuggugauaggccagugcaucuacacgaucacuucccuguucucacuccugccagggguggcucacagcaucgcgaucgagcugugcgucccgggcuuccacggaugggccaccgccgcccuccugaccacguucuguuuuggguggguccucauccccgcgugcacccucgccauccugcuggugcucaaguucuucgcgaacauccugcauaccuccaaccaggagaaccgauucaaggccauccugcggaagauaaaggaggaauuugagaaaacaaagggcagcauggucugcgagaucugcaaguacgagugcgaaacccucaaggagcuaaaggcccauaaccuguccugcgugcagggagagugccccuacuguuucacccacugugagcccaccgagaccgcgauccaggcccacuacaaggugugccaggccacgcaccgcuuccgagaggaccucaagaagaccguuaccccgcaaaacaucggccccgggugcuaucgcacccugaaccuuuuccgguacaaaagccgcugcuacauccuaaccauguggacgauccuucucaucaucgagagcauccugugggccgccagcgcggccgagaucccgcucgugccccuguggaccgauaacgcccacggcgugggcuccgucccgaugcacaccgaccuggagcucgauuucucccuacccuccagcucgaaguacaccuacaagcgccaccucacgaaccccguaaacgaccagcagagcgugucccuucacaucgaaaucgagagccaggggauaggcgccgacguccaccaucugggacacugguacgacgcccggcuaaaccuuaaaacguccuuccacugcuacggcgcgugcaccaaguaucaguacccguggcacaccgccaagugccacuucgagaaagacuaugaguacgaaaacagcugggccugcaacccgcccgacugccccggcguggggacgggcugcaccgccugcgggcuguaccuggaccagcucaagcccgugggcaccgcguucaagaucaucuccguccgguauagccggaagguaugcgugcaguucggggaggaguaccuuugcaagacuaucgacaugaacgacugcuucgucacgcgccacgccaaaauuugcaucaucggcaccgugagcaaguucucccagggcgacacgcuccucuuccugggccccauggagggcggcgggaucaucuucaagcacuggugcacuagcacgugccacuucggggacccaggggacgugauggggcccaaggacaagccguucaucugcccggaguuccccgggcaauuccggaagaagugcaacuucgccacuacccccguuugcgaguacgacggaaacaucaucuccggguacaagaaggugcuggcaaccaucgacuccuuccaguccuucaacacgagcaacauccauuucacagacgagcgcaucgaguggcgggacccggacggcaugcuccgcgaccacaucaacaucgugaucuccaaggacaucgacuucgagaaccuggccgagaaccccugcaaggucgggcugcaggcggccaacaucgagggcgccugggguagcgggguuggcuucacccugaccugucaggugucccugacugagugcccuacguuccuuaccucgaucaaggccugcgauauggccaucugcuacggugcggaguccgucacccucagccggggccagaacacggugaaaaucaccggcaaagggggccacagcgggagcuccuuuaagugcugucacggcaaggaaugcagcuccaccgggcuacaggccagcgcgccccaccuggacaaggugaacggcaucuccgagcucgagaacgagaaagucuacgacgacggggccccggagugcgggaucacgugcugguucaagaaguccggcgagugggugauggggaucauaaacggcaacugggugguccuaauugcccuuugcgugcuccugcuguucagccucaucuugcugagcauccucugccccguccgcaagcacaagaagaguuga

SEQ ID NO: 15154 - RNA, 3402 nt, Artificial Sequence
  derived and/or modified CDS sequence (opt11) from SEOV(WuhanRn10)__JQ665896.1__GP
auguggagccugcuccugcuggccgcccucguggggcagggguucgcccugaagaacgucuucgacaugcgcauccaaugcccccacuccgugaacuucggcgagaccagcguguccggguacaccgagcugccgccccucagccugcaggaggccgagcaacugguccccgaauccagcugcaacauggacaaccaccagucccucagcaccauuaacaagcugaccaaggugaucuggcgaaagaaggccaaccaggaguccgccaaccagaacagcuucgaggugaucgaguccgaggucagcuucaagggccugugcaugcucaagcaccgcauggucgaagaguccuaccggaaccgccgguccgugaucuguuacgauuuggccugcaauuccaccuucugcaagcccaccgucuacaugaucgugccgauccacgcgugcaacaugaugaaguccugccugauaggguugggccccuaccgcauacagguggucuacgagcggacguacugcaccaccggcauccugaccgaggggaaguguuucgugcccgacaaggccguggucagcgcccugaagcgcggcauguacgcgguggcgagcaucgagacgaucugcuucuucauccaccagaaggggaacaccuacaagaucgugacggccaucaccuccgccaugggcagcaagugcaacaacacggacaccaaaguccagggauacuacaucugcauaaucggcggaaauagcgcccccguguacgcuccggcgggggaggacuuccgggccauggagguguucuccggcaucaucaccagcccccacggggaggaccacgaccuccccggcgaggagaucgccaccuaccagaucuccggacagaucgaggccaagaucccccacacggucagcuccaaaaaccugaagcugaccgcuuucgcggggauaccgagcuacuccagcaccucgauccucgccgccagcgaggauggccgcuucaucuucucccccggucuguuccccaacuuaaaccagagcgugugcgacaauaacgcccugccgcugaucuggcggggccugaucgaccucaccggguacuaugaggccguccacccgugcaacgucuucugcgugcugucggggcccggcgcgagcugcgaggccuucuccgagggcgggaucuucaacaucaccagccccaugugccuggucuccaagcagaaucgcuuccgggccgccgagcagcagaucagcuucgugugccagcgcguagacauggacauaaucgucuacugcaacgggcagaagaagaccauccucaccaagacccucguaaucggccagugcaucuacacgaucaccucccuguucagccugcuccccgggguggcccacuccaucgcgaucgagcugugcgucccgggcuuucacggcugggccaccgccgcccugcugaccacguucugcuucgggugggugcugauccccgcgugcacacucgccauucugcugguguuaaaguucuucgccaacauccuucauaccucaaaccaggagaaccgguucaaggccauccuucgcaagaucaaagaggaguucgagaaaaacaaaggaagcgucgugugcgagauaugcaaguacgagugcgagacccucaaggagcugaaggcccauaaccuguccugcgugcagggggagugccccuacugcuucacgcacugcgagcccacugagacggcgauccaggcccacuacaaggucugccaggccacccaccgguuccgcgaggaccucaagaaaaccgugaccccgcagaacaucggccccggaugcuaccgcacccugaaccuguuccgcuacaagagccggugcuacauccugaccauguggaccauucuccugaucaucgagagcauccugugggccgcuagcgcggccgagaucccccucgucccccuguggacggacaacgcccacggcgucggcucagugccuaugcacacugaccuggagcucgacuucagccugcccuccagcuccaaguacaccuacaagcgccaccugaccaaccccgugaacgaccagcagagcgucucccuccacaucgaaaucgaaagccaggggaucggcgccgacgugcaccaccugggacacugguacgacgcccgccugaaccucaagacguccuuccacugcuacggcgcgugcaccaaguaccaguacccguggcacaccgccaagugccacuuugagaaggacuacgaguacgagaacagcugggccuguaacccgcccgacugccccgggguggggaccggcugcacggccugcgggcuguaccuggaccagcucaaaccagucgggaccgcguucaagaucaucuccgugcgguacagccgcaaggugugcguacaguucggggaggaguaccugugcaagaccaucgacaugaacgacugcuucgugacccggcacgccaagaucugcaucaucggcacggugagcaaguucucccagggcgacacucucuuauuccuggggcccauggagggugggggcaucaucuucaagcacugguguaccagcacgugccauuucggggaccccggagacgucaugggacccaaggacaagccguucaucugccccgaguuccccggccaguuccgaaagaaguguaacuucgcaaccacccccgucugcgaguacgacggcaacaucaucagcggguacaagaaggugcuggccaccaucgacagcuuccaguccuucaacaccagcaacauccacuucacagacgagcggaucgaguggcgugacccggacggcaugcuacgggaccauaucaacaucguuauauccaaggacaucgacuucgagaaucuggccgagaaccccugcaagguggggcugcaggcggcgaacauagagggcgccuggggcagcggggucggcuuuacccuuaccugccaggucucgcuaaccgagugccccacguuccugaccagcaucaaggccugcgacauggcuauaugcuacggggcggaguccgugacccucagccgcggccagaacaccgugaagaucacggggaagggcggccacuccgggagcuccuucaagugcugccacggcaaggagugcagcuccacaggacugcaggccagcgcgccccaccuagacaaggucaacggcaucagcgagcucgagaacgagaagguguacgaugacggugcaccggagugcgggaucacgugcugguucaagaaguccggcgagugggugauggggaucaucaacggcaacugggucguguugaucgcccugugcgugcuccuccuguucagccucauccugcugagcauucucugccccguccggaaacauaagaaguccuga

SEQ ID NO: 15155 - RNA, 3402 nt, Artificial Sequence
  derived and/or modified CDS sequence (opt11) from SEOV(WuhanRn25)__JQ665897.1__GP
auguggagccuacuccugcuggccgcacucguaggccagggguucgccuuaaagaacgucuucgacaugcgcauccaaugcccccacagcgugaacuucggcgagaccagcgucuccggguacaccgagcugccgccccucucgcugcaggaggccgagcaacugguccccgaguccagcuguaacauggacaaucaccaaucccucagcaccauuaacaagcugaccaaggugaucuggcggaagaaggccaaucaggaaucggccaaccagaacagcuucgaggugaucgaguccgaggucagcuucaagggccugugcaugcucaagcaccgcaugguggaagagucauaccggaaccgccggagcguaaucugcuacgaccuggccugcaacuccaccuucugcaaacccaccgucuacaugauagugccgauccaugcguguaacaugaugaaauccugccugaucgggcucggccccuaccguauccaggugguauacgagcggacguacugcaccaccggcauccuaaccgagggcaagugcuucgugccggacaaggccguggucagcgcgcugaagcggggcauguaugccgucgcgagcaucgagacgaucugcuucuucauccaccaaaaggggaacaccuacaagaucgugaccgccaucaccagugccaugggcagcaaaugcaacaacacugacaccaagguccaaggguacuauaucugcaucaucggcggcaacagcgcccccgucuaugccccggcgggggaggauuuccgagccauggagguauucuccggcaucaucaccagcccccacggcgaggaccacgaccuccccggcgaggagaucgccaccuaccagaucuccggccagaucgaggccaagaucccccacacggucagcuccaagaaccugaagcugaccgccuucgcggggaucccgucuuacuccucgaccagcauccucgccgccagcgaggacggccgcuuuaucuucucccccgggcuguucccgaacuuaaaccagagcgugugcgacaacaacgcacucccccugaucuggcggggccugaucgaccuuaccggguacuacgaggccgugcacccgugcaacgucuucugcgugcuguccggccccggcgcgagcugcgaggccuuuucggagggcgggaucuuuaacauaacgagccccaugugccuggucuccaagcaaaaccgguuuagggccgcggaacaacagaucagcuucguuugccagcgcguggacauggacaucaucgucuacugcaacggccagaagaagaccauccucaccaagacccuggugaucggccagugcaucuacacaaucaccucccuguucucauuauuacccgggguggcccauagcauugcgaucgagcugugcgucccgggcuuccacggcugggcuaccgccgcccucuuaaccacuuucuguuucgggugggugcugauccccgcgugcacccucgccauccucuuagugcucaaauucuucgccaacauccuacacaccuccaaccaggagaacagguuuaaggccauccuacgcaagaucaaggaagaguucgagaagaacaagggcaguauggucugcgagauuugcaaguacgagugugagaccuugaaggagcugaaggcccacaaccuguccugcgugcagggggaaugccccuacugcuuuacgcacugcgagcccaccgagaccgcgauccaggcccacuacaaagucugccaggccacccaccgguuccgcgaggaccugaaaaagacugucacaccccagaacaucgguccagggugcuaucggacccuaaaccuguuucgcuacaagagccggugcuauauucugaccauguggaccauccuacugaucauugagaguauccugugggccgccagcgcggcagagaucccccucgugccccuguggaccgacaacgcccacggggugggcuccgucccuaugcacaccgaccuggaacucgacuucagccuucccuccagcuccaaguacaccuacaagcgacaucugaccaaccccgugaaugaccagcagagcgugucccuccacaucgaaauugagagccaggggaucggugcggacguccaccacuuggggcacugguacgacgcccgguugaaccucaagacguccuuccacugcuacggcgcgugcaccaaauaccaguacccguggcauaccgccaagugccacuucgagaaggacuacgaguacgagaacucaugggccugcaacccgcccgauugccccggcguggggaccggcugcacugccuguggguuguaccuggaccagcucaagcccguugggaccgcguuuaagaucaucuccguccgguacucacgcaagguaugcgugcaguucggcgaggaguaccugugcaagaccaucgacaugaacgacugcuucgucacccggcacgccaagaucugcauaauuggcacagugagcaaguuuucccagggcgacaccuuacucuuccuggggcccauggaagggggcggcauaaucuucaagcacuggugcaccucuacuugucacuuuggggaccccggcgacgugaugggacccaaggacaagccguucaucugcccggaguuccccgggcaguuccgcaagaaguguaacuucgccaccacccccgucugcgaguacgauggcaacaucauauccggguacaagaagguguuagccacgaucgauagcuuucagaguuucaacacuagcaauauccauuucacggacgagcggaucgaguggcgcgauccugacggcaugcuucgggaccacaucaacaucgugaucuccaaggacaucgauuucgagaaccuggccgaaaaccccugcaaggucgggcugcaagcggccaacaucgagggcgccuggggcagcggggugggcuuuacccugaccugccaggugucccugaccgaauguccgacguuccugacaagcaucaaggccugcgacauggccauuuguuacggggcggaguccgucacccucagccgcggccagaacacagucaagaucacggggaagggcggccauucagggucauccuuuaagugcugccacggcaaggagugcagcuccaccgggcugcaggccucugcaccccaccuggauaaggugaacggcaucuccgagcucgaaaacgagaaagucuacgacgacggcgccccggagugcgggaucacguguugguucaagaaauccggcgagugggugauggggaucaucaacggcaauugggugguccugaucgcccugugcgugcuccugcuguucagcuuaauccuccugucgauccuuugccccgugcggaagcacaaaaaguccuga

SEQ ID NO: 15156 - RNA, 3402 nt, Artificial Sequence
  derived and/or modified CDS sequence (opt11) from SEOV(XiaotangshanRn7)__GU592929.1__GP
auguggagccuccucuuccuggccgcauuggugggccagggguuugcccucaagaacgucuucgacaugcgcauccagugcccgcacagcgugaacuucggcgagacaagcguguccggguacaccgagcugccgccccugagccuacaggaggccgagcagcuggugcccgaguccagcugcaacauggacaaccaccagucccugagcacgaucaacaagcucaccaaggugaucuggcggcgcaaggccaaccaggagucggccaaccagaacagcuucgaggucgucgaguccgaggugagcuucaagggccugugcaugcucaagcaccggaugguugaggaguccuaccgcaaccggcgcagcgucaucugcuacgaccucgccugcaacucgaccuucugcaagcccacgguguacaugaucgugccgauucacgcgugcaacaugaugaaguccugcuugaucgggcugggacccuaccggauccaggucguguacgaacgcacguacugcaccacaggaauuuugaccgaagggaagugcuuugugcccgacaaggccgucgugagcgcccugaagcggggcauguacgcaaucgcgagcaucgagacgauaugcuucuuuauccaccagaaggggaacaccuacaagauuguaaccgccauaaccuccgccaugggcagcaagugcaacaacacggacaccaagguccaggguuacuacaucugcaucaucggcggcaacagcgcccccguguaugccccggcgggggaggacuuucgcgcuauggagguguucuccggcaucaucaccagcccgcacggggaagaccacgaccugcccggcgaggagaucgccaccuaccagaucuccggccagaucgaggccaagaucccccacacagucagcuccaagaaccucaagcuaaccgccuucgcggggaucccgagcuacuccagcaccuccauccuggccgccagcgaggacggccgguucauauuuuccccggggcuguuccccaaccugaaccagagcgugugcgacaacaacgcccugccccucaucuggcgcggccugauagaccugaccggguacuacgaggccgugcacccgugcaacgucuucugcguacucuccggccccggcgcgagcugcgaggccuucuccgagggcgggauuuucaacaucacgagcccgaugugccuggucuccaagcaaaaccgguuccgcgccgccgagcagcagaucagcuucgucugccagcggguggacauggacaucaucgucuacugcaacgggcagaagaagaccauccugaccaaaacccucgugaucggccagugcaucuacacaaucaccucccuguucagccugcuucccgggguggcccacagcaucgcgauugagcugugcgucccgggcuuccacggcugggccaccgccgcccugcucaucaccuucugcuucggaugggugcugauccccgcaugcacucuggccauccuccuggugcugaaguucuucgccaacauccuccacaccuccaaucaggagaaccgcuucaaggcgauccugcggaagaucaaggaggaguuugagaagaccaagggcagcauggucugugagaucugcaaguacgaaugcgagaccuugaaggagcucaaagcccacaaccuguccugcguucagggggagugccccuacugcuuuacgcacugcgagcccaccgaaaccgcgauccaggcccacuacaagguaugccaggccacccacagauuccgggaggaccugaagaagacggucacaccgcagaacaucggccccggaugcuaccgcacccucaaccuguuccgguacaagagccgcuguuacauccugaccauguggacccugcuccuaaucaucgaguccauccugugggccgccagcgcggcagagaucccccucgugcccuuauggacggacaacgcccacggcgugggcuccguuccgaugcacaccgaccuggagcucgacuucagccugcccuccagcuccaaguauaccuacaagcgccaccugaccaaccccgugaacgaccagcagagcgugucccuccacaucgagauugagucacaggggaucggcgccgacguccaccaccuugggcacugguacgacgccagauuaaaccucaagacauccuuccacugcuacggcgcgugcaccaaguaccaguacccguggcacacugccaagugccauuucgagaaggacuacgaguacgagaacagcugggccugcaacccgcccgacugcccaggaguggggacaggcugcacggccugcgggcuguaccuggaccagcuaaagcccgugggcaccgccuucaagaucaucuccguccgcuacucucggaaggugugcguccaguucggugaggaguaccugugcaagaccaucgacaugaacgacugcuucgucacucgccacgccaagaucugcaucaucggcacggugagcaaguucucccagggcgacacccuccucuuccuggggcccauggagggcgggggcaucaucuucaagcacuggugcaccagcacgugccacuucggggaccccggcgacgugaugggccccaaggacaaaccguucaucugccccgaguuucccgggcaguuccggaagaagugcaacuucgccaccacucccguaugcgaguacgacggcaacaucaucuccggguauaagaaggugcuggcgaccaucgacagcuuccaauccuucaacaccagcaacauccacuuuacggacgagcgcaucgaguggcgggacccggacggcaugcuacgcgaccacauaaacaucgugaucuccaaggacaucgacuucgagaaccuggccgaaaaucccugcaaggucggguuacaggcggccaacaucgagggugcguggggcagcggugugggcuucacccugacaugccaggugucccugaccgagugccccacguuccugaccagcaucaaggccugcgacauggccauuugcuacggggcggaguccgucacccucagccggggccagaacacugucaagauaacggggaagggcggccacuccgguagcuccuucaagugcugccacggcaaggagugcagcucgaccggucugcaggccuccgcgccccaucuggacaaggugaauggcaucuccgagcucgaaaacgagaagguuuacgacgacggcgccccggaaugcggggugaccugcugguucaagaaguccggugagugggugauggggaucaucaauggcaacugggucgugcugaucguccugugcguccuccugcuguucagccucauccugcugagcauccuaugccccgugcgcaagcacaagaaauccuga

SEQ ID NO: 15157 - RNA, 3402 nt, Artificial Sequence; identical to SEQ ID NO: 11871
  derived and/or modified CDS sequence (opt11) from SEOV(YongjiaRf45)__GU592926.1__GP

SEQ ID NO: 15158 - RNA, 3402 nt, Artificial Sequence
  derived and/or modified CDS sequence (opt11) from SEOV(YongjiaRn14)__GU592927.1__GP
auguggggccugcuccugcuggccgccaugguggggcagggcagcgcgcucaagaacgucuuugacaugaagauccaguguccccacagcgugaacuucggggaaaccagcguguccggcuacaccgagcugccgcccuuaccccuccaagaggccgagcagcugguccccgagagcucuugcaacauggacaaccaccagagccuguccacgaucaacaagcucaccaagguaauuuggcggaagaaggccaaccaggaaagcgccagucagaacucauucgagguggucgaguccgaggugagcuucaaggggcugugcaugcugaagcaccggaugguagaggaguccuaccggaaccgccgcagcgucaucugcuacgaccucgccugcaacaccaccuucugcaagccgaccguguacaugaucgugcccauccacgcgugcaacaugaugaaguccugccugaucggcuugggccccuaccggauccaggucaucuacgagcgcaccuacugcaccaccgggauccucacggagggcaaaugcuucguucccgacaaggccguggucagcgcgcugaagcgggggauguacgccaucgcguccaucgagaccguaugcuucuucgugcaccaaaagggcaacaccuacaagauugucaccgccaucacgagcgccauggguucgaagugcaacaacaccgacaguaaggugcaaggcuacuacaucugcaucaucggcgggaacagcgccccgguguaugcccccgcgggcgaggacuuccgcgccauggaggucuucuccgguaucaucaccagcccccacggcgaggaucacgaccugcccggcgaggagguggccaccuaccagaucuccgggcagaucgaggcuaagaucccacacacugugagcuccaagaaccucaagcugaccgcguucgcgggcauccccagcuacuccagcacaucccugcucgccgccagcgaagacgggcgguucauuuucuccccuggccuguuccccaaccugaaccagagcgucugcgauaacaacgcccucccgcugaucuggcgcgggcugaucgaccucaccggcuacuacgaggccgugcacccgugcaacgucuucugcgugcuguccggccccggggcgagcugcgaggccuuuuccgaaggcgggaucuucaacaucacgagccccaugugccugguguccaagcagaaccgguuccgugccgcggagcagcagaucagcuucauuugccagcgggucgacauggacaucaucguguacugcaauggccagaagaagaccauccucaccaagacccuggugaucgggcaguguaucuacacgaucaccucucuguucagccuucucccgggcgucgcccauagcaucgcgaucgaacugugcgugcccggcuuccacgggugggccaccgcagcucuccugaucacauuuugcuuuggcugggugcugauccccgcgugcacgcucgcggucuuacuguuccucaaguuuuucgccaauauccugcacaccuccaaccaggagaaccgcuucaaggccauccuccggaagaucaaggaggaguucgaaaagaccaaggggagcauggugugcgaaaucugcaaguacgagugcgagacccucaaggagcugaaagcccacaaccuguccugcgugcaaggcgagugccccuacugcuuuacgcacugcgagccgaccgagaccgcgauccaggcccacuacaaggugugccaggccacccaccgcuuccgggaggaccucaagaagacggugacgccccagaacauagggcccggcugcuaccgcacccugaaccuguuccgguacaagagccgaugcuacauccugaccauguggauccuccugcuggucaucgagagcauccucugggccgccagcgcggccgagaucccccuagucccgcuguggacggacaacgcccacggcgugggcucagugcccaugcacaccgaccucgagcuggacuucagccugcccuccagcuccaaguacaccuacaagcggcaccucaccaacccggucaacgaccagcagagcgugucacugcacaucgagaucgaaagccagggcaucggggcggacgugcaccacuuaggccacugguacgacgcccgccucaaccugaagaccuccuuccacugcuacggcgcgugcacgaaguaccaguaccccuggcacaccgccaagugccacuucgagaaggacuacgaguacgagaacagcugggccugcaacccacccgacugccccggggucggcaccgggugcaccgcgugcggccuguaucucgaccagcugaagccaguggggacagcguucaagaucaucuccguccgcuacagccggaaggucugcgugcaauucggcgaggaguaccuuugcaagaccaucgauaugaacgacugcuucgugacccgccaugccaagaucugcaucaucggcaccgucagcaaguucucccagggggacacgcuccuguuccugggccccauggaaggcggcgggaucaucuuuaagcacuggugcaccagcacuugccauuuuggggaccccggcgacgugauggggccgaaggauaagcccuucaucugccccgaguuccccggacaguuccggaagaagugcaacuucgcuaccaccccggugugcgaguacgacgggaacgucaucuccggcuaccggaaggugcucgccaccaucgacagcuuccaguccuucaacaccagcaaugugcacuucaccgacgagaggaucgaauggcgcgaucccgacgggaugcugcgggaccacaucaauaucgucaucuccaaggacaucgacuucgagaaccuggccgagaaccccugcaaggugggccuccaagcggccaacaucgagggcgccugggggagcggggugggguucacgcugaccugccaggucucccugaccgagugccccaccuuccucacgucaaucaaggccugcgacauggccaucugcuacggcgcagaguccgugacccugagucgcgggcagaacaccgugaagaucaccggcaagggcggccauuccggcagcuccuucaagugcugccacgggaaggagugcuccaguaacggccugcaggccucagccccgcacuuggacaaggucaacggcauuuccgaacuggagaacgaaaagguguacgacgacggggcccccgagugcggcaucacgugcugguucaaaaagagcggggagugggugaugggcaucaucaacggcaacuggauaguccucaucgugcuaugcgugcugcuccuguucucgcugauccugcuuagcauccucugucccguacggaagcacaagaaguccuga

SEQ ID NO: 15159 - RNA, 3402 nt, Artificial Sequence
  derived and/or modified CDS sequence (opt11) from SEOV(ZT10)__DQ159911.1__GP
auguggagccugcuacugcuggccgcccucgugggccagggguucgcccugaagaacgucuucgauaugcgcauccagugcccccacucagugaacuucggcgagaccagcguguccggguacaccgaacugccgccccucagccugcaggaggccgaacagcugguccccgaguccagcugcaacauggacaaccaccagucccucagcaccaucaacaagcugaccaaggugauuuggcggaagaaggccaaccaggaguccgccaaccagaacagcuucgagguggucgaguccgaaguuagcuucaagggccugugcaugcucaagcaccgcaugguggaggaguccuaccggaaccgccggagcgucaucugcuacgaccuggccugcaacuccaccuucugcaaacccaccguguacaugaucgugccgauccacgcgugcaacaugaugaaguccugccuuaucgggcucggccccuaccgcauccaggucguguacgagcggacguacugcaccaccggcauccugaccgaggggaaaugcuucgugcccgacaaggccgucgugagcgcccugaagcgcggcauguacgccaucgcgagcaucgagacgaucugcuucuucauccaccagaaggggaacaaguacaagaucgugaccgccaucaccuccgccaugggcagcaagugcaacaacaccgacacgaagguccagggguacuacaucugcaucaucggcggcaacagcgcccccguguacgccccggcgggggaggacuuucgggccauggagguguucuccggcaucaucaccagcccucacggggaggaccacgaccuccccggcgaggagaucgccaccuaccagaucuccggccagauugaggccaagaucccccacacggucagcuccaaaaaccugaagcugacggccuucgcggggaucccgagcuacuccagcaccuccauccucgcggccagcgaggacggccgcuucaucuucucccccgggcuguuccccaaccugaaccagagcgugugcgacaacaacgccuuaccccugaucuggcgcggccugaucgaccucaccggguacuacgaggccgugcacccgugcaacguguucugcgugcuguccggccccggcgcgagcugcgaggccuucuccgagggcggaaucuucaacaucaccagccccaugugccuagucuccaagcagauccgcuuccgggccgccgagcagcagaucagcuucaucugccagcgcguggacauggacaucaucguguacugcaacgggcagaagaagacgauccucacgaagacccuggucaucggccagugcaucuacacuaucacgucccuguucagccuccuccccgggguggcccacagcaucgcgaucgagcuaugcgugccgggcuuccacggcugggccaccgccgcccuccucaucaccuucugcuucggguggguccugauccccgcaugcacgcucgccauccugcuggugcucaaguucuucgccaacauccugcacacguccaaccaggagaaccgguucaaggccauccugcgcaagaucaaggaggaguucgagaagaccaagggcagcauggugugcgagaucugcaaguacgagugugagacccuaaaggagcugaaggcccacaaccuguccugcguccagggggagugccccuacugcuucacccacugcgagcccacggagaccgcgauccaggcccacuacaaggugugccaggccacccaccgguuccgagaggaccucaagaagaccgugacgccgcagaacaucggccccgggugcuaucggacacugaaccuguuccgguacaagucccggugcuacauccugacaauguggacccuccugcugaucaucgaguccauccucugggcugccagcgcggccgagaucccccuggucccccuguggaccgacaacgcccacggcgugggcuccgugccgaugcacacggaccucgagcuggacuucagccugcccuccagcuccaaguacaccuacaaacgccaccucacuaaccccgucaacgaccagcagagcgugucccugcacaucgagaucgagagccaagggaucggcgccgacguccaccaccuggggcacugcuacgacgcccgccucaaccugaagaccuccuuccacuguuacggcgcgugcacgaaguaccaguacccguggcacaccgccaagugccacuucgagaaggacuacgaguacgagaacagcugggccugcaacccgcccgacugccccggugucgggaccggcugcaccgccugcgggcuguaccucgaccagcugaagcccgugggcacggcguucaagaucaucuccgugcgguacagccgcaaggucugugugcaguucggagaggaguaccugugcaagacaaucgacaugaacgacugcuucguuacccggcacgccaagaucugcaucaucggcaccgucagcaaguuuucccagggcgacacgcuccuguuccuggggccgauggagggcgggggaaucaucuucaagcacuggugcaccuccacgugccacuucggggaccccggcgacgugaugggucccaaggacaagccguucaucugccccgaguuccccgggcaguuccgcaagaagugcaacuucgccaccaccccggugugcgaguacgacggaaacaucaucuccggauacaagaagguacucgccaccauagacagcuuucaguccuucaacaccagcaacauccacuucaccgacgaacggaucgaguggcgcgacccggacggcaugcugcgggaccauaucaacaucgugaucuccaaggacaucgacuucgagaaucuggccgagaaccccugcaagguggggcuccaggcggccaacaucgagggcgccuggggccugggggucggcuucacgcugaccugccaggugagccucaccgagugccccaccuucuugacguccaucaaggccugcgacauggccaucugcuauggggcggagagcgugacccugucccgcggccagaacaccgucaaaaucaccgggaagggugggcacagcggguccagcuucaagugcugccacggcaaggagugcuccagcacggggcuccaggccuccgcgccccaccuggacaaggugaacggcaucagcgagcuggagaacgagaagguguacgacgacggcgccccggagugcgggaucacgugcugguucaagaaguccggcgaaugggucauggggaucaucaacggcaacuggguggugcucaucguccugugcguacugcuccuguucagccugauccucuugagcaucuuaugccccguucgaaagcacaagaaguccuga

SEQ ID NO: 15160 - RNA, 3402 nt, Artificial Sequence; identical to SEQ ID NO: 11874
  derived and/or modified CDS sequence (opt11) from SEOV(ZT71)__EF117248.1__GP

SEQ ID NO: 15161 - RNA, 3402 nt, Artificial Sequence; identical to SEQ ID NO: 11875
  derived and/or modified CDS sequence (opt11) from SEOV(DN2)__KX289953.1__GP

SEQ ID NO: 15162 - RNA, 3402 nt, Artificial Sequence
  derived and/or modified CDS sequence (opt11) from SEOV(IR162)__KX079475.1__GP
auguggagccugcuccugcuggccgcccucgucggccgcggguucacgcugaagaacgucuucgacaugcggauccagugcccccacagcgugaacuucggcgagacuagcguguccggguacacggaacugccgccccucagccugcaggaggcggagcagcugguccccgagucuucaugcaacauggacaaccaccaaucccucagcaccaucaacaagcugaccaaggugaucuggcgcaagaaggccaaccaggaguccgccaaccaaaauagcuucgagguggucgaguccgaggugagcuucaagggccugugcaugcucaaacaccggaugguggaagaguccuaccgcaaccggcgcagcgucaucugcuacgacuuagccugcaacuccaccuucugcaagcccacggucuacaugaucgugccgauccacgccugcaacaugaugaaguccugccugaucggucucggccccuaccggauccaggucguguacgagcgcaccuacugcaccacgggcauccugacggaggggaagugcuucgugcccgacaaggcgguaguaagcgcccugaagcggggcauguacgccauagccagcaucgagaccaucugcuucuucauccaccagaaggggaacaccuacaagaucgucaccgcgaucacuuccgccaugggcagcaagugcaacaauaccgacaccaagguccagggguacuacaucuguaucaucggcggcaacagcgccccuguguaugcaccggcgggggaggauuuccgugcgauggagguguucuccggcaucaucaccagcccccacggggaggaccacgaccucccaggcgaggagaucgccacguaccagauaucuggccaaaucgaggccaagaucccccacaccgucuccucuaagaaccugaagcugaccgcguucgcggggaucccgagcuacuccagcaccuccgugcucaucgcgagcgaggacggacgguucaucuucucccccgggcuguuccccaaucugaaccagagcgugugcgacaacaacgcccucccccugauuuggcgcggccugauugaccucacgggguacuacgaagccguccacccgugcaacgucuucugcguccuguccggccccggcgccagcugcgaggccuucagcgagggcgggaucuucaacaucaccagccccaugugccugguguccaagcagaaccgcuuccgcgcggccgagcagcagaucagcuucguaugccagcgggucgacauggacaucaucguguacugcaacggucagaagaagaccauccucaccaagacgcuggugaucggccaguguaucuacaccaucaccucccuguucagccuccugcccggaguggcccacagcaucgccaucgagcugugcgugccgggcuuccacggcugggccaccgcggcccuacugaucacguucugcuucgggugggugcuuauccccgccugcacccuagccauccuccugguccucaaguucuucgcgaauauacugcacacguccaaccaggagaacagauucaaggccauccugcggaagaucaaggaagaguucgagaagaccaagggcagcauggugugugagaucugcaaguacgagugcgagacgcucaaggagcugaaggcccacaaccuguccugcgugcagggugagugccccuacugcuucacccauugcgagcccaccgagaccgccauccaggcacacuacaaggucugccaggcgacgcaccgcuuccgggaggaccucaagaagaccgugacaccgcagaacaucggccccgggugcuacaggacacugaaccuguuccgguacaagagccgcugcuacauacugaccauguggacgcuccuucugaucaucgaguccauccuaugggccgccagcgcaaccgagaucccccuggugccccuguggaccgacaacgcccacggcguaggcuccgugccgaugcacaccgaccucgagcuggacuucagccugcccuccagcuccaaguacaccuauaagcgccaccucaccaaccccgugaacgaccagcagagcgucucccugcacaucgagaucgagagccaggggaucggcgcggauguacaccaccuggggcacugguacgacgcccgccucaaccugaagaccuccuuccacugcuacggcgccugcaccaaguaccaguacccguggcacacagccaagugccacuucgagaaggacuacgaguacgagaacagcugggccuguaacccgccagacugccccggcaucgggaccggcugcaccgcgugcgggcuguacuuggaucaguuaaagcccgugggaacggccuucaaaaucaucuccgucagauacagccggaaggugugcgugcaguucggggaggaguaccuaugcaagacgauugacaugaacgacugcuucgucacccgccacgccaagaucugcaucaucggcaccgugagcaaguucagccagggcgacacucuccuauuccuggggcccauggagggcgggggcaucaucuucaagcacuggugcacuucuacgugccacuucggggaccccggcgacgugaugggccccaaggacaaaccguucaucugccccgaguuccccggacaguuccggaagaagugcaacuucgccacuacccccgucugcgaguacgacggcaacaucaucuccggguacaagaagguacucgcuaccaucgacagcuuccaguccuuuaacaccagcaacauccacuucaccgacgagcgcaucgaguggcgggaccccgacggcaugcugcgcgaccacaucaacaucgugaucuccaaggacaucgacuucgagaaccuggccgagaaccccugcaaagucggccuccaggccgccaacaucgagggcgcauggggcucgggggugggcuucacccugacgugccaggugucccugacagagugccccaccuuccuuaccagcaucaaggcgugugacauggccaucugcuacggggccgaauccgucacgcugagccggggucagaacaccgugaaaaucaccgggaagggcggucacuccgggagcuccuucaaguguugccacggcaaggagugcagcuccaccggucugcaggccuccgcgccccaccucgacaagguuaauggcaucuccgaccuggagaacgagaagguuuacgacgacggcgccccggagugugggaucacauguugguucaagaaauccggcgagugggugauggggaucaucaacggcaacugggugguccugaucgugcucugcgugcugcuccuguucagccugauacuacucaguauccugugccccguccggaagcacaaaaaguccuag

SEQ ID NO: 15163 - RNA, 3402 nt, Artificial Sequence
  derived and/or modified CDS sequence (opt11) from SEOV(Gou3)__AF145977.2__GP
auguggggccugcuccugcuggccgcccucguggggcagggccuagcgcugaagaacgucuuugacaugaagauccagugcccgcacagcgugaacuucggggagaccagcgugagcggcuacaccgagcuuccgccccugccccugcaggaggccgagcagcucguccccgaguccagcugcaacauggacaaccaccagucccugagcaccaucaacaagcugaccaaggugaucuggcgcaagaaggccaaccaggaguccgccucacagaacuccuucgagguugucgagaaugaggugagcuucaagggacucuguaugcugaagcaccggaugguggaggaguccuaccguaaucggcgcagcgucaucugcuacgaccuggccugcaacaccaccuucugcaagccgacgguguacaugaucgugcccauccacgcgugcaacaugaugaaguccugccucaucggccugggccccuaccggauccaggucaucuacgagcgcaccuacugcaccaccgggauccugacugagggcaagugcuucgugcccgacaaggccguggucagcgcccucaagcgggguauguacgccaucgcguccaucgagaccaucugcuucuucgugcacaagaagggcaacacuuacaagaucgugagcgccaucacccuggccaugggguccaagugcaacaacacggacagcaagguacagggauacuacaucugcaucaucggcgggaacuccgccccgguguacgcccccgcgggcgaggauuuucgcgccauggagguguucagcgggaucaucaccucaccccacggcgaggaccacgaccugcccggcgaggaaaucgccaccuaccagaucuccgggcaaaucgaggccaagaucccgcacaccgucagcuccaagaaccucaaguuaacugccuucgcgggcauccccagcuacuccagcacuuccauccuggccgccagcgaggacgggcgguucaucuucucccccggccucuuccccaaccugaaccagagcgugugcgacaacaacgcccugccgcucaucuggcgcgggcugaucgaucugaccggcuacuacgaggccauccaccccugcaacguguucugcguacucuccggucccggggcgagcugugaggccuucuccgagggcgggaucuucaacaucacaagccccaugugccugguguccaagcaaaaccgguuccgcgccgccgagcagcagaucucauucauaugccagcgggucgacauggacaucgugguuuauugcaacggccagaagaagacgauccugaccaagacccucgucaucgggcagugcaucuacaccauuacgucccuguucagccugcucccgggcguggcccacuccaucgcgaucgagcugugcgugcccggcuuccacgggugggccaccgccgcccugcucgucaccuucugcuucggcuggguguugauccccgcgugcacccuggccgugcuccuguuccugaaguucuucgccaacauccuccacacgagcaaccaggagaaccgcuucaaggccauccugcggaaaaucaaggaggaguucgagaagaccaaggggagcauggucugcgagaucuguaaguacgagugcgagacccugaaggagcucaaggcccacaaccuguccugcgugcagggcgagugccccuauugcuucacucacugcgagccgacggagaccgcgauccaggcccacuacaaggugugccaggccacccaccgcuuccgggaggaccugaagaagaccgucacgccccagaacaucggccccggcugcuaccgcacccugaaccucuuccgguacaagagccgcugcuacauccugaccauguggauccugcuccuggugaucgaguccauccugugggccgccagcgcggccgagaucccucucgugccucuguggaccgauaacgcccacggcgucggguccgugcccaugcacaccgaccuggaguuagacuucagccugccguccagcuccaaguacacguacaagcggcaccugaccaacccggugaacgaccagcagagcgucucgcuccacaucgagaucgagagccagggcaucggggccgacgugcaccaccugggccacugguacgacgcccgccugaaccucaagaccuccuuccacugcuacggcgcgugcaccaaguaccaguaccccuggcacacggccaagugccacuucgagaaggacuacgaguacgagaacagcugggccugcaacccgcccgacugccccgggguaggcgccgggugcaccgcgugcggccuguaccuggaccagcucaagcccgucgguaccgccuucaagaucaucuccgugcgauacagccggaaggugugcguccaguucggcgaggaguaccugugcaaaaccaucgacaugaacgacugcuucgugacgcgccacgccaagaucugcaucaucggaaccguguccaaguucagccagggggacacccuccucuuccugggccccauggagggcggcgggaucaucuucaagcacuggugcaccagcacgugccacuucggggaccccggcgacgucauggggccgaaggacaagcccuucaucugccccgaguuccccggccaauuccggaagaagugcaacuucgccaccaccccagugugcgaguacgacgggaacgugaucuccggcuaccgcaagguacuggccaccaucgacagcuuucaguccuucaacaccagcaacgugcacuucaccgacgagcggaucgaauggaaggaccccgacgggaugcuccgcgaccacaucaacaucgugaucuccaaggacaucgacuucgagaaccuggcggagaaccccugcaaggucggccugcaggccgccaacaucgagggcgccugggggagcggcgugggcuucacccugaccugccaggugucccugacggagugccccaccuuccugaccagcaucgaggccugcgacauggcgaucugcuacggcgccgaguccgucacccucagccgggggcagaacacgaucaagaucaccggcaagggcgggcacuccggcagcuccuucaaaugcugccacgggaaggagugcagcgccaacggccugcaggccuccgccccgcaccuggacaaggugaacggcaucagcgagcucgagaaugagaagguguacgacgacggggcgcccgaaugcggcaucacgugcugguucaagaaguccggggaaugggucaugggcauuaucaacgggaacuggguggugcugaucguccugugcgugcuccugcuguuuagccucauccugcuuuccauacucugccccgugcguaagcacaagaaguccuga

SEQ ID NO: 15164 - RNA, 3402 nt, Artificial Sequence
  derived and/or modified CDS sequence (opt11) from SEOV(HB55)__AF035832.1__GP
auguggagccugcuccugcuggccgcccucgugggccagggguucgcccugaagaacguuuucgauaugcgcauccagugcccucacuccgugaacuucggcgagaccagcguguccggguacaccgagcugccgccccucagccugcaggaggccgagcagcugguccccgaauccagcugcaacauggacaaccaccagucccucagcacgaucaacaagcugaccaaagugguguggcgcaagaaggccaaccaggaguccgccaaccagaacagcuucgaggucguggaguccgaggugagcuucaagggccugugcaugcucaagcaccgcauggucgaggaguccuaccggaaccgccggagcgugaucugcuacgaccuggccugcaacuccaccuucugcaagcccaccguguacaugaucgucccgauccacgcgugcaacaugaugaaguccugccugaucgggcuuggccccuaccgcauccaggugguguacgagcggacguacugcaccaccggcauccugaccgaggggaagugcuucguccccgacaaggccguggugggcgcccugaagcgcgggauguacgccaucgcguccaucgaaacgaucugcuuuuucauccaccagaagggcaacaaguacaagaucgucaccgccauuaccagcgcuaugggguccaagugcaacaacaccgacacgaaggugcagggcuacuacaucugcaucaucggcgggaacagcgcccccguuuacgccccggcgggcgaggacuuccgggccauggaggucuucagcgggaucaucaccagcccccacggcgaggaccacgaccuccccggcgaggagaucgccacguaucagaucagcgggcagaucgaggccaagauaccccacaccguguccagcaagaaccugaaacugaucgccuucgcgggcaucccguccuacagcuccacgagcaucuuagccgccuccgaggacgggcgcuucaucuucagccccggccucuuccccaaccugaaccaguccgugugcgacaacaacgcccucccacugauauggcgggggcugaucgaccucacuggcuacuacgaggccguccaccccugcaacguguuuugcguccugagcggccccggggccuccugcgaggccuucucugagggcgggaucuucaacaucaccucccccaugugccuggugagcaagcagaaccgcuuucgggccgccgagcagcagaucuccuuuaucugccagcgcguggacauggacaucaucgucuacugcaacggccagaagaagaccauccucacgaagacccuggugaucggccagugcauuuacacuaucaccagccuguucucccuccugcccggcguggcccacagcaucgcgaucgagcugugcgucccgggcuuccacgggugggccaccgccgcccuccugaucaccuucugcuucggcugggugcugauccccgcgugcacccucgccauccugcuggugcucaaguucuucgccaacauccugcacaccagcaaccaggagaaccgguucaaggccauccugcgcaagauaaaggaggaguucgagaagacgaagggguccauggucugcgagaucugcaaguacgagugcgagacccucaaggaacugaaagcccacaaccugagcugcgugcagggcgagugccccuauugcuucacccacugcgagcccaccgagacggcgauccaggcccacuacaaggugugccaggccacccaccgguuccgcgaggaccucaagaaaaccgucaccccgcagaacauugggcccggcugcuaccgcacgcugaaccuguuccgcuacaagucccggugcuacauccugaccauguggacccuccugcugaucaucgagagcauauuaugggccgccuccgcggccgagaucccccuggugccccuguggaccgacaacgcccacggcguggggagcgucccgaugcauaccgaccucgagcuggacuucucacugcccagcuccagcaaguacacguacaagaggcaccucaccaaccccgugaacgaccagcaguccgugagccugcacaucgagaucgagucccagggcaucggggccgacguccaccaccugggccauugguacgacgcccgacucaaccugaagaccagcuuccacugcuacggcgcgugcacuaaguaccaguacccguggcacacggccaagugccacuucgagaaggacuacgaguacgagaacuccugggccugcaacccgcccgacugccccggggugggcaccgggugcaccgccugcggccuguaccucgaccagcugaagcccguggggaccgcguucaagaucaucagcguccgguacucccgcaaggccugcgugcaguucggcgaagaguaccugugcaagacgaucgauaugaaugacugcuucgugaccggccacgccaagaucugcaucaucgggaccgucagcaaguucagccagggcgacacccuccuguuccuggggcccauggagggcgggggcaucaucuucaagcacuggugcacguccacgugccacuucggcgaccccggugacgugaugggccccaaggacaagccguucaucugcccugaguuccccgggcaguuccggaagaaaugcaacuucgccaccacccccaucugcgaguacgacggcaacaucaucuccggguacaagaaggugcucgccaccaucgacuccuuccagagcuucaacaccuccaacauccacuucaccgacgagcgcaucgaguggcgggacccggacggcaugcugcgcgaccacauuaauaucgucaucagcaaggacauugacuucgagaaccuggcggagaaccccugcaagguggggcuccaggccgccaacaucgagggggccuggggcuccggggugggcuucacccugacgugccaggucagccugaccgagugucccaccuucuuaaccuccaucaaggccugcgacauggcgaucugcuacggggccgagagcgugacgcugucccggggucagaacaccgugcgcaucacaggcaagggcgggcacagcgggucuagcuucaaaugcugccauggcaaggagugcuccagcaccggccugcaggccuccgcgccccaccucgacaaggucaaugggaucagcgagcuggagaacgagaagguguacgacgacggcgccccggagugcggggugacgugcugguucaagaaguccggcgagugggucauggggaucaucaauggcaacuggguggugcugaucguccucugcgugcugcuccuauucagccugauccugcucagcauccugugccccgugcggaagcacaagaaguccuga

SEQ ID NO: 15165 - RNA, 3402 nt, Artificial Sequence
  derived and/or modified CDS sequence (opt11) from SEOV(L99)__AF035833.1__GP
auguggagccuccugcuacucgccgcccucguaggucaaggguucgcacucaaaaacgucuucgacaugagaauacaaugcccccacuccguaaauuucggcgagacauccguauccggcuacacagaacuuccgccccucagccugcaagaggcagaacaacucguaccugaaucaagcugcaacauggacaaccaccaaagccucucgaccauuaacaaacuaacaaaaguaguauggcggaagaaagccaaccaagaacucgccaaccaaaacucguucgaagucgucgaaucagaagucagcuucaaaggacuauguaugcuaaaacaccgcaugguugaagagucuuaccgaaaccggcgauccguuaucugcuacgaucucgccugcaacagcaccuucugcaaaccgaccgucuacaugaucgucccuauucacgccugcaacaugaugaaauccugcuuaauaggacucggcccuuaucgaauccaaguagucuaugaaagaaccuacugcaccacuggcauucucaccgaaggcaaaugcuucguaccagacaaggcaguggugagcgccuuaaaacgaggcauguacgccaucgcaucgaucgaaaccaucugcuuuuucauacaccagaaaggcaacacauacaaaaucguaacagccaucacgucugcaaugggcagcaaauguaacaacacugauacgaaaguccaaggcuacuacaucugcaucaucggaggcaacuccgccccaguguacgccccugcgggcgaagacuuccgcgcaauggaggucuucuccggcaucaucaccucaccccauggcgaagaccaugaucuaccaggcgaagaaauugccacauaccagauauccggccaaaucgaagccaagaucccacacacagucuccaguaaaaaucuaaaauuaauagccuucgccggcauccccaguuacuccucaaccuccauccuagccgcaagcgaagauggacgcuucaucuucucccccggccucuucccaaaccucaaccagucugucugugacaacaacgcccuuccccucaucuggagaggcuugaucgacuugacaggauacuacgaggccguacaccccugcaacguauucuguguccucucuggaccuggugccaguugcgaggcauucuccgaaggcgggauauucaacaucaccuccccuaugugccugguuaguaagcagaacagauuucgagccgcagaacaacagaucuccuucauaugccagcgcgucgauauggauauaaucgucuauugcaacggccagaaaaagacaauccuuacgaagacccuagucaucggccaaugcauauacaccaucacaagccucuucagccuucuaccgggaguagcccauagcaucgcaauugagcucugcgugcccggcuuccacggaugggccaccgccgcccuccucaucacauucugcuucgguuggguccuuauucccgccugcacacucgcaauccuucuaguacucaaguucuucgccaauauccuccacacauccaaccaagaaaaucgcuucaaagccauccuccgcaaaaucaaagaggaguucgaaaagacaaaggggucgauggucugugagauaugcaaauacgaaugcgaaacccucaaggagcucaaggcgcacaaccuuuccugcguccaaggugaaugucccuacugcuucacccacugcgaaccgaccgaaacagccauacaggcccacuacaaagugugccaagccacccaccgcuuccgggaagaccucaagaaaaccguuaccccuaaaaacaucggucccggaugcuaccgaacccucaaccuuuuucgcuacaagucccgauguuacauccucaccauguggacucuucugcugauuauagaaucaauacucugggccgccucagccgcagaaaucccucucgucccacucuggacagauaacgcccauggagucggaucaguaccgaugcacacagaccuagaacucgacuucagccugcccagcuccucaaaauacacuuacaagcggcaccucacaaacccuguaaacgaccaacaauccguaagccuccacauagaaauagaaucccaaggaauuggcgcagacguucaccaccugggacacugguacgacgcacgccucaaccuaaaaacguccuuccauugcuacggugccugcacaaaauaccaguaccccuggcauacggcaaaaugccacuucgagaaggacuacgaguacgagaacagcugggccugcaacccucccgacugccccggcguaggcaccggcugcaccgccugcggccucuaccucgaccaacugaaacccgucggcaccgccuucaaaaucauauccguccgcuacuccaggaaggucugcgugcaauucggggaagaauaccuaugcaaaaccaucgauaugaacgacugcuucguaacccgccaugccaagauuugcaucaucggcacagucuccaaauucucccaaggcgacacacuucucuuucucgggccaauggaaggaggcgggaucaucuucaaacacuggugcacuucaacuugccacuucggggacccaggcgacguaauggggccaaaggacaagccuuuuucaugccccgaguuccccggucaauuucgcaagaaaugcaacuuugccacuaccccaaucugcgaauacgaugguaacauaauauccggcuacaagaaaguucucgccaccaucgauucuuuccagucauuuaacaccagcaacauucacuucaccgacgaacgcauagaauggcgggauccagacggcaugcugagggaccacauaaacaucguuauaucaaaagacaucgacuucgaaaaccuugccgaaaaccccugcaaagucggacuacaggccgccaacauagaaggugccuggggaagcggcguuggauuuacacugacaugccaaguuagccucaccgaaugcccaaccuuccucacaagcaucaaagcaugcgacauggcaaucugcuacggcgcugaguccguaacacugucgcguggccaaaacaccgucagaaucaccggcaaaggcggccacuccggauccuccuuuaaaugcugccacgguaaagagugcuccuccaccggucuccaggcaagcgcuccacaccucgacaaagucaacgggaucagcgaacucgaaaacgaaaaagucuaugacgacggugccccagagugcggcguaacaugcugguucaagaaaucaggcgagugggucauggguaucaucaacggcaacuggguuguccuaauaguacugugcguacuccuauuauucucgcuuauccugcuauccauccugugccccguucgcaaacacaagaaaagcuaa

SEQ ID NO: 15166 - RNA, 3402 nt, Artificial Sequence
  derived and/or modified CDS sequence (opt11) from SEOV(Z37)__AF187081.1__GP
auguggagccugcuccugcuggccgcccucgugggccagggguucgcauuaaagaacgucuucgacaugcgcauccagugcccccacagcgugaacuuuggcgagacuagcguguccggguacaccgagcugccgccccucagccugcaggaggccgagcagcuggucccagaguccagcugcaacauggacaaccaccagucccucagcaccauaaacaagcugacaaaagugaucuggcgaaagaaggccaaccaggaguccgccaaccagaacagcuucgagguggucgaauccgaggugagcuucaagggccugugcaugcucaaacaccgcaugguggaggaguccuaccggaaccgccggagcgucaucugcuacgacuuagccugcaacagcaccuucugcaagcccaccguguacaugaucgugccgauccacgcgugcaacaugaugaaguccugccugaucgggcucggccccuaccgcauccaggucguguacgagcggaccuacugcaccaccggcauccugaccgaggggaagugcuucgugcccgacaaggccgucgugagcgcccugaagcggggcauguacgccaucgcgagcaucgagacgaucugcuucuucauccaccagaaggguaacaaguacaagauagugaccgccaucaccuccgccaugggcagcaaaugcaacaauaccgacacgaagguccagggguacuacaucuguaucaucggcggcaacagcgcccccguguacgcaccggcgggggaggacuuccgggccauggagguguucuccggcauuaucacuagcccccacggggaggaccacgaccuccccggcgaggagaucgccaccuaucagaucuccggccagaucgaggccaagaucccccacaccgucagcuccaagaaccugaagcugacggccuucgcggggaucccgagcuacuccagcaccuccauccucgccgccagcgaggacggccgcuucaucuucucccccgggcuguucccuaaccugaaccagagcgugugcgacaacaacgcccucccccugaucuggcggggccugaucgaccucaccggguacuacgaggccgugcacccgugcaacgucuucugcgugcuguccggccccggcgcgagcugcgaggccuucuccgagggcgggaucuucaacaucaccagccccaugugccuggucuccaaacagauccgcuuccgggccgccgagcagcagaucagcuucaucugccagcgcguggacauggacaucaucguguacugcaacgggcagaagaagacgaucuuaaccaagacccugguuaucggccagugcaucuauacaaucacgucccuguucagccucuuacccgggguggcccacagcaucgcgauagagcugugcgugccgggcuuccacggcugggccaccgccgcccuccugaucaccuucugcuucggguggguccugauccccgcgugcacccucgccauccugcuggugcucaaguucuucgccaacauccugcacacguccaaccaagagaaccgguucaaggcuauccugcgcaagaucaaggaggaguucgagaagaccaagggcagcauggugugcgagaucugcaaguacgagugcgagacccucaaggagcugaaggcccacaaccuguccugcguccagggggagugccccuacugcuucacccacugcgagcccacggagaccgcgauccaggcccacuacaaggugugccaggccacccaccgguuccgcgaggaccucaagaaaacugugacgccccagaacaucggcccggggugcuaccggacccugaaccucuuccgcuacaagagccggugcuacauccugaccauguggacccuccugcugaucaucgaguccauccucugggccgccagcgcggccgaaaucccccuggucccccuguggaccgacaacgcccacggcgugggcuccgugccgaugcacacggaccucgagcuggacuucagccugcccuccagcuccaaguauaccuacaagcgccaccucacgaaccccgucaacgaccagcagagcgugucccugcacaucgagaucgagagccaggggaucggcgccgacgugcaccaccuggggcacugguacgacgcccgccucaaccucaagaccuccuuccacugcuacggcgcgugcacgaaauaccaguauccauggcacaccgccaagugccacuucgagaaggacuacgaguacgagaacagcugggccugcaacccgcccgacugccccggcgucgggaccggcugcaccgccugcgggcuguaccucgaccagcugaagcccgugggcacggcguucaagaucaucuccgugcgguacagccgcaaggucugcgugcaguucggggaggaauaccugugcaagaccaucgacaugaacgacugcuucgugacccggcacgccaagaucugcaucaucggcacggucagcaaauucagucagggggacacgcuccuguuccuagggcccauggagggcgggggcaucaucuucaagcacuggugcaccagcacgugccacuucggggaccccggcgacgugaugggccccaaagacaagccguucaucugcccggaguuccccggacaguuccgcaaaaagugcaacuucgccaccacccccgugugcgaguacgacggcaacaucaucuccggguacaagaagguccucgccacaaucgacagcuuccaguccuucaacaccagcaacauccacuucaccgacgagcggaucgaguggcgcgacccggacggcaugcugcgggaccauaucaacaucgugaucuccaaggacaucgacuucgagaaccuggccgagaaccccugcaaggugggguugcaggcugccaacaucgagggcgccuggggcagcggugucggcuucacgcugaccugccaggugucgcugaccgagugccccaccuuccucacgagcaucaaggccugcgacauggccauuugcuacggggcggaguccgugacccugagccgcggccagaacaccgucaagaucaccgggaagggcgggcacuccgggagcuccuucaagugcugccacggcaaggagugcagcuccacgggguugcaggcgagcacgccccaccucgacaaggugaacggcaucuccgagcucgagaacgagaagguguacgacgacggcgccccggaaugcgggaucacgugcugguucaagaaguccggcgagugggucauggggaucaucaacggcaacuggguggugcugaucguccucugcgugcugcugcuguucagcuugauccugcucagcauccugugccccgugcggaagcacaagaaguccuga

SEQ ID NO: 15167 - RNA, 3402 nt, Artificial Sequence; identical to SEQ ID NO: 11881
  derived and/or modified CDS sequence (opt11) from SEOV(Z37)__AF190119.1__GP

SEQ ID NO: 15168 - RNA, 3402 nt, Artificial Sequence
  derived and/or modified CDS sequence (opt11) from SEOV__M34882.1__GP
auguggagccugcuccugcuggccgcccucgugggccagggguucgcccugaagaacgucuucgacaugcgcauccagcugccccacagcgugaacuucggcgagaccaguguguccggguacaccgaguucccgccccucagccugcaggaggccgagcagcugguccccgaguccagcugcaacauggacaaccaccagagccucagcaccauuaacaagcugaccaaggugaucuggcgaaagaaggccaaccaggaguccgccaaccagaacagcuucgagguggucgaguccgaggugagcuucaagggccugugcaugcucaagcaccgcaugguggaggaguccuaccggaaccgccggagcgucaucugcuacgaccucgccugcaacuccaccuucugcaagcccaccguguacaugaucgugccgauccacgcgugcaacaugaugaaguccugucugaucggacucggccccuaucgcauccaggucguguacgagcggacguacugcaccaccggcauccugaccgaggggaagugcuucgugcccgacaaggccgucgugagcgcccugaagcgcggcauguacgccaucgccagcaucgagacgaucugcuucuucauccaccagaaggggaacaccuacaaaaucgugaccgccaucaccuccgccaugggcagcaagugcaacaacacggacaccaagguccagggcuacuacaucugcaucaucggcggcaacagcgcccccguguacgccccggcgggggaggacuuccgggccauggagguguucuccggcaucaucaccagcccccacggggaggaccacgaccuccccggcgaggaaaucgccaccuaccagaucuccggccagaucgaggccaagaucccucacacggucagcuccaagaaccugaagcugaccgccuucgcggggaucccgagcuacuccagcaccuccauccucgccgccagcgaggacggccgcuucaucuucucccccgggcuguuccccaaccugaaccagagcgugugcgacaacaacgccuuaccccugaucuggcggggccugauagaccucaccggguacuacgaggccgugcacccgugcaacgucuucugcgugcuguccggccccggcgcgagcugcgaggcuuucagugagggugggaucuucaacaucacgagccccaugugccugguauccaagcagaaccgcuuccgggccgccgaacagcagaucagcuucgugugccagcgcguggacauggacaucaucgucuacugcaacgggcagaagaagaccauucucaccaagacccuggugaucggccagugcauauacacgaucaccucccuguucagccuccugcccgggguggcccacagcaucgcgaucgagcugugcgugccgggcuuccacggcugggccaccgccgcccuccugaucaccuucugcuucgggugggugcugauccccgcgugcacgcucgccauccugcuggugcucaaguucuucgccaacauccugcacaccuccaaccaggagaaccgguucaaggccauccugcgcaagaucaaggaggaguucgagaagaccaagggcagcauggucugcgagaucugcaaguacgagugcgagacccucaaggagcugaaggcccacaaccuguccugcgugcagggggagugccccuacugcuucacgcacugcgagcccaccgagaccgccauccaggcacacuacaaggugugccaggccacccaccgguuccgcgaggaccucaagaagacggucaccccgcagaacaucggccccgggugcuaccggacccugaaccuguuccgcuacaagagccggugcuacauccugaccauguggacccuccuacugaucaucgaguccauccucugggccgccagcgcggccgagaucccccucgugccccuguggacggacaacgcccacggcgugggcuccgucccgaugcacaccgaccucgagcuggacuucagccugcccuccagcuccaaguacaccuacaagcgccacuuaaccaacccggugaacgaccagcagagcgugucccugcacaucgagaucgagagccaggggaucggcgccgccguccaccaccuggggcacugguacgacgcgcgccucaaucugaagacguccuuccacugcuacggcgccugcaccaaguaccaguacccauggcacaccgccaagugccacuucgagaaggacuacgaguacgagaacagcugggccugcaauccgcccgacugccccggcgugggaaccggcugcacggcgugcgggcuguaccucgaccagcugaagcccgugggcaccgccuucaagauuaucucaguccgguauagccgcaaggugugcgugcaguucggggaggagcaccugugcaagaccaucgacaugaacgacugcuucgucacccggcacgccaaaaucuguaucaucggcacggugagcaaguucucccagggcgacacccuccuguuccuggggcccauggagggcggcgggaucaucuuuaagcauuggugcaccagcacgugccacuucggggaccccggggacgugauggggccgaaggacaagccguucaucugccccgaguucccugggcaguuccgcaagaagugcaacuucgccaccacccccguaugcgaguacgacggcaacaucaucuccggguacaagaaggugcucgccacuaucgacagcuuccaguccuucaacaccagcaacauccacuucacggacgagcggaucgaguggcgcgacccggacggaaugcugcgggaccacaucaacaucgugauauccaaggacaucgauuucgagaaccuggcggagaaccccugcaagguagggcuccaggccgccaacaucgagggcgccuggggcagcggggugggcuucacccugaccugcaaggugucccugaccgagugccccacguuccucaccagcaucaaggcaugcgacauggcgaucugcuacggcgcggaguccguaacccugagccgcggccagaacaccgugaagaucacggggaagggcggccacuccgggucuuccuucaagugcugccacggcaaggagugcagcaguaccgggcugcaggccagcgcgccccaccucgacaaggugaacggcaucucagagcuagagaacgagaaggucuacgacgacggcgccccagagugcgggaucacgugcugguucaagaaguccggcgagugggugauggggaucaucaauggcaacugggugguccugaucgugcucugcgugcugcuccuguucagccugauccugcucagcauccugugccccguccggaagcacaagaaguccuga

SEQ ID NO: 15169 - RNA, 3423 nt, Artificial Sequence
  derived and/or modified CDS sequence (opt11) from SNV(NM H10)__NC_005215.1__GP
auggugggcugggucuguaucuuccugguggugcucaccaccgccacggccgggcugacccgcaaccuguacgagcucaagauugaaugcccucauacugucggacuggggcaaggguaugucaccgggucaguggagaucacgccuauccugcucacccagguggcggaccucaagaucgaguccagcuguaauuucgaccuucacgugccggccaccaccacgcagaaguacaaccagguggacuggaccaaaaagucuagcaccaccgaguccaccaacgccggcgccaccaccuucgaggcaaagacuaaggagaucaaccucaaaggcacgugcaacaucccgcccaccaccuuugaggcggccuauaagagcaggaagaccgucaucugcuacgacuuggccugcaaucagacgcauugccugcccaccgugcaccucaucgccccuguacagacaugcauguccguacgcagcugcaugaucgggcuacuguccagcagaauccaggugaucuacgagaagacauacugcguaaccggccagcuaaucgagggccugugcuucauccccacccacacuauagcucugacccagccuggccacacguacgacacaaugacacuccccgugacaugcuuccugguggcaaagaagcuggggacgcagcucaagcuggccgucgagcuagagaagcucaucaccggugucucuugcaccgagaacagcuuccagggcuacuacauauguuucaucggcaagcauuccgagccccuuuucgugccgaccauggaggacuaccguagcgccgagcuguucacgaggauggugcucaacccccgcggcgaggaccacgacccggaccagaaugggcagggccugaugcggauugccggacccgucacagcgaaaguuccauccacugagaccaccgagacuaugcaggggaucgccuucgccggagcucccauguacucuuccuucagcacacuggugcggaaggcggaccccgaguacgucuucuccccaggaaucaucgcagagagcaaccauagcgugugcgacaagaagaccgucccccucaccuggacgggcuucuuagccgugaguggagaaaucgagaagaucacgggcugcaccguauucugcacccuggccggcccaggggccagcugugaggccuacuccgaaacggguaucuuuaacaucagcucgccuacgugccucgucaacaaagugcagaaguuccgagggucugagcaaagaaucaacuucaugugccagcggguagaucaggacgucguggucuacugcaacggacagaagaagguuaucuuaaccaaaaccuuagucauuggucaguguaucuacacguucacaucccuauucagccugauucccggcguggcgcacucccuggccgucgagcucugcgugcccggccuucacgggugggccaccaccgcacugcucaucacguucuguuucggcuggcugcugauccccgccgugaccuuaaucauccugaagauccucaggcuccugacauucagcugcucccauuauagcaccgaaucuaaguucaaggucauccuggagcgggugaagguggaguaccaaaagacgauggggagcauggugugcgacaucugccaucacgaaugcgaaaccgcgaaagagcuugaaacccacaagaaguccugcccggaaggccaaugcccguacugcaugaccauaacagagagcaccgaguccgcccuccaggcccacuucgccauuugcaaauugaccaaccgcuuccaagagaaucugaagaagucccugaagcgccccgaggugcgcaaggggugcuaccggacccugggcguguuccgguacaaaagccggugcuacgucggccugguuugggggauccuccugacgaccgagcuuaucaucugggcggccagcgccgauacuccucucauggagucuggcugguccgacacggcccacggggugggcaucaucccgaugaagaccgaccuggagcuggacuuugcccucgcgagcuccagcuccuacagcuaccgccggaagcucgucaaccccgccaaccaggaggaaaccuugcccuuccacuuccaacucgacaagcaggucgugcacgccgagauccagaacuugggccauuggauggacgggaccuucaacaucaagacagcauuccacugcuacggcgagugcaagaaguacgccuacccguggcaaacggcuaagugcuucuucgaaaaggacuaccaguacgagaccuccugggggugcaacccgcccgacugccccggcgucgggaccggcugcaccgccugcggcguguaccuggacaaacugcguagcguggggaaggccuacaagauugucucccuaaaguacacccgcaaggugugcauccaguuaggcacugagcaaaccugcaagcacaucgaugugaaugacugucuagucacccccucugugaagguuugcaugaucgggaccaucuccaaguuacagcccggcgacacgcuccuauuccuggguccccuggagcagggcggcaucauccucaagcaauggugcaccaccagcugugucuucggggaccccggcgacauuauguccaccacgagcgggaugcggugcccggagcacaccggcuccuuccgcaaaaucugcggguuugccaccacacccacgugcgaguaccaaggcaacacugugucgggcuuccagcggaugauggccacccgcgacuccuuccaaaguuuuaacgugacagagccccacaucacgagcaaccgccuggaguggaucgaucccgacuccagcaucaaggaccacaucaauaugguccucaacagggacguguccuuccaggaccucagcgacaauccgugcaagguggaccuacacacccaguccaucgauggagccuggggcagcggagucggcuuuacccugguuugcaccguggggcucacggagugcgcuaauuucaucacaucaaucaaggcuugcgacagcgcgaugugcuacggcgcgaccgucaccaaccugcugcgaggcucuaacacggugaagguagucgggaaaggcgggcacaguggaucccuguucaaaugcugccacgacaccgauugcacagaggagggccuugcugcgagcccgccccaccuggaccgggugaccgguuacaaccagaucgacucagacaagguguacgacgacggugccccucccugcacgaucaaaugcugguucaccaagagcggggagugguugcugggcauccugaacgguaauugggucguggucgccgugcucauagugauccugauccugucuauccucuuguucagcuucuucugccccguccggagccgcaagaacaaagcgaacuga

SEQ ID NO: 15170 - RNA, 3423 nt, Artificial Sequence
  derived and/or modified CDS sequence (opt11) from SNV(1)__JQ690283.1__GP
auggucggcugggucugcauuuuccuuguugucuuaaccaccgccaccgccgggcucacccgcaaccuuuaugaguugaagauugaaugcccccacaccguaggccuaggccaaggcuacgucacuggcuccgucgaaaccacccccauacuucucacccaaguagcggaccuuaaaauugagagcuccugcaacuucgaccuucacguacccgcaacuaccacacaaaaauacaaucaagucgauuggaccaagaaaucuucaacuaccgaauccacaaacgcaggcgccgccacauucgaagcaaaaacaaaagaggucaaccuaaagggcacguguaacauaccaccaaccacauucgaagcagcauacaaaucccguaaaacugucaucugcuacgaccuagcgugcaaccaaacucauugccuccccaccguccaccuaauagcccccguccaaacaugcauguccguacgaagcugcaugaucggccuccucaguagccguauacaaguaaucuacgagaaaaccuacugcguaaccggacaacucauagaaggacucuguuucauccccacccacacgauagcccuuacccaaccaggccacaccuacgacacuaugacccucccaguaaccugcuuccuuguagcuaaaaagcugggcacacaacucaaacuggcagucgaacuggaaaaauugaucaccggcgucuccugcacggaaaacucauuucagggauacuacaucugcuucaucggcaaacauucugagccacuguuuguucccaccauggaggacuacagaagcgcagaauuguuuacacgaaugguccucaacccacguggcgaagaccacgacccggaccagaacggacagggucuaaugcgcaucgcgggccccgucaccgcuaaaguucccucuacggagaccaccgaaacgaugcaaggcaucgcauucgcgggcgcccccauguauuccuccuuuaguacccucgucaggaaagcagauccagaguaugucuucucgcccggcaucaucgcagagagcaaccacagcguuugcgacaagaaaaccgugccacucacauggaccgguuuccuagccgucuccggagagaucgagcgcauaacaggaugcacaguauucuguacccuggcgggacccggcgcaagcugcgaagcguacuccgaaacuggcauauuuaacauauccagcccgacgugccuagucaacaaaguucaaaaauuccgcggcuccgaacaacgcaucaacuucaugugccaacgcguggaccaagacgucguugucuacugcaauggacaaaagaaagucauccucaccaaaacccuugucaucggacaaugcaucuacacguucaccagccuuuucagccugaucccgggagucgcgcacucccuagccguugagcucugcguccccggucuacacggcugggccacaaccgcccuccucaucaccuuuugcuucggcuggcuacucauccccaccguuacacuaaucauccuaaaagugcuccgacuucucaccuucuccugcucccacuacucaacggagucaaaauucaaaguaauccucgagagagucaagguagaauaucagaaaacaaugggcuccaugguaugcgacauaugccaccacgaaugcgaaacagcaaaagaacuggaaacacacaaaaagagcugccccgaaggccaaugccccuacugcaugacgaucaccgaauccaccgaaucagcacuacaagcccacuuuuccaucugcaagcucaccaauagauuccaagaaaaucuaaagaaaucucucaagcgcccagaggugcgaaagggaugcuacaggaccuuaggcguuuuucgcuacaaaucccgcugcuauguuggacuggucuggggcauccucuuaacaacagaacugauaauuugggcagccucugccgacacgccgcucauggaaagcggcuggucagacaccgcccacggcguaggcaucauuccuaugaaaacugaccuugagcucgacuucgcccuugcguccucuagcagcuacuccuaccgcagaaagcuggucaacccagccaaccaagaagagacucuccccuuccacuuccaacuggacaaacaagugguucacgcggaaauacaaaaccucggacacuggauggacggaaccuuuaauauuaaaaccgccuuccauugcuacggcgaguguaagaaauacgcauacccauggcaaacagccaaaugcuucuucgaaaaagauuaccaauacgaaaccucauggggaugcaaucccccagacugccccgguguuggcacaggcugcaccgccugcggaguuuaccucgacaaacuaagaucagugggaaaagccuacaagaucgucucacuuaaauacacacgaaagguaugcauccaacucggaacggagcaaacuugcaagcacaucgacgucaacgacugccuagucacgccaucaguaaaagucugcaugaucgggacuaucuccaaacuccaacccggagacacccuucucuuccucggaccucucgagcaagggggcaucauacucaaacaguggugcacuacaaguugcgucuucggagaccccggcgacaucaugucgaccacaagcggcaugcgcugcccagaacauaccggcuccuuccgcaaaaucugcggauuugcaacuacaccgaccugcgaguaucaaggaaauacaguauccggcuuccaacgcaugauggcaacucgcgacucauuccaaucuuucaacguaacagaaccccacauaaccuccaaccggcucgaguggaucgacccugacucguccaucaaagaccacauaaacaugguccucaacagagauguuagcuuccaagaccuuuccgauaauccaugcaaagucgaucuccacacccagucaauagauggagccuggggcuccggugucggauucacccucguauguaccgucggccucaccgaaugcgccaacuuuaucaccucuaucaaagccugcgacucggccaugugcuacggcgccaccgucacgaaccuccugcgcggcuccaacaccgucaaggugguaggaaaaggcggacacagcggcagccuauucaaaugcugccacgacaccgacugcaccgaagagggccuagcugcgucaccaccccaccuagaccgcgucaccggcuacaaccaaauugacucagacaaggucuacgaugacggcgccccacccugcaccauaaaaugcugguucacaaaaucaggcgaauggcuacucggcauccucaacggcaacuggguagucgucgccguccuaauagucauacucaucuuauccauauuacuuuucucauucuucugccccguucgaaaccgcaagaauaaagccaacuaa

SEQ ID NO: 15171 - RNA, 3423 nt, Artificial Sequence
  derived and/or modified CDS sequence (opt11) from SNV(1)__JQ690279.1__GP
auggugggcugggucugcaucuuccuaguggugcuaaccaccgccacggcugggcugacccgcaaccuguacgagcucaaaauugagugcccacacaccgugggccucgggcaaggcuacgugaccgggucuguggagacgacacccauucugcucacccaggucgcagaccugaaaaucgaguccagcugcaacuucgaccugcacguucccgccaccacgacccagaaguacaaccagguggauuggaccaagaaguccagcaccacggaguccaccaacgccggcgccaauaccuuugaggccaagaccaaggagaucaacuuaaagggcacgugcaacauaccacccacgaccuucgaggcagccuacaagagccggaagaccgucaucugcuacgaccuggcuugcaaccagacgcacugccugcccaccgugcaccucaucgcccccguccagaccugcaugucaguccgcagcugcaugaucgggcuacuguccagccggauccaggucaucuacgagaagaccuacugcgugacaggccagcuuaucgaggggcugugcuucauccccacccacacaauagcgcugacccagcccggccacacguacgacaccaugacacucccggugaccugcuuccugguggccaaaaagcuggggacgcagcucaagcuagccguggagcuggagaaacucaucaccggcguuuccugcaccgagaacagcuuccagggcuacuacaucugcuucaucgggaagcacuccgagccccuguucgugccuaccauggaggacuaccgcucggccgagcuuuucacgcggauggugcucaauccccgcggcgaagaccacgacccggaucagaaugggcagggccugaugcggaucgccggccccgugaccgcgaaggugcccuccaccgagaccaccgagacgaugcaggggaucgccuuugccggcgcccccauguauagcuccuucagcacccuggugcgcaaggccgaccccgaguacgucuucuccccugggaucaucgcagagagcaaccacagcgugugcgacaagaaaaccgucccccucaccuggacgggcuuccuggccguguccggggagaucgagcggaucaccggcugcaccguguucugcacgcuggccggccccggagcuagcugcgaggccuacuccgagacgggcaucuucaacaucagcucuccgaccugucucgucaauaaagugcaaaaguuccgcgguagcgagcagcggaucaacuucaugugucagcgcguggaccaggacgucguggucuacugcaacggccagaagaaggucauccugaccaaaacacuggugaucggucagugcaucuacacguucaccucccucuucagccugauccccggcguggcgcacucccuggccgucgagcucugcgugcccggccuucacggaugggccaccaccgcucugcucaucacauucugcuucggcuggcugcugauccccaccgugacccuccucauauuaaagauacuccggcugcugaccuucagcugcucccacuauagcacggaguccaaguucaaggucauccuggagcgcgugaagguagaguaccagaagaccauggggagcauggucugcgacaucugucaucacgagugcgagacugccaaggagcuggaaacucacaagaagucuugcccggagggccagugccccuacugcaugacgaucaccgagagcaccgaguccgcgcugcaggcccacuuuagcaucugcaagcugaccaaccgguuccaagagaaccucaagaagucccugaaacgacccgaagugaagaaggguugcuaccggacgcugggcguguuccgcuacaagagccguugcuacgucggccucgugugggggauccugcugaccaccgaacucaucaucugggccgccucugcggacacgccccugauggaguccggcuggagcgacaccgcccacggggugggcaucauaccgaugaaguccgaccuggagcucgacuucgcccuggccagcucguccuccuacagcuaccgccggaaguuggucaaccccgccaaccaggaggagacccuccccuuccacuuccagcuggacaagcaggucgugcacgcggagauccagaaccugggccacuggauggaugggaccuucaacaucaagaccgccuuccacugcuacggggagugcaaaaaguacgcuuacccguggcagaccgccaaaugcuucuucgagaaggacuaccaguacgagaccuccugggggugcaacccgcccgacugccccggcgucgggaccggcuguaccgccugcggcguguaccucgacaagcugcgcagcguggggaaggcguacaagaucgucucccugaaguacacucgcaagguuuguauccagcuuggcacggagcagaccugcaagcacaucgacgugaacgacugccuggucacccccagcgugaagguuugcaugauagggaccaucuccaagcugcagcccggcgacacgcuccuguuccuggguccccucgaacagggcggcaucauucugaagcaguggugcaccaccagcugcgucuucggggaccccggcgacaucauguccaccacuagcgggaugcggugcccggagcacaccggcuccuuccgcaagaucugcggguucgccaccaccccuacgugcgaguaccagggcaacaccgugagcggcuuccaacggaugauggccacccgcgacagcuuccaguccuucaacgugaccgagccccacaucacgagcaaccggcuggaauggauagaccccgacuccucaaucaaggaccacaucaacaugauccucaaccgcgacgucuccuuccaggaccugagcgacaacccgugcaagguggaccugcacacccaguccaucgacggggccuggggcagcggggugggcuucacccucgucugcaccgugggguugacggagugcgccaacuucaucaccuccaucaaggcgugcgacagcgccaugugcuacggcgccaccgugaccaaucugcuccggggcucgaacacggucaaggugguggggaaaggcgggcacagcggcucccuguucaagugcugccacgacaccgacugcaccgaggagggccuggccgcuagcccgccccaccucgaccgcgucaccggguacaaccagaucgacuccgacaaaguguacgacgacggcgccccacccugcacgauaaagugcugguucaccaagagcggggaguggcugcugggcauccucaacggcaacuggguugucguugccguccugaucgugauccugauccucaguauucuguuguucagcuucuucugccccgugcggucccgcaagaacaaggccaacuga

SEQ ID NO: 15172 - RNA, 3423 nt, Artificial Sequence
  derived and/or modified CDS sequence (opt11) from SNV(2)__JQ690284.1__GP
auggugggcugggucugcauauuccucgugguccuuaccacggccacugccggccucacacgcaaccucuacgaacuuaaaauagagugcccccauaccgucggccuagggcaaggcuacgucaccggcuccgucgaaaccacacccauucuacucacccaagucgcugaccugaagauagagucaucaugcaacuucgaccuccacguacccgccacaacaacccagaaauacaaccagguagacuggacaaagaaaggauccacgacagaguccaccaaugccggcgcgaauaccuucgaagccaaaacaaaagaagucaaccucaaagguaccugcaacauucccccaaccacauuugaggcagccuacaaaucacgaaaaaccgucaucugcuaugaccuugccugcaaucaaacgcacugcuuacccacgguccaccugaucgcccccguccaaaccugcauguccguacgaucaugcaugaucggcuugcucucaagucgaauccaaguaauauaugagaaaacguacugugucaccggacaacuuauugaaggacuaugcuucauacccacccacacuauagcgcucacccagcccggccacacauacgacaccaugacccuaccaguaaccugcuuccucgucgccaaaaagcuaggaacccaacucaaacuagcagucgaacucgaaaaacucauaacaggcgucuccugcacagaaaacuccuuccaaggcuacuacaucugcuucauaggcaaacacucagaaccccuauucguccccaccauggaagacuacagauccgcugaagucuucacccgaaugguacucaacccccgaggugaggaccaugacccagaccaaaacggccaaggacucaugcguaucgcaggaccaguaacagccaaaguacccagcacagaaacgaccgaaaccaugcagggcaucgccuucgcaggcgcccccauguacucauccuucucaacccuagugcggaaggcugacccagaguacguauucaguccaggcaucaucgccgaaagcaaccauuccgucugcgacaagaaaacgguaccccuaaccuggaccggcuuccucgccgucuccggcgaaauugaacgcaucacagggugcacgguuuucugcacacuugccgguccaggcgcguccugcgaagcauauuccgaaacaggcauauuuaauaucucaucaccaaccugccuagucaacaaaguccaaaaauuccgaggguccgaacaacgcauaaacuucaugugucagcgcgucgaccaggacguagucgucuacugcaauggccaaaagaaaguuauccucaccaaaacccucguaauuggucaaugcauauacaccuucaccucccuguucucccucauccccgggguagcucacucccucgccguugaacucugcguccccggcuugcacgggugggcaacgaccgcccugcuaaucaccuucugcuucggauggcuacucaucccuaccguaacucucaucauacuaaaaauccugcgucuccuuacauucucaugcucccacuacucgacagaguccaaauucaaaguaauccuugaacgcgucaaagucgaauaccagaaaacuauggguagcaugguaugcgacaucugccaccacgaaugcgaaaccgcuaaagaacuagagacccauaagaaaagcugccccgaaggccaaugcccuuacugcaugaccaucacagaaagcaccgaaucugcacuccaagcccauuucucaaucugcaaacuuaccaaccgauuccaagagaacuugaagaaaagccuaaaacgccccgaagucaagaaaggauguuauagaacacuaggcgucuuucgcuacaaaucacgcuguuacguuggccucguauggggaauccuccugaccacagagcuaaucauuugggccgcgagcgcggacacuccccucauggagagcggcugguccgacaccgcccacgggguaggaaucaucccaaugaaaaccgaccucgaacuagacuuugcccuggcguccagcuccagcuacucauaccgacgcaaacuggugaacccagcuaaccaagaggaaacgcuaccguuccauuuccaacuagacaaacaaguaguacaugcugaaauccaaaaucuaggucacuggauggaugggacauuuaauaucaagacagccuuccacugcuacggcgaauguaagaaauacgcauaccccuggcagacggcuaaaugcuucuucgaaaaagacuaccaauacgagaccuccuggggaugcaacccacccgauugccccggagucggaacaggaugcacugcguguggaguguaccuugauaaacuccgaagcguaggcaaagccuauaaaauaguaagccucaaauauacacgcaaaguaugcauccaacuuggaacagagcaaacaugcaaacacaucgacgucaacgauugcuuaguaacccccuccgucaaaguuugcaugaucggaacuauuagcaaguugcaacccggagacacgcuacucuuccuaggcccccuugaacaaggcggcaucauccucaaacaauggugcaccaccagcugcgucuucggcgaccccggagacaucaugaguacaaccuccggcaugagguguccagaacacacagguuccuuccgcaagauuugcggauucgcaacaacaccaaccugcgaauaccaagggaacacagucucuggcuuccagcgcaugauggcgacccgagacuccuuccaaucauucaacgucacggaaccccacauaaccuccaacagacucgaauggauagacccggacucguccaucaaagaccacauaaacaugguacuaaaccgugacgucuccuuccaggaccuauccgauaacccgugcaaaguagaccuccacacacaaagcaucgacggugcaugggguuccggcgucggcuucacgcuagucugcacaguuggucuuacugagugcgccaauuucaucaccuccauaaaagcgugcgacuccgccaugugcuacggcgccacagucaccaaccuccuacguggauccaacacugucaaagucgucggaaaaggcggccacucagguucccuauucaaaugcugccacgacacugacuguacagaggaaggacuagcagcaagcccaccccaccuagaccgugugacaggcuacaaccaaauagauuccgacaaaguauacgaugacggggccccacccuguaccaucaagugcugguucacuaaauccggggaauggcuucuggguaucuuaaacgggaacugggucguaguagccguccucaucguaauccuaauacucucaauucuccuauuuaguuucuuuugcccaguccgaucaagaaagaacaaagccaacuaa

SEQ ID NO: 15173 - RNA, 3423 nt, Artificial Sequence
  derived and/or modified CDS sequence (opt11) from SNV(2)__JQ690280.1__GP
auggucggcugggucugcauauuccuagucguacugacaaccgcaacagcaggccucacccguaaccucuaugaacugaagauagaaugcccacacaccgugggacuaggccaaggauacguaaccggcuccgucgaaaccacgcccauuuuacucacacaaguagcggaccuaaaaaucgaaucuucguguaauuuugaccuucacgugccggccacgacaacccaaaaauacaaccagguagacuggaccaagaaaucaagcaccaccgaauccacgaacgcuggagccaacacuuucgaggccaaaaccaaagaagucaaccuaaagggcacgugcaacauacccccaacuaccuucgaagccgcauacaaaucacggaagacagucaucuguuaugaccuagcuugcaaucaaacccacugccuacccacaguccaccugaucgccccaguccaaacuuguauguccguccgcuccugcaugauuggauuacucuccuccagaauacaagucaucuacgagaaaaccuacugcguuaccggacagcucauugaaggccucugcuucaucccaacacauacaauagcgcucacacagccaggacacaccuacgacaccaugacccugcccguaaccugcuuccuuguagccaagaagcugggcacacaacucaagcuagcaguagaacuagaaaaacucaucaccggcgucucuugcaccgaaaacuccuuccaaggcuacuacaucugcuuuauaggaaagcacuccgaaccacuguucgucccaaccauggaagacuaccgauccgccgaacuauuuacccgcauggucuugaacccccguggcgaagaccacgaccccgaccaaaacggccaaggccuaaugcgcauagcgggcccgguaaccgccaagguacccucaacggaaaccacagaaaccaugcagggcaucgcauuugccggagcccccauguacucgagcuucuccacacuuguccgcaaagccgacccagaauacguguucucaccugggauuauagccgaaucaaaucacucgguaugcgauaagaaaacuguuccccucacauggacaggcuuccucgcggucagcggcgaaaucgagcgaauaaccggaugcaccguauucugcacacuugccggccccggggccucuugcgaggcauauucggagacugguaucuucaacaucagcagcccgaccugccugguaaacaaaguccaaaaauuccgcggguccgagcagcgaauaaauuucaugugucaacgaguugaccaggacguagucgucuacugcaacggccaaaagaaaguuauacucacgaaaacacuggucaucggacaaugcauauauaccuucacaucacucuuuucgcuaaucccuggcgucgcacacucccuagccguagaacuuugcgugccaggacuacauggcugggcgacaacugcccuacucauuaccuucugcuucggcuggcuacuaauacccaccguaacccuaauaaucuuaaaaauccugcgccugcuaacauucuccugcagucauuacuccacagaauccaaauucaaagucauccuggaacgcguaaaaguugaguaccagaaaacgaugggcagcauggucugcgacauaugccaccacgagugcgaaacagccaaagaacuagaaacccacaagaaaucaugccccgaaggccagugccccuacugcaugacgaucaccgaaucuacagagagugcccuccaagcucauuucucgaucugcaaacucaccaaccguuuccaagagaaccuuaagaaaucccuuaaaagacccgaagugaagaaaggcugcuaccgcacccucggcguauuccgcuacaaaucgcggugcuacgugggcuuaguauggggcauccuccuaaccaccgaacucaucauaugggccgccuccgcagacacuccccucauggaauccggauggucagacaccgcacauggggucgggauaauccccaugaagaccgaccuugaacuagauuucgcucuugcguccuccuccucauacagcuaccgacgcaaauuggucaaucccgccaaccaagaagaaacccuacccuuucacuuccaacuagacaagcaaguaguacacgccgaaauacaaaaccugggccacuggauggacggaaccuucaacauaaaaaccgcauuccauugcuacggcgaaugcaagaaauacgcauacccauggcagaccgcaaaaugcuucuucgaaaaagacuaccaauacgaaaccuccuggggauguaauccacccgacugucccggcgucggaacaggaugcaccgcguguggcguauaccuggacaaacucagauccguaggcaaagcauacaaaauaguauccuugaaauacacacggaaagucugcauccaacuaggcacagaacaaacaugcaaacacaucgacgucaacgacugccucguuaccccaucugugaaaguaugcaugaucggaaccaucagcaaacuacagcccggugacacccuccuauuccugggcccccuagagcaaggcggaauaauacucaaacaauggugcacuacaucuugcguauucggagaucccggcgacaucaugucgaccaccuccgguaugcgaugccccgaacacacaggcuccuucagaaaaauaugcggcuucgcuaccacccccacaugcgaauaccaaggaaauacggucagcggcuuccaaagaaugauggcaacacgcgacagcuuccaaucauucaacguaacugaaccccacaucaccuccaaccgauuagaauggaucgaucccgacuccucuauaaaagaccacauaaacaugguacuaaaucgagacgucuccuuccaagaccucuccgacaacccauguaaggucgaucuccacacccaaucaauugacggggcaugggguagcggagucggcuucacccucgucuguacagucggcuuaaccgaaugcgccaacuuuauaaccucgaucaaagccugcgacucggccaugugcuacggcgcaaccguuacuaaccugcuacgcggcucaaacacagugaaaguaguagggaaaggcggccacagcggaucccuuuuuaaaugcugucaugacaccgacugcacggaggagggccuggcagccucucccccucaccucgaccgcgucaccggcuacaaccaaauagacuccgacaaaguauacgaugacggcgcgcccccuugcacaaucaagugcugguuuacaaaauccggggaauggcuacuaggaauccugaauggcaacugggucguggucgccguccuaauugucauccuuauccuaagcauacuacuauucagcuucuucugccccguacgcuccagaaagaacaaagccaacuaa

SEQ ID NO: 15174 - RNA, 3423 nt, Artificial Sequence
  derived and/or modified CDS sequence (opt11) from SNV(CC107/POR)__KT885045.1__GP
auggugggcugggucuguaucuuccugguggugcucaccaccgccacggccggucugacccgcaaccuguacgagcucaagaucgagugcccccacaccgucggccugggacagggcuacgugaccggcucgguagagacgacccccauccugcucacccaggucgcggaccugaagaucgaguccagcugcaacuucgaccugcacgugcccgccaccacgacccagaaguacaaccagguggacuggaccaagaaguccagcaccacggaguccaccaacgccggcgccaccaccuucgaggcaaagacgaaggaggucaaccucaaggggaccugcaacauuccgcccaccaccuucgaggcggcuuacaagagccggaagacggugaucugcuacgaccuggccugcaaccagacccacugccugccaaccgugcaccucaucgcccccguccagaccugcauguccgugcgcagcugcaugaucggccugcuguccagccggauccaggucaucuacgagaagacguacugcgucaccggccaacucaucgaggggcugugcuucauccccacccacaccaucgcgcugacgcagcccggccacaccuacgacaccaugacccucccggugacgugcuuccugguggccaagaagcuggggacccagcucaagcuggccgucgagcuggagaagcucaucaccggcguguccuguaccgaaaacucauuccagggcuacuacaucugcuucaucgggaagcacuccgagccccuguucgugcccacgauggaggacuaccgcagcgcugagcuguucacccggaugguccucaacccccgcggcgaggaccacgacccggaccagaacggccagggccugaugcggaucgccggccccgugaccgcgaaggugcccuccaccgagaccacggagaccaugcaggggaucgccuucgccggcgcccccauguacagcucguucagcacccugguccgcaaggccgacccggaguauguguucucccccgguaucaucgcggagagcaaccacagcgucugcgacaagaagaccgugccccucacguggacgggguuccuggccguguccggggagaucgaacgcaucaccggcugcaccguguucugcacgcuggccggccccggggccuccugcgaggccuacuccgagaccggcaucuucaacaucagcuccccgaccugccucgugaacaaggugcagaaguuccgcgggagcgagcagcggaucaacuucaugugccagcgcguggaccaggacguggucgucuacugcaacggccagaagaaggugauucugaccaagacgcuggucaucggucaguguaucuacaccuucaccucccucuucagcuuaauacccggcgucgcgcacucccuggccguggagcucugcgugcccggccuucacgggugggccaccacggcccuguugaucaccuucugcuucggcuggcugcugauccccaccgucacccucaucauccugaagauccuacggcuccugacguucagcugcucccacuacagcaccgaguccaaguucaaggugauccuggagcgcgugaaggucgaguaccagaagaccauggggagcauggugugcgacaucugccaucacgagugcgagaccgccaaggagcuggagacgcacaagaaguccugcccggagggccagugccccuacugcaugaccaucaccgagagcaccgaguccgcgcuccaagcccacuucagcaucugcaaacuuacgaaccgguuucaggagaaccugaagaagucccucaagcgccccgaggugcggaaggggugcuaccgcacccucggugucuuucgguacaagagccgcuguuacgugggccuggugugggggauccuccugaccaccgagcugaucaucugggcugccagcgcggauacgccccucauggaguccggcuggucggacaccgcccacggggucggcaucgugccgaugaagaccgaccuggagcuggacuucgcccucgccuccagcuccagcuacuccuaccggcgcaagcuggugaaccccgccaaccaggaggagacccuucccuuccacuuccagcucgacaagcagguagugcacgcggagauccagaaccuaggccacuggauggacgggacguucaacaucaagaccgccuuccacugcuacggcgagugcaagaaguacgccuauccguggcagaccgccaagugcuucuucgagaaggacuaccaguacgagaccagcugggggugcaacccgcccgacugccccggcguggggaccggcugcacggccugcggcgucuaccuggacaagcuccgcuccguggggaaggcguacaagaucgugagccugaaguacacccggaaggucugcauccagcugggcaccgagcagaccugcaagcacaucgacgugaacgacugccucgugacgccaagcgucaaggugugcaugaucgggaccaucagcaagcugcagccuggcgacacccuccuguuccuggggccccuggagcagggcggcaucauccucaagcaguggugcaccacguccugcguguucggggaccccggcgacaucaugagcaccaccuccgggaugcgcugcccggagcacaccggcagcuuucggaagaucugcggguucgccacgacaccgaccugcgaguaccagggcaacaccgucuccggcuuccagcgcaugauggccacacgggacagcuuccagagcuuuaacgugaccgagccccacaucaccuccaaccgccuggaguggaucgaccccgacagcuccaucaaggaccacaucaacauggugcugaaccgagacgucagcuuccaggaccucuccgacaaccccugcaagguggaccugcacacccagagcaucgacggggccuggggcaguggggugggcuucacgcuggucugcaccguggggcucaccgagugcgccaacuucaucaccagcaucaaagccugcgacucggccaugugcuacggcgccacggugaccaaccugcugcgcggcagcaacaccgucaaggugguggggaagggcgggcacuccggcagccucuuuaagugcugccacgacaccgacugcacggaggagggcuuggccgccuccccgccccaccuggaccgggucaccggguacaaccagaucgacagcgacaagguguacgacgacggcgccccgcccugcaccaucaagugcugguucaccaaguccggggaguggcuccugggcauccugaacgggaacugggucgugguggccguccucaucgugauccugauccugagcauccuccuguucuccuucuucugccccgugcgcaaccggaagaacaaggccaacuga

SEQ ID NO: 15175 - RNA, 3423 nt, Artificial Sequence
  derived and/or modified CDS sequence (opt11) from HPS(Convict Creek 107)__L33474.1__GP
auggucggcugggucugcauauuucucgucguccucaccaccgccacagcaggacucacccgaaaccucuaugagcucaaaaucgaaugcccacacaccguagggcucggacaaggcuaugucacaggguccgucgaaaccacccccauacuacucacccaagucgcagaccucaaaauugaaagcuccugcaacuucgacuuacacgucccagcaacaaccacccagaaauacaaccaagucgacuggaccaaaaagagcuccacaaccgaauccacaaacgccggcgcgacgaccuucgaagccaaaacaaaagaagucaaccucaaagggaccugcaacauacccccuacaaccuucgaagcggccuacaagucccggaaaacagucaucuguuacgacuuagccugcaaccaaacacacugucucccaacuguacaccucaucgcgcccguccaaaccugcaugucugugcgcuccugcaugauaggccugcucuccagccgcauacagguaaucuacgagaaaaccuacugcguaacgggccaacucaucgaaggacugugcuuuauaccaacccacaccaucgcccucacccagccaggccacaccuaugacacaaugacccuccccguuaccugcuuucuagucgccaagaaacuaggcacccaacuaaagcuagccgucgaacuggagaaacucaucaccggcguaagcugcaccgaaaacuccuuccagggauacuacauaugcuuuaucggaaaacacuccgagccccucuucguacccaccauggaggacuaucgauccgcagaacucuucaccaggaugguccucaauccucgaggagaagaccacgaccccgaccaaaacggucaaggccucaugcggaucgccggcccgguaacugcaaaaguaccaagcaccgagacuacagaaacaaugcaaggcauagcauuugcaggggcacccauguacagcucauucagcacacucguccgcaaagcagaccccgaauauguguucucacccggcauaauagccgaauccaaccacuccgucugcgacaagaaaaccgucccccucacauggacgggcuuccuugcaguguccggcgaaaucgagaggaucacaggcugcaccguguucuguacacuugcaggccccggcgcgucaugcgaagccuacuccgaaaccggcaucuucaauauuucuaguccaaccugcuuaguaaacaaaguucaaaaguuuagaggcucagaacaacgcaucaacuucaugugccaacgaguggaccaggacgucgucguauacugcaacggccagaagaaagucauacucacgaaaacucucgucaucggccaaugcauuuacaccuucacaucacucuucucgcuaauacccggaguagcccacucccuagccguagaacuaugcguccccggacuccacggcugggccacaaccgcccugcuuauaaccuucugcuucggcuggcuacucauacccaccgucacccuaauaauuuuaaagauccuccgccuccucacuuucagcugcagccacuauagcacagaaaguaaauucaaaguaauucuagaacgggucaaggucgaauaucagaaaacuaugggcucaaugguuugcgauaucugccaccaugaaugcgagaccgcgaaggaacucgaaacccacaagaaaucgugcccagaaggucaaugcccauacugcaugaccaucaccgagucuaccgagucggcccuucaagcacacuucucaaucugcaaacugacgaaucguuuccaagaaauucuuaagaaaucacucaaacgcccagaaguacgcaaaggaugcuaccgcacccucggggucuuccgcuacaaaucucguugcuacguuggccuaguauggggcauucuauuaacuaccgagcuuaucauuugggcagccuccgcagacacaccucucauggaauccggauggagcgacaccgcccacggagucgguauaguccccaugaaaacagaccucgaacuugacuuugcauuagcaagcuccucaagcuacuccuaccgccgcaaacuugucaaccccgccaaccaggaagaaacccuacccuuccacuuccaacucgacaaacaaguugugcacgcagagauucaaaaccuaggacacuggauggacggcaccuuuaacauaaaaacggccuuccacuguuacggagaaugcaagaaauacgccuaccccuggcaaacagccaaaugcuucuucgaaaaggacuaccaauaugaaacuucauggggaugcaacccgcccgacugcccagggguaggcacagguugcacagccugcgguguauaccucgacaagcuacgcucggucggaaaggccuauaaaaucgucucccuaaaguacacacgcaaagucugcauccaacuaggcacggaacaaacguguaaacacaucgacgucaacgacugccugguaaccccauccgucaaaguaugcaugaucggcaccaucucaaaauuacagcccggcgacacucuccuuuucuuaggaccccuggaacagggaggaaucauccuaaagcaauggugcacaacuucuugcgucuucggcgacccgggagacauaaugagcacaacaagcggcaugcgaugcccggaacacacaggcucguuccgaaaaaucugcggauucgccaccacaccuaccugugaauaccaaggcaacacgguaucaggcuuccagaggaugauggcaacccgcgacucauuccaauccuuuaauguuacagagccgcacaucaccucgaaccgccucgaguggaucgacccugacucgucaaucaaagaucacaucaacaugguucucaaccgagacguauccuuccaagaccuuuccgacaaccccuguaaaguagaccuccacacccaguccaucgacggcgccuggggcucggggguuggcuucacccucgucugcaccguaggccucaccgaaugugcaaacuuuaucacaucaauuaaagccugugacucugccaugugcuauggcgccacagucaccaaccucuuacgaggcucaaacacagucaaagucgucggcaaaggcggacacagcggaucauuguucaaauguugccacgacacugacuguaccgaagaagggcuggcagccucaccuccccaccuggaccggguaaccggauauaaccaaaucgauucagacaaggucuacgaugauggcgcacccccaugcacaauuaaaugcugguucacgcgguccggcgaauggcuacucggcauacucaacggaaauuggguugucguagccguacucauagucauccuaauacucuccauacuucuauucuccuucuucugcccuguccgcaaccguaaaaacaaggcgaacuaa

SEQ ID NO: 15176 - RNA, 3423 nt, Artificial Sequence
  derived and/or modified CDS sequence (opt11) from HPS(Convict Creek 74)__L33684.1__GP
auggucggcuggguaugcauauucuugguagugcuaacaacugccacagccggcuugacaagaaaccuauacgaacugaagaucgaaugcccgcacaccgucggacugggccaaggcuacguaacaggaucaguagaaacaacaccaauccuauuaacucaaguagccgaccuaaaaaucgaaagcuccuguaacuucgaucugcacguacccgcgacgaccacccaaaaguauaaucaagucgacuggaccaagaaauccagcaccaccgaaagcacgaacgccggcgccaccaccuuugaagccaaaacaaaagagguuaaccucaaaggaaccugcaauauaccucccaccacauucgaagcugcauucaagucccgaaaaaccgucauaugcuaugaccuggcaugcaaucagacccacugccucccgaccguucaccuaauugcuccgguacaaacaugcauguccguccgcucgugcaugaucggccuccucagcucuagaauacaagucaucuacgagaaaacguacugugucacaggccaacucauagaaggacugugcuucauacccacacacacaaucgcacucacgcagcccggucacaccuacgacaccaugacguuacccguaacuugcuuccucgucgccaaaaagcugggaacucagcucaaauuagccgucgaacuagaaaaacucauaacgggcgucucuugcacugaaaacucauuccaaggcuacuacaucuguuucauagguaagcacuccgaaccacucuucgugccuaccauggaagacuacagaucggccgaauuauucacgcggaugguccucaacccccguggugaagaccacgacccugaccagaacggccaaggccuaaugaggaucgcaggcccaguaaccgcuaaaguacccagcaccgagaccaccgaaaccaugcagggcauugcauucgccggagcccccauguacucaucuuucagcacccucguccgcaaagcagaccccgaguacguauucucgcccggaauuaucgccgaaagcaaccacuccgucugcgauaagaaaaccguaccgcucacauggaccggcuuccuugcggucuccggagaaauagaacgaaucacaggcugcacagucuucuguacccucgcaggcccgggcgccagcugcgaagcguacagcgagaccggcaucuucaacauuucaucuccaaccugccuugugaacaaaguccaaaaauuccgcggcucagagcaaagaaucaacuucaugugccaacgagucgaccaggacgucguaguauacugcaacggacaaaagaaagucauccugaccaaaacccuaguaauaggccaaugcauuuacacauucacaucuuuguucagccucaucccuggcguagcucacucgcuugcgguugagcuuugcgucccaggccuacacggcugggccacaacugcacuacucauaaccuucugcuuugggugguugcugauacccaccgucacucucaucauucuuaaaauccuacgccuacucacuuucagcugcucacacuacuccaccgaauccaaauucaaaguaauucuggaacgcguuaaaguagaauaccagaaaacgaugggaagcaugguuugcgacaucugccaccacgaaugcgagaccgccaaggaacucgaaacucacaaaaagagcugcccggagggccaaugccccuacuguaugacaauaaccgaaagcacggaaucagcccuucaggcucacuucucaauaugcaagcucaccaaccgauuucaagagauacucaagaaaagccuaaaacgucccgaaguacgcaaaggcugcuaucguacucucggcguauuccgguacaaaucgcgcugcuauguuggccuaguauggggcauccuccucacaacagaacuaaucaucugggccgcuuccgcggacacgccccuuauggaauccggguggucagauaccgcccacggagugggaaucguccccaugaaaacagaccucgagcuagauuucgcucuagcguccuccuccucauacucguacagaaggaagcuagucaaccccgcaaaccaagaagagacacucccguuccacuuucaacucgacaaacaaguagugcacgccgagauacaaaaccuaggccacuggauggacggcaccuucaacaucaagaccgcauuccacugcuacggggagugcaagaaauacgccuacccauggcagacagcaaaaugcuucuucgaaaaagacuaccaauacgaaaccagcuggggcugcaacccaccagacugccccggcgucggcacaggaugcacagcaugcggagucuacuuagacaaacuccgaagcgugggcaaagcauacaaaaucgucucacucaaauacacccguaaagucugcauacaacucggcacagaacagacgugcaaacacaucgacgucaacgacugccuggucacccccuccguaaaagugugcaugauaggaaccaucucaaaauuacaacccggugacacccuccucuuccuugguccacucgaacaagguggcauuauccuaaaacaaugguguaccaccuccugcguauuuggcgacccgggagauaucaugagcaccacuucaggcaugcgcugccccgaacacacuggcagcuuccgcaaaaucuguggauucgccaccacaccgaccugcgaauaccaaggaaacacagucucaggauuccagcgaaugauggccaccagagacuccuuccaauccuucaacgucacggaaccacacaucacgucaaacaggcuagaguggaucgacccagacagcucaaucaaagaccacauuaacaugguacucaaucgugacgucagcuuccaagaucucucagauaacccgugcaaaguagaucuacacacucaaagcauagauggagcuugggguagcggcguaggauuuacccuuguauguaccgucggcuuaacagaaugcgcgaacuucaucaccuccauaaaggcgugcgacuccgcaaugugcuacggggcgaccgugacaaaccuccuccgcgguaguaauaccgugaaggucgucggcaagggcggccauucuggcagucuuuucaaaugcugccacgacaccgacuguacagaggaaggccucgcagccuccccuccccauuuagaccggguaacaggcuacaaccagaucgacuccgacaaagucuacgacgacggcgccccucccuguacaaucaaaugcugguuuaccaaaucaggcgaguggcuacuagguauauuaaacggcaacuggguagucgucgcaguccucaucguaauacugauccucucaauccuccuuuucucauucuucugccccgucaggaaccgcaaaaacaaagcaaacuag

SEQ ID NO: 15177 - RNA, 3423 nt, Artificial Sequence
  derived and/or modified CDS sequence (opt11) from BRV(Indiana)__AF030551.1__GP
auggugggcuggguaugcaucuuccuggugguccuaaccaccgccacggccgggcugacccgcaaccuguacgagcucaagauugagugcccccacaccgucggcuuggggcagggcuacguuacugggagcguggagaccacccccgucccccugggacaggugaccgaucucaagaucgaguccagcugcaacuucgaccugcacgugcccuccaccacgauccagaaguauaaccaggucgagugggcgaagaaaaccuccacaaccgaguccacgaacgccggagccagcacguucgaggcaaagaccaaggaggugaaccuaaaagggaccugcaacauccccgucacuaccuucgaggccgcguacaagucccggaaaaccgucaucugcuacgaccuggccugcaaccagacccacugccugccgacggugcaucugaucgcccccgugcagacaugcaugagcguucgcuccugcaugaucggccuccugagcucgcggauccacgugaucuacgagaagaccuacugcgugaccgggcaagugguagagggccugugcuuuauccccacgcauaccauagcacucacccagccggggcacaccuacgacacgaugacccuaccgauuaccugcuuucuaguagccaagaagcucggcacucagcugaagaucgcgguagaacuggagaagcucaucacggccaguggcugcaccgagaacuccuuccagggguacuacaucuguuucuugggcaagcauagcgagccccuguacguccccaccauggacgacuaccgcucagcugaacuguucacccggauggugcucaaccccaagggggaggaccacgauccggaccaagacggccagggccugaugcgcaucacggggcccaucaccgccaagguccccagcaccgagaccaccgagacgaugcagggcguggcauucgcugggacccccauguacagcuccuucuccacccuccuccggaaggccgacccggaguacgucuucucucccggcaucaucccagagagcaaccacuccgugugcgacaagaagaccaugcccaucacguggacuggguuccuggccgugagcggcgagaucgagaagaucaccggcuguaccgucuucugcacccucgccggcccgggcgcuuccugcgaagccuacagugaaaccgggaucuucaacaucuccagcccgaccugccuggugaauaaggugcagaaguuccgaggcuccgagcagcgggucaacuucaugugccagaggguggaccaggacguugucguauacugcaacgggcagaagaaggugauccuuacaaaaacacucguaaucggccagugcaucuacaccuucaccagccuguucucccugcuccccggcguggcccacagccuggccguggaacugugcguccccgggcuccacggaugggcuaccacggcacugcugaucaccuucugcuucggguggcugcugauccccuccgugacacugauuauccuccggauccugcgccugcucaccuuuuccugcucccacuacagcacggagucuaaguucaagauccugcuggagaaggugaaggucgaguaucagaaaaccaugggcagcauggugugcgacaucugccaucacgagugugagaccgccaaggagcuggauacccaccggaaguccugccccgaggggcagugucccuacugcaugacgaugaccgaguccaccgaguccgccuuacaagcccacuuuaguguaugcaagcugaccaaccgcuuccaggagaacuuaaagaagagucucaagcaccccgaggucaagcaaggcugcuaccggacguugggcguguuccgcuacaaguccagguguuacguggggcugguauggggcauccuccugaccgccgaacucaucaucugggcggccagcgccgagaccccgcucauggagagcggguggagcgacaccgcccacggugugggaaucgugcccaugaagacggaccuggagcuggacuucgcgcucgccucuagcuccagcuauuccuaucgccggaagcucgucaacccagccaacuccgaagagaccuuaccguuucaucuccaguuggagaagcaggucgugcacgccgagauccacaaucuggggcacuggauggacggcacauucaacaucaagaccgccuuccacuguuauggggaaugcaagaaguacgcguaucccuggcagacugcgaagugcuucuucgagaaggacuaucaguacgagaccucguggggcugcaacccgcccgacugccccggaguaggcaccggcuggaccgccugcggcgucuaccucgacaaacugcgcagcgugggcaaggccuacaagaucgucucccugaaguacacccgcaagguauguauucagcucgggacggagcagacuugcaagcacaucgacgugaaugauugccuggucacccccagcgugaaaguuugcaugaucggcaccgucuccaagcugcagccaggggacacgcuccuguucuugggcccccucgaacaggguggaaucauccugaaacaguggugcaccaccagcugcguguucggcgauccgggggacauaauguccaccaccagcggaaugaagugccccgagcacaccgggagcuuccgcaagaucugcggcuuugcgaccacccccacgugcgaguaccagggcaacaccguguccgguuucaagcgcaugauggcgacccgagacagcuuccaguccuuuaaugucaccgagccccacaucacgucaaaccgccuggaguggaucgacccggacuccagcaucaaggaucacauaaacgugguguuaaaccgggacgucuccuuccaggacuuaagcgacaaccccuguaagguggaccugcacacccagucaaucgacggcgccuggggaagcggcgugggguucacccucgucugcaccgucggccugacggagugcgccaacuucaucaccuccauuaaagccugcgaccuggccaugugcuacggcgcaaccgugaccaaucuccugcgggggagcaacacggucaagguugucggcaaaggcgggcacuccggcagccuguucaagugcugccaugacaccgacuguaccgacgaaggguuggccgccuccccgccccaccuggaccgggugaccggcuucaaccagaucgacagugacaagguguacgacgacggggccccgcccuguagcgucaaguguugguucacaaagagcggcgaauggcugcuccgcauccugaacgggaacuggauggugguggcgguccugaucgucauccucauccucuccauccuccuuuucagcuucuucugccccauccgaucccgcaagucaaagccaaacuaa

SEQ ID NO: 15178 - RNA, 3423 nt, Artificial Sequence
  derived and/or modified CDS sequence (opt11) from BRV(Oklahoma)__AF030552.1__GP
auggucggauggguauguauauuccucguaguccuaacaaccucaacugccggccucacccgaaaccuguaugaacuaaagaucgaauguccacacaccgucgggcucggccaaggcuacguuacuggauccgucgaaaucaccccaguaccccuuggacaaguuaccgaccuaaagaucgaaucauccugcaauuucgaccuccacguccccucaacaaccauacaaaaguacacacagguagagugggccaagaaaucguccacaaccgaaagcacaaacgcugccgccaccacauucgaagccaaaaccaaagaaguuagccuaaaaggcacuugcaacauccccguuaccacguucgaagccgccuacaaaucacggaaaaccgucaucugcuaugaccucgccugcaaccaaacucacugcuuaccaacaguacaccucauagcgccuguucagacuuguaugucaguucgaucauguauggucgggcuccucucaucccgaauacaaguuaucuacgagaaaaccuacugcgucacaggucaacucguagaaggccucugcuuuauccccacccacacgauagcccucacccaaccgggccacaccuacgacacaaugaccuuacccaucacgugcuuucuagucgcaaagaaacucggcacgcagcugaaaaucgccgucgaacucgaaaaacucauaacagcguccggcugcacugaaaacagcuuccaaggauacuacaucugcuuccuaggcaaacacagcgagcccauguacguaccgacuauggacgacuaucgauccgcagaacucuucaccagaaugguucuaaaucccaaaggcgaagaccaugacccagaccagaacggccagggacuuaugcguauagccggacccaucaccgcaaaaguccccagcacagaaacaacagaaacaaugcaaggcaucgccuucgccggugcgcccauguacuccacauucgccacucuuguccgcaaagccgacccugaauacguauuuucaccuggaauaauaccggaaagcaaccacucggugugugauaagaaaaccaugccaaucaccuggaccggcuuccuagcacucuccggugaaaucgaaagaauaacuggguguaccguauucugcacccucgcaggccccggugccuccugcgaagccuacuccgagacaggcauuuucaacauauccucgccgacaugccuagucaacaaaguccagaaauuccgcggcucagaacaacgcaucaacuucaugugccagcgaguugaccaggaugucgucguguacugcaacggccagaagaaaguuauucucaccaaaacucuugucaucggacaaugcaucuacaccuucacgucacuguuuucccuucucccaggcgucgcacacucgcucgccguagagcuaugcguaccagguuuacacggcugggcuaccaccgcccugcuuauuacauucugcuuuggauggcuccugaucccagcaaucacccugauaguacucaaaauacuacgccuccuaaccuucuccugcucgcacuacuccaaagaaucgcgguucaaaauacuucucgaaaaaguaaaaguagaauaccagaaaacaaugggauccauggugugcgacaucugccaccacgauugcgagacggccaaagaacucgacacccacaaaaagagcugccccgagggacaaugcccguacuguaugacgaugaccgaaucaacugaaucugcccuccaagcccacuucuccguaugcaaacucaccaaccgguuucaggaaaaccuuaagaagucccucaaacaccccgaaguaaagcaaggcugcuacaggacacucggcgucuuccgauacaaauccagaugcuacguagggcuaguauggggucuuuuacucaccaccgagcuuauaaucugggcagccucagccgaaaccccgcuaauggaaagcggcuggucugacaccgcccacggcguugggaucguaccuaugagaaccgaccucgagcuggacuucgcccucgcauccucaucaagcuacagcuaccgccgcaagcuagucaacccugcaaacacagaagaaacccucccuuuucaccuccaacuagagaaacaagucguccacgcagaaauacaaaaccuuggccacuggauggacggaaccuuuaacaucaaaaccgccuuccacugcuacggcgaaugcaagaaauacgcguaccccuggcaaacugcaaagugcuucuuugagaaagacuaucaauacgaaacaagcuggggcugcaauccgcccgacugccccggaguaggcacgggcugcacagcaugcggaguauaucucgacaaacuccgcagcguuggaaaagccuacaagaucgucucuuugaaauacaccaggaaagucugcauccagcuuggcacagaacagaccugcaaacauaucgaugucaacgacugcuuagugucccccuccgucaaggucugcaugaucggcaccgugagcaaacugcaacccggugacacccuacucuuucugggcccacuggaacaaggcggcauaauacucaaacaaugguguaccaccaguugcguauucggcgacccaggugacauaaugucaacaaccucaggcaugcgcugcccggaacauaccggcagcuuccgcaaaauaugcggcuucgccaccacaccuacaugcgaauaccaaggcaacaccauuucuggauucaaacgaaugauggcgacucgcgacucauuccagagcuucaaugucacagaaccccacauaaccagcaaccgccucgaguggaucgacccagacucuuccaucaaagaccauaucaacgucguucuaaaccgcgacgucuccuuccaagaccucucggacaacccauacaaggucgaccugcauacccaaucuaucgacggcgccuggggcucaggcgucggauucacgcucguauguauagucggccuaaccgaaugcgcgaacuucauaaccuccaucaaagccugcgacauggccaugugcuacggcgcaaccgucacaaaccuccuacgcggcaguaauaccguaaaaguugucgguaagggcggccacucaggcucacuuuucaaguguugccacgacacagacugcacggaagaaggccuagcagcuuccccaccccauuuagaucgagugacgggcuacaaccaaaucgacucagacaaagugugugaugacggagcgccccucugcagcgucaagugcugguucaccaaaucaggcgaauggcuacucgggauccucaacggaaacuggauggucgucgcaguccuggucgugauucucauacuuagcauccuucuauucuccuucuucugccccauucgcagcaaaaaguccaaacccaacuga

SEQ ID NO: 15179 - RNA, 3399 nt, Artificial Sequence; identical to SEQ ID NO: 11893
  derived and/or modified CDS sequence (opt11) from THAIV(Thai749)__L08756.1__GP

SEQ ID NO: 15180 - RNA, 3426 nt, Artificial Sequence
  derived and/or modified CDS sequence (opt11) from TULV(Moravia/5302v/95)__NC_005228.1__GP
auguucugccuuugccuuagccuccugggccuccuacuaugcuggcccgcggccaccagaaaccuccucgaacucaaagucgaaugcccacacaccauaggacuaggccaagguauagugauuggguccgcagaacuacccccagucccccucgcgaaaguagaaucccugaaacucgagagcucguguaacuucgaccuccacaccuccacagcagcacagcaagcguucacaaagugguccugggaaaagaaagcggauaccgccgaaaacgccaaagccgcuagcaccaccuuccaguccucaaguaaagagguacaacuacgagggcucugcguaauaccaacccuuguucuagaaacagccagccgcacacgaaaaaccgucacuugcuuugaccuuucaugcaaccaaacaguaugccagcccaccguauaucuuauggccccuauacaaacaugcguaaccacgaaauccugccuccuuggucucggagaucaacguauccaggucguauaugagaaaaccuacugcgucucaggccaacugauagaggggaacugcuucaacccccuccacaccauugcaaucucccaacccacccacacuuacgacaucaugacccucgccguccauugcuucuuuaucagcaagaaagguggcacugacgacacacuaaaaauagaaaaacaauucgagacacuuguugaaaagacuggaugcacagagaaugcgcuaaaagguuacuacgcuugcauccucgguacaagcuccgaaguaguauacguccccgcuauggacgauuaucgaucuuccgaaaucuuaagccgaaugacgacggcaccccauggggaagaccacgacaucgauccaaacgccauaucaucacuucgcaucgucggacaacucacuggcaaggccccaucaaccgagaguuccgauaccguacaaggaauagcguucgccgguacaccccuauacaccagcaccuccauacucguccggaaagaagaccccauuuaccuauggagccccggcauuauaccugagggaaaccacucucaaugcgacaagaaaacacuaccccucacguggacaggcuucaucacacuccccggcgagauugagaaaaccacccaaugcacagucuucugcacccucuccggacccggcgcugacugcgaagccuacucggacacaggcauauucaacauaucgucacccacuugccuaguaaaccguguccagcgcuuccgaggagcagaacaacaggugaaauucgucugccagagaguagaccucgacauaacaguuuacugcaauggcgucaaaaagguaaucuugaccaaaacacucguaauaggacaaugcauuuacaccuucaccuccaucuucucgcucaugccgggcgucgcccacucccucgccgucgaacucugcguccccgggcuccacgguugggcaaccaucucccuccucaucacuuucugcuucgguuggcuggccaucccgcuccuuucuaugauaaucauccgauuccuccuaauauuuacguaccucugcucuaaauacagcaccgacucaaaauuuaagcucaucauagaaaaaguaaaacaagaauaccagaagaccauggguuccaugguaugugaagucugccagcaaggaugcgagaccgccaaagaacucgaaucccacaaaaagagcugcccucauggccaaugucccuacugccuuaaccccacugaagcgacagaaagcgcccuucaagcccacuucaaaguaugcaagcugaccacgcgauuccaagaaaacuugaaaaagagccuguccaccuacgaaccgaaacggggccucuaccgaacccuuucaauguuccgauacaaauccaagugcuauguagggcuaguaugguguauacucuuaaccauggaacuaaucgucugggccgccuccgcagagaccaucaaccuagaacccggcuggaccgacacagcccacggcuccggcaucaucccccucaaaacagaccucgaacuagacuucucccucccaagcuccgcuacauacaccuaccgaagagagcuucaaaaccccgccaacgagcaggagaaaauaccauuccacuuucaaauggaacgccagguuauccacgcagaaauacaacaccugggccacuggauggacggaacauucaaccucaagacagccuuccauugcuacggcagcugcaucaaauacgccuacccauggcagacagccaaaugcuuccuggaaaaggacuucgaguucgaaacuggauggggaugcaauccgcccgacugccccggugucggaaccggcugcaccgcuugcggcgucuaucuagacaaacuacgcucugucgggaaaguauacaaaauacucucccucaaauauacccgcaagguaugcauccaacucggaaccgaacaaacaugcaaaacuauagacagcaacgacugccuaguuaccacgagugucaaagucugcaugaucgguacaauuucuaaauuccaaccaggcgacacacuccucuuccucggaccccuagaagaggguggcaugaucuucaaacaguggugcacaacuaccugccaauucggagaccccggagacaucaugagcacccccuuaggcaugaagugcccagagcaugcaggcuccuuccgcaagaaauguagcuuugccaccuuacccaguugccaauacgaugguaacaccgucuccggauaccaacgaaugauagcgacgaaagacuccuuccaauccuucaacaucaccgaaccccauauaacuacaaacucccucgaauggguagacccagacucuagccuaaaagaccacguuaaucucaucgucaaccgcgaccucucauuccaagaccucgcagaaaaccccugccaaguggaccugucugucaguucaaucgacggagcguggggcaguggcgucggauucaaucuugucugcuccguaucacuaacugaaugcgccaguuuccucaccagcauuaaagcgugcgacucggccaugugcuaugggucgucuaccgcuaauuuaguaagaggccaaaauacaguccacgucgucggaaaaggcggacacuccgggucaaaauucauguguugccacgacaagaagugcagcgccaccggacucguagccgccgcaccccaccucgaccgagugaccgguuauaaccaaauagacacaaacaaagucuucgacgauggugccccacagugcggaguucacuguugguucaagaaaucaggagaguggcuccugggcauccucaguggcaacuggauggucgucgccguucucaucgcccucuuuauauucagccuacuccuauucucccuuugcuguccucgacgccagaacuacaagaaaaacaaauag

SEQ ID NO: 15181 - RNA, 5055 nt, Artificial Sequence
  derived and/or modified CDS sequence (opt11) from CCHFV(10200)__U39455.2__GP
augcacaucagccugauguacgccauccucugccuacagcugugcgggcucggggagacccacggcucccacaacgagacccgccacaacaagacggacacuaugaccacucacggggacaaccccagcucagagccgcccgugagcacggcccuguccaucacgcuggaccccucaaccgugacccccacgaccccggcguccggccucgaggggagcggcgagguguacaccuccccgcccaucaccacgggcagccugccccuguccgagaccacccccgagcuccccgugaccacggggaccgacacccugagcgccggcgacguugaccccuccacccagacggccgggggcaccagcgcucccaccgugcggaccucccugccgaacucacccuccacgcccagcacgccccaggacacccaccacccggugcgcaaccuccuguccgucacuagccccgggcccgacgagaccagcacccccuccggcaccggcaaggagagcuccgccaccaguuccccgcaccccgugagcaaccggccgcccacgccgcccgcgaccgcccaggggcccaccgagaacgacucccacaacgccaccgagcaccccgagagccugacgcaguccgccacccccggccucaugaccagccccacccagaucgugcacccccaguccgcgaccccaaucacgguccaggacacccaccccagccccaccaaccgcuccaagcggaaccugaagauggagaucauccugacccucagccaggggcugaagaaguacuacggcaagauccugcgccuccugcagcugacgcucgaggaggacaccgagggccugcuggaauggugcaagcggaaccucgggcuggacugcgacgacaccuucuuccaaaaacgcauugaggaguucuucaucaccggcgaggggcacuucaaugaggugcugcaguuccggacgccgggcacccucuccaccaccgaaagcacgccggccgggcugcccaccgccgagccauucaaguccuacuucgccaagggcuuucugagcaucgacuccggcuacuacagcgccaagugcuacagcgggaccuccaacagcggccuccagcuaaucaacaucacccgccacuccacgcggaucguggacacacccgggccgaagaucaccaaccugaagaccaucaacugcaucaaccucaaggcuagcaucuucaaggagcaccgcgaggucgagaucaacgugcugcugccccagguggccgucaaccucuccaauugccacgucgugaucaagagccacgucugcgacuacucccuggacaucgacggcgccgugcggcugccccacaucuaccacgaggguguguucauccccggcacguacaagaucgucaucgacaagaagaacaagcucaacgaccgcugcacccuguucacugacugcgugaucaagggccgggagguccgcaaggggcagagcguccugcggcaguacaagaccgagauccgcaucggcaaggccuccacgggguuccggcggcuccugagcgaggagccguccgacgacugcguuagccggacccagcugcuccgcaccgagaccgccgagauccacggcgacaacuacggcgggcccggggacaagaucacgaucugcaacgguucuaccaucgucgaccagcgccugggcagcgagcuggggugcuacaccaucaaccgggugcgcuccuucaagcugugcgagaacagcgcgaccggcaagaacugcgagaucgacuccgugcccgucaagugccggcagggauacugccuccgcaucacgcaggaggggcggggccacgugaagcugagcagggggagcgaggugguccuggacgccugcgacaccuccugcgagaucaugauccccaagggaaccggggacauccucguggacugcagcggcggccagcagcacuuccugaaggacaaucugauugaccucgggugcccgaagaucccccugcugggcaagauggccaucuacaucugucggaugucaaaucaccccaagaccacgauggccuuccucuucugguucagcuucggguacgugaucacgugcauccugugcaaggccaucuucuaccugcucaucaucgucggcacccuggggcgccggcugaagcaguaccgcgagcucaagccccagaccugcaccaucugcgagacuaccccgguaaacgcgaucgacgcagagaugcacgaccugaacugcuccuacaacaucugccccuacugcgccagccggcugaccuccgacggccucgcccgccacgugauccaaugccccaaacggaaggagaaggucgaggagaccgagcuguaccugaaccucgaacgcauccccugggugguccggaagcugcugcaggucagcgaguccacgggcguggcccuuaagcgcagcuccuggcugaucgugcugcucguacuguucaccgugagccuguccccggugcagagcgcgcccaucgggcagggcaagaccaucgaggccuaccgggcccgcgagggguacaccuccaucugccucuucguccugggcagcauccuguucaucgugaguugccucaugaaggggcugguggacuccgucggcaacuccuucuuccccggccugagcaucugcaagacgugcagcaucuccagcauaaauggguucgagaucgagucccacaagugcuacugcagccucuucugcugcccguacugccggcacugcuccaccgacaaggagauccacaagcugcaucuauccaucugcaagaagcgcaaaaccggcuccaacgugaugcucgccgugugcaagcugaugugcuuccgcgcgacgauggaagucagcaaucgugcccuguucauccgcuccaucaucaacacgaccuucgugcucugcauacugauccuggccgugugcgucgugagcaccuccgccguggagauggagaaccuccccgccgggaccugggagcgggaggaggaccugacgaacuucugccaccaggagugccaggucaccgagaccgagugccugugccccuacgaggcgcucgugcugcggaagccccuguuccucgacagcaccgccaagggcaugaagaaccugcugaacucuacgagccucgagacgucccugagcaucgaggccccguggggcgccaucaacgugcaguccaccuacaagcccaccgucagcacggccaacaucgcgcuguccuggagcucuguggagcaccgggggaacaagauccucguguccggccguagcgaguccaucaugaagcuggaggagcggaccgggaucagcugggaccugggcgucgaggacgccuccgaaagcaagcuccugaccguguccgugauggaccugagccagauguacagccccgucuucgaguaccucagcggggaccgccagguggaggaguggcccaaggcgaccugcacgggcgacugcccggagcgguguggcugcacauccagcacgugccugcacaaggaguggccccacucccgcaacuggcggugcaaccccaccuggugcuggggcguggggaccgggugcacgugcugcggucuggacgucaaggaccucuucaccgacuacauguucgugaaguggaagguggaguacaucaagaccgaggccaucgucugcguggagcugaccagccaggaacgacagugcucccugaucgaggccgggacccgguucaaccucggccccgugaccaucacccugagcgagccgcgcaacauccagcagaagcugccgcccgagaucaucacucuccacccccggaucgaggagggcuucuucgaccugaugcacguccagaagguucuguccgccagcacggucugcaagcuccaguccugcacccacggggugcccggggaucuccagguguaccauaucgggaaccugcugaagggcgacaaggucaacgggcaccugauccacaagaucgagccccacuuuaacaccagcuggaugagcugggacgguugcgaccuggacuacuacugcaacaugggcgacuggcccuccugcaccuacacgggggugacccagcacaaccacgccagcuucgugaaucuccugaacaucgagacggacuacacgaagaacuuccauuuccacuccaagcgcgucacggcgcauggcgacacgccccagcuggaccucaaggcccggccgaccuacggggcgggcgagaucaccgugcugguggaggucgccgacauggagcugcacaccaagaagaucgagaucagcgggcucaaguucgccucccuggccugcaccggcugcuacgccugcagcuccagcaucagcugcaaggugcgcauccacguggacgagcccgacgagcugaccguccacgucaagagcgacgaccccgacguggucgcggccuccagcucccucauggcccggaaauuagaguuuggcaccgacagcacguucaaggccuucuccgccaugcccaagaccagccugugcuucuacaucguggagcgcgagcacugcaaauccugcagcgaggaggacaccaagaagugcgugaacaccaagcucgagcagccgcaguccauccugauugagcacaaggggacgaucaucggcaagcagaacuccacgugcaccgcgaaggccagcugcuggcuggagagcgucaagagcuucuucuacgggcugaagaauaugcucuccggcaucuucggcaacguguucauggggaucuuccuguuccuggcccccuucauccuccugauccuguucuucauguucggcuggcggauccucuucugcuucaagugcugccgccgcacccgggggcuguucaaguaccgccaucugaaggacgacgaggagaccggcuaccggcgcaucaucgagaagcucaacaacaagaaggggaagaacaagcuguuggacggcgaacggcucgccgacggccgcaucgccgagcuguucagcaccaagacccacaucggguag

SEQ ID NO: 15182 - RNA, 5055 nt, Artificial Sequence
  derived and/or modified CDS sequence (opt11) from CCHFV(IbAr10200)__AF467768.2__GP
augcauaucagccugauguacgccauccucugccugcagcugugcggccucggggagacccacggcucccacaacgagacccgccacaacaagacggacaccaugacgacccccggggacaacccgagcuccgagccgcccgugagcacggcccugucgaucacccuggaccccagcacagucacccccacgacccccgcguccggccucgagggcucgggcgagguguacaccuccccgcccauuaccaccgggagccugccccuguccgagaccacccccgagcuccccgugaccacggggaccgacacccugagcgccggcgacgucgaccccucaacccagacggccgggggcaccagcgcaccgaccgugcggaccucccugcccaacucucccuccacgcccagcaccccgcaggacacccaccaccccgugcgcaaccuccuguccgucaccagccccgggcccgacgagacgagcaccccgucaggcaccggcaaggagagcuccgccaccagcagcccccaccccgugagcaaccggcccccgacgccgcccgcgaccgcccaggggcccaccgagaacgauucccacaacgccaccgagcaccccgagagccugacgcaguccgccacccccggccucaugaccagccccacccagauagugcacccgcaguccgcgacgcccaucacgguccaggacacccaccccagccccaccaaccgcuccaagcggaaccugaagauggagaucauccugacccucagccaggggcugaagaaguacuacggcaagaucuugcgccuccugcagcugacgcucgaggaagacaccgagggcuugcuggaguggugcaagcggaaucucgggcuggacugcgacgacaccuucuuccagaagcgcauugaggaguucuucaucaccggcgaggggcacuucaaugaggugcugcaguuccggacgccgggcacccucuccaccaccgagagcacgcccgccgggcugcccaccgccgagcccuucaaguccuacuucgcgaagggcuuccuuagcauagacuccggcuacuacagcgccaagugcuacagcgggaccuccaacagcggccuccagcugaucaacaucacccgccacuccacgcggaucguggacaccccggggcccaagaucaccaaccugaagaccauaaacugcaucaaccucaaggcgagcaucuucaaggagcaccgcgaggucgagaucaacgugcugcugccacagguggccgucaaccucuccaacugccacguggugaucaagagccacgucugcgauuacucccuggacaucgacggcgccgugaggcugccccacaucuaccacgaggggguguucaucccgggcacguacaagaucgucaucgacaagaagaacaagcucaacgaccgcugcacccuguucaccgacugcgugauaaagggccgggaggugcgcaaggggcagagcguccugcggcaguacaagaccgagauccgcaucggcaaggccuccacggggagccggcgccuccuguccgaggagcccagcgacgacugcaucucccggacccagcugcuccgaaccgagaccgccgagauccacggcgacaacuacgggggcccuggcgacaagaucacgaucuguaacgggagcaccauuguggaccagcgccugggcuccgagcuggggugcuauaccaucaacagaguccgcucguucaagcugugcgagaacuccgcgaccggcaagaacugcgagaucgacagcgugcccgugaagugccggcagggauacugccuccgcaucacgcaagaggggcggggccaugucaagcugagccgcggguccgagguggugcuggacgccugcgacaccagcugcgagaucaugaucccgaagggcaccggggacaucuuggucgacugcuccggcgggcagcagcacuuccugaaggacaaccugaucgaccucgggugccccaagaucccccugcugggcaagauggccaucuacaucugccguaugagcaaccaccccaagaccacgauggccuuccucuucugguucuccuucggguacgugauaaccugcauccugugcaaggccaucuucuaccugcucaucaucgugggcacccugggaaagcgccugaagcaguaccgugagcucaagccgcagaccugcaccaucugcgaaacgacgcccgucaacgcgaucgacgccgagaugcacgaccugaauugcagcuacaacaucugccccuacugcgccuccagacugaccagcgacggccucgcccggcacgugauccagugccccaagcgcaaggaaaagguggaggagaccgagcuguaccugaaccucgagcggaucccgugggucgugcgcaagcugcuccagguguccgagagcacgggcguggcccugaagcgguccagcuggcugaucgugcugcuggugcuguucacagucuccuuaagcccggugcaguccgcgcccaucgggcagggcaagaccaucgaggccuaccgcgcccgggagggguacaccagcaucugccucuucgugcugggcuccauccuguucaucgucaguugccucaugaaggggcugguggacuccgugggcaacagcuucuucccgggucugagcaucugcaagacgugcuccaucagcuccaucaacggguucgagaucgagagccacaagugcuacugcucccucuucugcugccccuacugccgccacugcagcaccgacaaggagauccacaagcugcaccuguccaucugcaagaaacggaagaagggcagcaacgucaugcucgccgugugcaagcugaugugcuuccgcgcaaccauggaggugagcaaccgcgccuuguucauccggucaaucaucaacaccacguuugucuuaugcauccugauccuggccguguguguggucuccaccagcgccguggagauggagaaccuccccgccgggacuugggagcgcgaggaagaccugaccaacuucugccaccaggagugccaggugacggagaccgagugccugugccccuacgaggcgcucguccugcggaagccgcuguuccucgacuccaccgccaagggcaugaagaaccugcugaacagcaccucccucgagacgagccuguccaucgaggccccguggggcgccaucaacgugcagagcacuuacaagcccaccguguccaccgccaacaucgcgcugagcuggagcagcgucgagcaucgcggcaacaagauccucgugagcggacgguccgagucgaucaugaagcuggaggagcgcacggggaucuccugggaccugggcguggaggacgccagcgaguccaagcuccugaccgucagcguaauggaccugucccagauguacagccccguguucgaguaccucuccggggaccggcaggucggcgaguggccgaaggcgaccugcaccggcgacugccccgagcgcugcgggugcacgagcuccaccugucugcacaaggaauggccacacagccggaacuggcgcugcaaccccaccuggugcuggggcguggggaccggcugcacgugcugcgggcuggacgugaaggaccucuucaccgacuacauguucgucaaguggaagguggaguacaucaagaccgaggccaucgugugcgucgagcugaccucccaggagcggcagugcagccugaucgaggccggcacgcgcuucaaccucggcccggugaccaucacccuguccgagccccggaacauccagcagaagcugccgcccgagaucaucacccuccacccccgcaucgaggagggguucuucgaccugaugcacgugcagaagguccugucugccuccaccgugugcaagcuccagagcugcacgcacggcguccccggggaccuccagguguaccacaucggcaaccugcugaagggggacaagguaaacggccaccugauccacaagauagagccucacuucaacaccagcuggauguccugggacggcugcgaccuggacuacuacugcaacaugggggacuggcccagcugcaccuacacgggcgucacgcagcacaaccacgccuccuucgugaaccuccugaacaucgagaccgacuacaccaagaacuuccacuuccacagcaagcgggugaccgcccacggggacacgccgcagcuggaccucaaagcccgccccaccuacggagcgggggagaucaccguccugguggagguggccgacauggagcugcacaccaagaagaucgagaucucgggccucaaguuugccagccuggccugcaccggcugcuacgccugcuccagcggaaucuccugcaagguccggauccacguggacgagcccgacgagcugaccgugcacgucaagagcgacgaccccgacgugguggcggccuccagcucccucauggcacgcaagcuggaguucggcaccgacagcaccuucaaggccuucuccgccaugccgaagacgagccugugcuucuacaucgucgagcgggagcacugcaaguccugcuccgaggaggacaccaagaagugcgugaacaccaagcucgagcagccccaguccauccugaucgagcauaaggggaccaucaucggcaagcagaacaguacgugcaccgcgaaggccagcuguuggcuggaguccgugaaguccuucuucuacggccuaaagaacaugcucucggggauauucggcaacgucuucauggggaucuuccuguuccuugccccauucauccuccugauccuguucuucauguucggcuggcgcauccucuucugcuucaagugcugccggcgcacccgcgggcuguucaaguaccggcaccugaaggacgaugaggagaccggcuaccgccggaucaucgagaagcucaacaacaagaagggcaagaacaagcugcuggacggggagcgccucgccgacagacgcaucgccgagcuguucagcacgaagacccacaucggcuga

SEQ ID NO: 15183 - RNA, 5067 nt, Artificial Sequence
  derived and/or modified CDS sequence (opt11) from CCHFV(Turkey-Kelkit06)__GQ337054.1__GP
augcccaccaacaucaugcacacaccgcugguuugcuucauacucuaucugcagcuucucugccugggcggggcccacggccagcuaaacgccacugagcauaacggaaccaauaacaccaccgcgcccggcgcuagccagucccccaagcccccgaugaguacgaccccgccccacgcccccgaguccagcaccaucaagcccaccacgcccaucuccgaggccgaagggagcggcgagaccaccuccccgcccaacaccacgcagggccucagcucccccgagaccaccagcgagagacccgccaccacguccaucagcaccuccagcaccgacuccaccaaccccacgacccagaugaccgacaacacccccacgccgacaguuagcaccucacccagcuccagccccagcacccccagcacgccgcaggggauccaccaccccgcgcggagccugcuguccgugagcucccccaagaccgugaccacccccacgccgaccagccccggcgagaugagcagcgagaccuccagccagcacuccgccaugagccgcauacccacaccccacaccgccacccgggucuccaccgagaucaccaaccaccgcaccccgcggcagagcgaguccagcgcccagcagacgacccccucgcccaugacaucgccggcgcaguccauccuccugaugagcgccgcccccaccgccgugcaggacauccaccccagccccacgaaccgcuccaaacggaaccuggagaccgagaucauccucacacugagccaagggcugaagaaguacuauggcaagauccucaagcugcugcaccucacccuggagcaggacacggaggggcugcuugaguggugcaagggcaaccugggcuccaacugcgacgacgacuucuuccagaagcgcaucgaggaguucuucaugaccggggaaugcuacuucaacgaggugcuucaguucaagacccucagcacccuguccccgacggagcccagccacgcucggcugcccacugcggaacccuucaaguccuacuucgcaaagggcuuccucagcaucgacuccggguacuucagcgccaagugcuauccgcgcuccagcgcguccggccugcagcugaucaaugucacccagcaccccgcacggaucgcggagacccccggccccaagacgaccagcuuaaaaaccaucaacugcaucaaccugcgcgccuccguguuuaaggagcaccgcgaggucgagaucaacguccugcucccgcagaucgcgguuaaccugagcaacugccacguggucaucaacucccaugugugcgacuacagccuggacaccgacgggcccgugcgccucccccggauuuaccacgagggcacuuucauccccgggacuuacaagauagucaucgacaagaaaaacaagcugaaugaccgcugcacccucguuaccaauugcgugaucaagggccgggagguccgcaaggggcagagcgugcuccggcaguacaagacggaaaucaagaucggcaaggccuccaccggcuuccgcaagcugcuaucggaggagccgggggacgacugcaucucccgcacccaacucuugcgcaccgagacggccgagauccacgacgacaacuacggcgggcccggcgacaagaucaccaucugcaacgggagcaccauuguggaccagcgccugggcuccgagcucggcugcuacaccaucaacagaguuaagagcuuuaagcugugcaagaacuccgcaacggggaagaccugcgagguggacagcacucccgugaagugcagacaaggauucugccugaagaucacccaagaggggcggggacacgucaagcucucccgcgggagcgaggugguccuggacgccugcgacuccagcugcgaagugaugauccccaagggcacgggcgacauccugguggacuguuccggaggccagcagcauuuccugaaggacaaccucaucgaccuggggugcccgcacaucccccugcucggccggauggccauuuacaucugccgcaugagcaaccacccccggaccaccauggcuuuccuguucugguucuccuucggcuacgucauuaccugcaucuucugcaaggcccuguucuacagccugaucaucaucgggacccugggcaagaagaucaagcaguaccgcgagcugaagccccagacgugcaccaucugcgagaccgcgccgguuaacgccaucgacgccgaaaugcacgaccucaacugcuccuacaacaucugccccuacugcgccagccggcugaccuccgacgggcuggcgcgccacgugacgcagugucccaagcggaaggagaaggucgaggagacggagcucuaccuaaaccuggagagaaucccguggaucgugcggaagcuccugcaggucagcgagagcaccggcgucgcccucaagagguccagcuggcucaucgugcuucuugugcucuuaaccgucucccugagccccguacaguccgcccccguggggcacggcaagacgaucgagaucuaccagacccgggagggcuucgccucgaucugccuuuucaugcugggguccauccuguucaucgucagcugccucgugaagggucuggucgacagugucagcgaguccuucuuccccggccugagcguaugcaagaccugcuccaucggcagcgugaacggguuugagaucgaaucccauaagugcuacugcagccucuucugcugcccguacugccgccacugcucagcggaccgagaaauccaucagcugcaccugagcaucugcaagaaacgcaagacaggcuccaaugucaugcucgcagugugcaagaggaugugcuuccgcgccacgaucgaggccagccgucgggcccugcugaucaggagcaucaucaacaccaccuucgucaucugcauccucacccugacgaucugcgugguguccaccuccgccguggagauggagaaccugccggcgggcaccugggagcgggaggaggaccucaccaacuucugccaccaagagugccaggugacggaaaccgagugcuugugccccuacgaagcccuggugcuucgcaagccccuguuccuagacuccaucgugaaggggaugaagaaccuccuuaacagcaccucccuggagaccagccuguccaucgaggccccguggggcgccauuaauguccagagcacguucaagcccaccgucuccaccgccaacaucgcgcugagcuggagcagcguggugcaucgggggaacaagauacuggugaccggccgcagugagagcaucaugaaauuggaggagcggacggggguguccugggaccugggcgucgaggacgcaagcgaauccaagcugcucacagugagcaucauggaccugucccagauguacagccccguguucgaauaccugagcggcgaccgacaggucgaggaguggcccaaggcuaccugcacuggggacugcccggagcgcugcggcugcacguccagcacuugccuccacaaggaguggucccacucgcgcaacuggcgcugcaaccccaccuggugcuggggcguugggaccggguguaccugcugcggcguggacgucaaggaccuguucaccgaccacauguucgugaaguggaagguggaauacaucaagaccgaggccaucgucugcguggcgcugaccucccaggagcgccagugcagccucaucgaggccggcacccgguucaaccuggggcccgugacgaucacccuguccgagccccgcaacauccagcagaagcucccgcccgagaucaucacccugcaccccaagaucgaagaggguuucuucgaccugaugcacguccagaaggugcucagcgccuccaccgugugcaaacuucagagcugcacgcacgggauccccggcgaucugcagguauaccacaucggcaaccuccuaaagggggaccgcgucaacggccaccugauccacaagaucgagucccacuucaacaccagcuggauguccugggacgggugcgaccucgacuacuacugcaacaugggcgauuggccgagcugcaccuacacuggggucacgcagcacaaccacgccgccuucgugaaccugcugaacaucgagaccgacuacaccaagaccuuccacuuccacaguaaacgcgugacggcccacggugacacgccccagcucgaccugaaggcccggcccaccuacggcgccgggggcaucaccguccugguugagguggccgacauggagcuccacaccaagaaggucgagaucagcgggcuuaaguucgccucccuggcgugcacuggcugcuacgccugcagcuccggaaucagcugcaaagugcgcauccacgucgacgagccugaugagcucaccguccacgugaaguccagcgacccggacgugguggccgccagcaccucccugauggcccggaaacuugaguucggaacggacagcaccuucaaggcuuucuccgccaugcccaagaccagccucugcuucuacaucguggagcgcgaguacugcaaguccugcagcgaggaugacacccagaagugcguggacacgcggcuugagcaaccccaguccauccugaucgagcacaagggcaccauaaucgggaagcagaacgauaccugcaccgccaaggccagcugcuggcucgaguccguuaagagcuucuucuauggccugaagaacaugcuaggguccguuuucggcaaccuauucaucgggaucuuacuguuccuggcgcccuucgugcugcugguccuguucuucauguucggcuggaaaauccucuucugcuucaagugcugccgccgcacgcggggccuguucaaguaccgccaccucaaggacgacgaggagaccggguauagacgcauuaucgagcggcucaacuccaagaagggcaagaaccgccuacuggacggggaccggcucgccgaccgcaagaucgccgaguuguucuccaccaagacccacaucggcuga

SEQ ID NO: 15184 - RNA, 5103 nt, Artificial Sequence; identical to SEQ ID NO: 11898
  derived and/or modified CDS sequence (opt11) from CCHFV(UCCR4416)__KY484026.1__GP

SEQ ID NO: 15185 - RNA, 5103 nt, Artificial Sequence
  derived and/or modified CDS sequence (opt11) from CCHFV(ArD15786)__DQ211627.1__GP
auguucuuacacuucaaguucgugcuccugaccaacuucuucuucugccagcuguuauggggcgggggcggggucaccucaggcgggggcacgaacaccagcagcacccaggccaucuuaaucuccagcaacacucccaacuccacgaugagcguucuagagaguucaaccggcaccgccgcggagacaguaccguccacgaccaucaacacccccgacacccaggucacaacugacagcgggagcggcgagaguucgaccgacccccagacaacaaacggggaagugccaucaaccaguaucgccaccaucaagacccaggagucugagacgcgacggacccagaaucugaguaccacagccggcagcggggccuccacuccggguaacaccacaagcaacaagcccgacgugaaccuacugaccagccccaucuccgaggcuaagagcuccccuucgccguccaagacgucuacgccccagaccgcgcaccaccucucucgcagucuguuaucagccgccaccaccgagaccagccaagccgcgucagucaugaccacaacccgggagaccaccaccaugagcucacccacgaccgugaaaaauagcgccaccgccacccccacccagggcaucacgaccuccaacaccagcaagcagaccgacaccaccacccucgagaucccgcccaagauccagaccacccagucgcagcagaccgccacccccgcaaucacccccgcgacgacggcgaucgcuuucaucagcccgaccaaccgcuccaagcgggagagcaagguacagauaauccuuacuuucagccaaggccugaagaaguacuacuccaagauuuuaaaguuacugcaucucacgcaggaggaagacucagagggccugcuugaauggugcacccgcguccucgaacaggccugcgacgaugacuacuuuaacgagcggaucgaggaguucuucaucaccgggaagggcuacuucaacgacgugcugcaguuucgccuguacgacaccuuuuccacgaccgagucuacccagaacaccucucccacggccaagcccuuccggagcuacuacgccaaaggcucccucacuuuugauagcggguauuucuccgccaagugcuacccccgagccagcaauuccggccugcagcugaucaacgugacccagcauagcgucaagaucgcgaacaccccaggcccuaagaucuccaacccuaagacgaucaacugcaucaaccucaaggugagcaccgacaaggaccacagcaagcuggagaucaacgugcuacucccacagguagcagugaaccuguccaacugccacguacuuaucgagucccacguuugcgauuacagccucaacaccgacggcaccaucaaacugccgaagauagcgcacaacggggcauucauccccggcacauacaagaucgugauugacaagaagaauaaguuaaacgaccggugcgcucucuucaccaacugugucaucaagggccgugaaguccggcgcggacaaagcgccuuacggcaauaucgcacugagauccguaucggacaaacuuucaccgggagucgucggcugcucgccgagggcgggagcaacgauugcguauccaggacgcaauugguaaagaccgaaguaaccgagauccacgaggauagcuacggcggcccuggcgagaagaucacaauuugcaacggcagcacgaucguggaucagcggcuggggucggagcucggcugcuacaccaucaaccgcguccgcaccuacaaacucugcgaaaacagugcgaccgagaaaaguugcgagaucgacagcgugcccgucaaaugcaagcaggguuucugcuugaagaucacgcaggaaggccgaggucacgucaagcucagccgaggaaccgagaucguccuggaugucugcgacaccagcugcgagcuuaugaucccgaagggcaccggggacauccucgucgacugcagcggcggccagcagcacuuccugcaggacaacuugauugaccuggggugccccaacaucccccuccugggucagacagccauauacguaugccguaugucuaaccauccaaaaacuaccauggccuuuuuguucugguucagcuucggguacgucaucacgugcgucguguguaaggugcuguucuaccuucugaucgucaucggcacccucgggaagagacugaaacaguaccgggagcuaaagccccaaaccugcaucgucugcgaauccaucccaguuaacgccauugacgcugagaugcacgaccucaacugcaacuacaacaucugccccuacugcgccagccgccugaccuccgacggcuuaguccggcaugucacccagugucccaagaggaaagaaaagguggaggagacggaguuauaccugaaccuggagcggauccccuggcucguccgcaaacuacuccaagugagcgaauccaccggggucgcgcuaaagcgaagcugcuggaucaucacucugcugauccuccugaccgucagcaugucccccguacagagcgcacccguggggcacaagcgagccguggagguguaccagauccgggaguccuauacuggcaucugcuuauucgugcucgggggcguccuguucgcggugagcuggcuugugaaggcguuaauugauuccaucgggaacagcuucuucccgggucuguccaucugcaagaccugcagcaucggcuccauuaacggguucgagaucgaaagccacaaaugcuacugcucccugcucugcugccccuacugccgcgcgugcagcuccgauaagauaacccaccggaugcauuuaaacguauguaagaagaggaaggugggcagcaacguaaugcuggccgucugcaagcggaugugcuuuaaggcaaccaucgaggcgaacaacagagccacauucauccggaacaucaucaacuccacauuugugauaugcauucugauucuggugaucugcgugguguccaccuccgccguugacauggagaaccugcccgcagguauuugggaaaaggaggaggaccucaccaacuucugucaccaggagugucaagucacggagacggagugccugugccccuacgaggcccuaaugcuuagaaagccgcuaagucuggacuccaucgcgaaaggcaugaagucucuccugaacagcaccagccuggagaccagccuguccauagaggcgcccuggggcgccaucaaugugcagagcaccuuuaagccaaccaucuccgccgcgaauaucgcccugagcugguccucuguggaacacaagggaaacaagauccuggucuccggccgcuccgaguccaucaugaagcucgaggaacggacggggaucaguuggugucuuggcguggaggacgccagcgagagcaagacccugaccgugucagucauggaccucagccaaauguauucccccguguucgaguaccugagcggggaccgccagguggaggaauggcccaaggccacguguaccggcgacugccccgagcggugcgguugcacuuccucaaccuguuuacacaaggaguggccacacucgcgcaacuggagguguaaccccacauggugcuggggcgucggaacagggugcacgugcugcggccucgacgugaaggaucuguucaccgacuacaugcuggugaaauggaaggucgaauacaucaagacggaggccaucauaugcguggagcucaccucccaagaacggcagugcagccugaucgaggcggggacccguuucaaccuggguccugucaccaucacgcuauccgagccccgaaacgugcagcagcggcugccgcccgagaucaucacccugcaccccaagaucgaggagggauucuuugaccugaugcacgugcagaaggucaugagcgccuccaccguguguaagcugcagaguuguacccacggggugcccggcgaccugcaggucuaccacguggggaaccuccugaagggcgacaaggugaacgggcacuccauccauaaaaucgagagccaucugaacacuuccuggaugagcugggacggcugcgacuuagacuacuucugcaacaugggggacuggcccuccugcaccuauaccggggucacgcagcacaaucgcgccgccuucaucaacaugcugaacaucgaaacggacuacaccaagaccuuccacuuccacagcaaaagagugacggcccauggggacacuccccaguuggaccuaaaggcgcgccccacguacggggcuggcgagaucaccguucugguugagguagccgaucuggaguuacauaccaagaagaucgagguguccgggcugaaauucgccagcuuaacgugcagugggugcuacgccuguagcuccgggaucagcugcaaaguccgcauacaugugaacgagcccgacgaguuuacaguucacgugaaauccaacgacccggacguaguggcggccgggagcagcuuaauggcccgaaagauagaguccggcgccgauagcaccuucaaggcuuucucgucuaugccgaagaacagucugugcuucuacaucgucgaacgcgacuacugcagcucgugcacggaugacgacacgcagaagugcguugacaucaagcuggagcauccgcaaagcauuuuaaucgagcauaaaggcacuaucauaggcaagcagaaugacacaugccccaccaaaaccuccugcuggcuggagagcaucaaguccuucuucuacgggcugaagaacaugcucagcggcauuuucggcaacaucuuccuggguaugcugcuguuccuggcccccuucguguuacucauccuguuuuucuucuucggcuggcgccucuuguuuugccugaagugcugccggcguacccggaagcuguuaaaauacaaacaccuccgcgacgaagaggaauccggguacaagaagaucauagagcggcuaaacgacaagaagggcaagagucgccuguucgacggcgagcgucucgcagaccgaaagauagcugaguuguucuccaccaagacccaugucggguga

SEQ ID NO: 15186 - RNA, 5100 nt, Artificial Sequence
  derived and/or modified CDS sequence (opt11) from CCHFV(UCCR4432)__KY484047.1__GP
auguucugccugcgccucgugcugcugaucaacuuggcccugugccagcugcucgagggcaacgacggggucaccagcgccgacgagaucaacuccaacaccacgcagaccagccucggcuuaccuaccauccucaacuccaccacgcccgcaccugggcccagcaucgacgcuaccauggaggcggugccuggaaccacgaacuccgugcuggagacgcaggucaccauggacagcggguccggcgagcugagcacugacccgaccacgacccgggaggccaccacccccaucacggccgcgaccguguccgcccaggagaccaagacccacaugacgcagaaccccggcaccaccguggacccugacaccacuacuagcaacaccaccacuuccaucgagccgaucaccaccccgcccaccagcccgacgccccaggccaccccaacgcccuccuacagcgaaacccccacgcucccgaacacccaucaucugucccgcagccugcucuccgccguaggcaccgaggcgggccagacagcccccgccaccccuacggccgagguggcccuggcgcccgggggcagcuccaccgccgagucaaacaccaucagcaucccggcccaggacaccacgauauccgggguaagcaagcaggauaaucccaccaccaccggcaucucgccugaggcccagacgaugcagagccagcaagccgucgcgcccgugaccaccccugccacggcuaucuccgccccgacgagccccaccaacagauccaaacgcgagagcaaggugcagaucauucugaccuucccccagggccucaagaaguacuacuccaaaauccugaaguuccugcaucucacccaggaggaggacagcgaggggcugcucgaguggugcacgcggguccuccagcaggucugcgacgacaccuacuucaacgagcgcaucaaggaguucuucauaacaggcaagggguacuucaacgacguccugcaguucaagcugcacgacaccccggccacgaccguccccgcgcucgcggccuccagcaccgcgaugcccuuccgguccuacuacgccaagggcucucugacccuggacuccggcuacuucagcgcgaagugcuacccacgcgccaguaacagcggaaugcaacucaucaacgugacgcagcaccccaugaagauagcaaacacccccggacccaagauauccaaccugaagaccaucaacugcaucaaccugaaggugagcaccgacaaggagcacagcgaguuggaaaucaauguccugaucccccagguggccgugaaccuguccaacugcuucgucagcauuaagucccacgugugcgacuacagccucgacacggacggggccauccggcugcccaagguggcccacaacggcgucuucaugccagggaccuacaagaucgugaucgacaagaagaauaagcugaacgaccgcugcgcccucaucaccaacugcgucaucaagggccgggaggugaggaagggccaguccacccugcggcaguauaagacggagauccgcaucggccagaccaucgccggcagccggcgccugcucgccgaggggguguccaacgauugcgucagccggacccagcugaucaagaccgagguggcggagauccaugaggacucguacggcgggcccggcgagaagaucaccaucugcaacggcagcaccaucguugaccagcgccuuggguccgagcucggcugcuauaccaucaaccgggugaaaacauacaagcugugcgagaacagcgccaccgagaaggggugcgagaucgacuccgugccggucaagugcaagcagggcuucugccugaaggucacgcaggaggggcgcggccacgugaaacuuagccggggcaccgagaucgugcucgacgucugcgacaccuccugcgagcugaugaucccgaaggggaccggcgacauccuggucgacugcucagggggccagcagcacuuccuccaggacaaccugauugaucugggcugccccaacgugccccucuuagggaagauggccaucuacaucugccgcauguccaaccauccgaagacuacaauggccuuccuguucugguucagcuucggcuacgucauuacgugcaucgucugcaaggucuuguucuaccuucugaucgucauagguacacucagcaagaagcugaagcaguacagggagcuaaagccccagaccugcaucgugugcgaauccacccccgugaacgccaucgacgcggagaugcacgagcucaacugcaacuacaacaucugcccguacugcgccagccggcugaccuccgacggccugguccgacacgugaaccagugcccgaaacggaaggagaaagucgaagagaccgagcucuaccugaacuuggagcgcaucccuuggcucguccggcgccugcugcaggucagcgagucuacggguauggcccucaagcggagcugcuggaugacuacccugcugauccuccugguggugucccugagccccgugcaguccgcccccgugggucagggcaaggccgucgagguguaccgcgugcgggagagcuacaccuccaucugccucuucguccuggggagugugcuguucgcgguguccuggcucaucaagggccugaucgacgggaucggcaacagcuucuucccggggcuguccgucuguaagacgugcagcaucggcuccaucaacggcuucgagaucgagagucacaagugcuacugcucccucuucugcugccccuacugccgggcgugcucgagcgacaagaucacccaccggaugcaccugaacgugugcaagaagcgcaaggccggauccaacgugaugcuggccguuugcaagcggaugugcuucaaggcgaccguggaggccagcaacaccgcccuccugauccgcggcauaaucaacuccacuuucgugaucugcguacugauccucgugaucugcgugguaagcaccuccgccgucgacauggagaaccugccagccgggaucugggagcgugaggaggaccugaccaacuucugccaccaggagugccaggugacugagacggaaugccucugccccuacgaggcguuaauccugcgcaagccgcucuaccuggacagcaucgcgaagggcaugaagucccugcugaacagcaccaaucuugagaccucccugagcaucgaggcccccuggggcgccaucaacguccaguccaccuucaagcccacggugagcgccgcgaacauugcccucuccuggagcuccguggagcaccgaggcaacaagauccuggucagcggccgcuccgagagcaucaugaagcuggaggagcggacggggaucuccuggagccuuggcguggaggacgccagcgaauccaaaacgcugaccgucagcgugauggaccugucccagauguacagccccguguuugaguaccucuccggggaccgccaggucgaggaguggcccaaggcgacgugcaccggcgacugccaggagcgcugcgggugcaccagcagcacgugccugcacaaggaguggccccacagccggaacuggcgaugcaaccccaccugguguuggggcgugggcaccgggugcacgugcugcggccuggacgugcgggaccuauucaccgacuacaugauggucaaauggaagguggaguacgugaagaccgaggccaucaugugcgucgagcugaccucccaagagcgccagugcagccucaucgaggcggggacccgauucaacuugggcccggugaccaucacccuguccgagccccgcaacauccagcagcggcugcccagcgagaucgugacgcuccaccccaagaucgaggagggcuuuuucgaccugaugcacguccagaaggugcuguccgccagcaccguaugcaagcuccaguccugcacccacggggucccuggugaccuccagguguaccacguggggaaccuguuaaagggcgacaaagucaacgggcauaguauccacaaaaucgagucccacuucaacaccagcuggaugagcugggacggaugcgaccuggauuacuucugcaacaugggcgacuggcccagcugcacguacaccgggguuacccagcacaaucgcgccgccuucaucaacaugcugaacaucgagaccgacuacacaaagaccuuucauuuccacagcaagcggguaaccgcgcacggggacacgccgcagcucgaccugaaggcccgccccaccuacggggccggcgaggucaccgugcugguggaggucgccgaccucgaguuacacaccaagaagaucgagguguccgggcugaaguucgccagccucacgugcuccgggugcuaugcgugcagcaguggcaucagcugcaagguuagaauccacgucaacgagccggacgaguucaccgugcacguaaaguccagcgaccccgacgucguagccgccggguccagccugauggccaggaagauagaguucggcgcggacuccaccuucaaggcguucagcuccaugcccaaaaauagccugugcuucuacaucguggagcgagacuacugcuccagcugcaccaacgacgacacccagaagugcgucgacacgaaguuggagcacccccagagcauccugauugaacacaaggggaccaucaucggcaagcagaacgacacgugcagcaccaagaccuccuguuggcuggagagcgugaaguccuuuuucuacgggcugaagaauaugcugggcggcaucuucggaaacguguuccugggcaucuuccucuuccuggccccguucgcccuguuaaucuucuucuucuuuuucggguggcgccugcuguucugccugaagugcugccgccgcacgcggggccuccugaaguacaaacagcugaaggacgaggaggaggccggcuacaagaagaucaucgagcgucuaaacgacaagaaggggaagucccggcuguucgacggcgagcgccuggccgaccguaagaucgcggagcuguucagcaccaagacccacaucggguaa

SEQ ID NO: 15187 - RNA, 5100 nt, Artificial Sequence; identical to SEQ ID NO: 11901
  derived and/or modified CDS sequence (opt11) from CCHFV(Nakiwogo)__KX013484.1__GP

SEQ ID NO: 15188 - RNA, 5100 nt, Artificial Sequence
  derived and/or modified CDS sequence (opt11) from CCHFV(UG3010)__AY900143.1__GP
auguucugccugcgccucgugcugcugauuaaccucgccuugugccagcugcucgagggcaacgacggggucaccucugccgacgagaucaacuccaacaccacgcaaaccagcuuaggcuuacccacuauccucaacuccaccacaccggcgcccgggcccagcaucgacgccaccauggaggccgugcccggcaccacuaauucuguguuagagacgcaggucaccauggacagcggguccggcgagcugagcaccgacccgaccacgacccgggaggccacuacccccaucacggccgcgaccguguccgcccaggagaccaagacccacaugacgcagaacccaggcacaaccguggaccccgacaccacgaccagcaacaccaccacguccaucgagccgaucaccacuccgcccaccucucccacgccccaggccacccccacccccagcuacucggagacaccuacccugccgaacacccaccacuugucccgcagccugcucuccgccgucggcaccgaagcuggucagaccgcccccgccacgcccacggcugagguggcccuggcgcccgggggcagcaguaccgccgagagcaacaccauaagcaucccggcccaggacaccacgaucuccggcgugagcaagcaggacaaucccaccacaaccggcaucucccccgaggcccagacgaugcagagccagcaggccgucgcgcccgugacgaccccggccaccgcaaucucagcccccacgucacccacuaaccggucaaagcgcgagagcaagguacagaucauccugacuuucccccagggacucaagaaguacuacuccaagaucuuaaaguuccugcacuuaacccaagaggaggacagcgagggguugcuggaguggugcacgcguguacuccagcaggucugcgacgacaccuacuucaaugagcgcaucaaagaguucuucaucaccggcaaggguuacuuuaacgacgugcugcaguucaagcugcaugacaccccagccacaaccguccccgcgcucgccgccuccagcaccgccauccccuuccgguccuacuacgccaagggcagccugacccuggacagcggcuacuuuagcgcgaagugcuacccccgcgccucgaacagcggaaugcagcucauuaacgugacgcagcaccccaugaagauugcgaacacccccggccccaagaucuccaaucuaaagaccauaaauugcaucaaccugaaagugagcacggacaaggagcauucugaacucgaaaucaacguccugauuccccagguggccguaaaccuguccaacugcuuugucagcaucaagucucacguaugcgacuauagccuugacacagacggggcgauccggcugccgaagguggcgcacaacggcgucuucaugcccgggacuuacaagauaguuauagacaagaagaacaaacugaacgaccgcugcgcccucaucaccaauugcgucaucaagggccgggaggugcguaagggccagucaacccugcgacaguauaaaacggaaauccgcaucgggcagaccauugccgguagccgccgccuacucgccgaggggguauccaacgacugcgucagucgcacccagcugaucaaaacagagguggcggagauccacgaggacuccuacggcgggccgggcgagaaaaucacgaucugcaacggcaguaccaucguugaccaacgcuuggggucugagcucggcugcuacaccaucaaccgggugaagaccuacaaacugugcgagaacagcgccacugagaaagggugcgagauugacucggugccggugaaaugcaagcagggcuuuugccuuaaggucacgcaggaagggagaggccaugugaaacucagccggggcaccgagauagugcuggacgucugugacaccuccugcgagcugaugauuccgaaggggaccggcgacauccugguggacugcagcgggggccagcagcauuuccuccaagacaaccugaucgaccuggguugccccaacgugccucuguuagggaagauggcaaucuacaucugccgcauguccaaccacccuaaaaccaccauggcauuccuguucugguucagcuucggauacgucaucacgugcaucgugugcaaggucuuguucuacuugcugaucgucaucgggacccucucuaagaagcugaagcaguaccgcgagcugaagccacagaccuguaucgucugcgaguccacccccgugaacgccaucgaugcggagaugcacgaguuaaacuguaacuacaacaucugcccuuacugugccagccggcugaccuccgacggccugguccgccaugugaaccagugcccgaagcguaaagagaagguggaggagacagagcuguaccugaaucuggagcgcauucccuggcucguacggcgccuccugcagguaagcgaguccacugggauggcccucaagcggagcugcuggaugaccacccugcugauccuccugguugugucccugagccccguccaguccgcccccguaggacagggcaaagccgucgaaguguaccgcguucgggaaagcuauaccuccaucugccuauucguccuggguucugugcuguucgcggucuccuggcucauuaagggacugaucgacgggaucggcaacucguucuucccugggcuguccguuugcaagacgugcagcauaggcuccaucaacggcuucgagaucgagagccacaagugcuacuguucccucuucuguugccccuacugucgcgccugcucgagcgacaagaucacccaccggaugcaccugaacgugugcaagaagcgcaaggcgggguccaacgugaugcuggccgucugcaagcggauguguuucaaggcuaccguggaggccagcaacaccgccuuacugauccgcggcaucaucaacuccacguucgugaucugcguccugaucuuagugaucugcguggucaguaccuccgccguggacauggagaaccugcccgcggggauaugggagcgggaggaagaccugaccaacuuuugccaucaggagugccaggugaccgagacggagugccucugccccuaugaggcgcugauccugcgcaaaccgcucuaccuggacagcauugccaagggcaugaagucccugcugaacagcaccaacuuggagaccucccugagcaucgaggccccuuggggcgccaucaacguccaguccacuuucaagcccacggugagcgccgcgaacaucgcccucucuuggagcuccguggagcaccgggguaauaagauccuggucagcggccgcuccgagagcauaaugaagcuggaggagcgaacugggaucuccuggagccucggcguagaggacgccagcgaguccaagacauuaaccgucagcgugauggaccuaucccagauguacagcccgguguuugaguaccuaagcggggaccgucaggucgaggaauggcccaaggcuacgugcacuggcgacugccaggaaagaugcgggugcaccagcagcacgugccugcacaaggaguggccccacagccggaacuggcgaugcaaccccaccuggugcuggggcgugggcaccgggugcacgugcugcgggcuugacgugcgggaccucuucaccgacuacaugauggucaaguggaagguggaguacguuaagaccgaggccaucaugugcgucgagcugaccucccaggagcgacagugcagccugaucgaggcggggacccgguuuaaccucggcccggugaccaucacccuguccgagccucgcaacauccagcagcggcugcccagcgaaaucguuacacuccaccccaaaaucgaggagggcuucuucgaccugaugcacguucagaaggugcuguccgccagcaccgugugcaagcuccaguccugcacccacggggucccgggcgaccuccagguguaccacguggggaaccugcucaagggcgacaagguaaacggucacagcauucacaagaucgagucccacuuuaacaccucauggauguccugggacggaugcgaccuggacuacuucugcaacaugggcgacuggccuagcugcacguacaccggggucacccagcacaacagagccgccuuuauuaacaugcugaacauagagaccgauuacacgaagaccuuccacuuccacagcaaacgggugaccgcgcacggcgacacgccucaguuggacuugaaggcgcgcccuacuuacggggccggcgaagucaccgugcuggucgaggucgcugaccucgagcugcacaccaagaagaucgagguguccggucugaaguucgccagccucacgugcucuggcugcuacgcgugcucuagcggcaucagcugcaaggugcggauccacgucaacgagccggacgaguucaccgugcacguaaagucuagcgaccccgacgucguggccgccgggagcagccugauggcccgcaaaaucgaguucggcgccgacuccaccuucaaggcguucagcuccaugcccaagaacagccugugcuucuacaucguggaacgggacuacugcuccagcugcaccaacgacgacacccaaaagugcgucgacacgaaacucgagcacccccaauccauccugaucgagcauaaggggacuaucaucggcaagcagaacgacacgugcagcaccaagacuuccugcuggcuggagucugugaaguccuucuucuacgggcucaagaacaugcugggcggcaucuucggaaacguguuccugggcaucuuccucuucuuggccccguuugcacugcucaucuucuucuucuucuucggguggcgccuacuguucugcuuaaaaugcugcagacgcacccggggccuccugaaguacaaacagcuuaaggacgaagaggaggccggcuauaagaagaucaucgagcgacugaacgacaagaagggcaagagccggcuauucgacggggaacgccucgccgaccggaagaucgccgagcuguucagcaccaagacgcacaucggguga

SEQ ID NO: 15189 - RNA, 5100 nt, Artificial Sequence
  derived and/or modified CDS sequence (opt11) from CCHFV(Semunya)__DQ094832.1__GP
auguucugccugaaacucgugcugcugaucaaccucgcccugugccaguuauuggaggguaacgaucgcgugaccagugccgacgggauaaacuccaacaccacgcagaccaaccugggcauuaguaccaucuugaacuccaccacccccgcgccagggcccagcacugacaccaccauggagacggugcccagcaccgccgauagcaugcucgagacccaggugaccacggacuccggcucgggggagcccuccacagagccgacuaccacgggcgaggccaccuccuccaccaccgccgccacggucagcaugcaggagacaaagacccacaugacacagaacacgcgguccaccgcggaccccgacaccacgacgcccaauaccaccaccucgguggagcccacgaccaucccgcccaccuccccuauccuucaggccacccccacgccgggccacggcaaggcccccacccugcccaacacccaccaccucagccgcuccuugcugagcgccguguccaccgaggcgggucagaccacgcccgccaccagcaccaccgaagcggccagcgccccgucuucguccagcacggcagaaaauaacaccauguuccagcccgcgcaggacaccaccacgucuggagucagcgagcaguauaaccccaccaccaccggcaucagccccaaggcccagacaaugcaggcccagcaagccauagugccggugaccacccccgucaccacgaccuucacccccaucaaccccaccaaccggagcaagcgcgaguccaaagugcagaucauccuaacguucccucaggggcugaagaaguacuauagcaaaauccugaagcuccugcauuugacccaggaagaagacuccgagggccuccuggaauggugcacccggguacuccagcaggucugcgacgacaccuacuucaacgagcgcaucgaggaguucuucaucacggguaagggcuacuucaacgacguguugcaguucaaacugcacgacacccccaccacuacggugcccgcgcuggccgcaucauccaccgcaaugcccuuccggagcuacuacgccaagggaucccucacccuggacuccggguacuucucagcgaagugcuauccgagggccagcaacuccgggaugcaacugauaaaugucacccagcaccccaugaagaucgccaacacgcccggaccgaagaccagcaaccucaaaaccaugaacugcaucaaccugaagguuagcaccgacaaggagcacagcgagcuggagaucaacguacucaucccccagguggccgugaaccugagcaacugcuuaguguccaucaagagccacgucugcgauuacucccucgacacggacggggccauccggcugcccaagguggccuacaacggcguauucaugccugggacauacaagaucgucauagacaagaagaacagacugaacgaccggugcgcacucaucaccaauugcguaaucaaaggccgcgagguccguaaggggcagagcacccugcgccaguauaagaccgagauccggauuggccaaacacugaugggcucccgccggcuccuggccgagggggugucaaacgacugcgugucccgcacccagcugaucaagacggaggucgccgagauccacgaagacagcuacggcgggccgggcgagaagaucacuaucugcaauggguccacgaucguugaccagcgacuuggcagcgagcugggcugcuacaccaucaaccgcgugaagaccuacaagcugugcgagaacuccgcgaccgagaaaggaugcgagaucgacagcguccccgucaagugcaagcagggcuucugccucaaggugacgcaggaggggcggggccacguaaagcuaucccgggggaccgagaucgugcuggacgugugcgacaccagcugcgagcucaugauccccaagggcaccggcgacauccucgucgacugcuccgguggccagcagcacuuccugcaggacaaccugaucgaccucgggugccccaacgugccucuacugggcaagauggccaucuacaucugccgcaugagcaaccaccccaagacgaccauggccuuccucuucugguucagcuucggcuacguuaucaccugugucguguguaaggugcuguucuacuuacucaucgucaucgggacccugggcaagaagcugaagcaguaccgggaguugaagccccagacgugcaucgugugcgaauccauccccgugaacgcgaucgacgccgagaugcacgagcugaacugcaacuacaacaucugcccguauugcgcgagccgccugaccuccgacgggcucguccgccacgugacccagugcccgaagcgcaaggagaagguggaagagaccgaguuguaccuaaaccucgaacggauccccuggcugguacgccgguugcuccaggucagcgaguccacgggcauggcccugaagcgaucguguuggaugaccacccugcucauccugcuuguggucucccucagccccgugcaauccgcuccgguagggcaggaaaaggccaucgagguguaccagguacgggaaagcuacaccagcaucugccuguucguucugggcagcguccucuucgccguguccugguuagucaagggacugaucgacggcaucggcaacagcuucuucccggggcuauccgucugcaagacgugcucgaucgguuccauuaacggguucgagaucgagucacacaagugcuacugcucccuguucugcugccccuacugccgcgcaugcagcagcgacaagaucacccauaggaugcaccugaauaucugcaaacgccggaaggucggcuccaacgugaugcucgccgucugcaagcgcaugugcuucaaggccaccguggaagcaagcaacuccgccuuacugauccggagcaucaucaacuccaccuucgugaucugcguccucauccuggugaucuguguggucagcacauccgcgguggacauggagaaccugcccgccggcaucugggagagagaggaggaccucaccaacuucugccaccaggagugucaggugaccgagacagagugccugugcccguacgaggcacugaucuugcggaagccccuguuccuggacagcaucgcgaaggggaagaagucccuccugaacagcacuaaccuggagaccucccucagcaucgaggcucccuggggcgcgaucaacgugcaguccaccuucaagccgaccgugagcgccgccaacaucgcccuguccuggagcucgguggagcaccgcgggaacaagauccucgucuccggccgguccgagagcaucaugaagcucgaggagcgcacggggaucagcuggucccuggggguggaggacgcgagcgagucuaagacccugacggucagcgugauggaccucucucagauguacagcccgguguucgaguaccuguccggcgaccgccagguagaagaauggcccaaagccaccuguaccggggacugucccgagcgguguggcugcacgagcuccaccugucuacacaaggaguggccgcacagccgcaacuggcggugcaaucccaccuggugcuggggcguggggaccggaugcacgugcugcggcuuagacgugcgcgaccuguucacggacuacaugauggucaaguggaagguggaguacgugaagaccgaggccaucaugugcgucgagcugaccucccaagagcggcagugcagcuuaaucgaggccggcacgcgcuucaaccuggggcccgugaccauaacccuguccgagccccggaacgugcagcagcgccugccgagcgagaucgucacccugcaccccaaaaucgaggagggcuucuucgaccugaugcacguacaaaaggugcuguucugcaaauacucccugcaggccaccagcugcacccacgggguccccggcgaccuccagguguaccacgugggcaaccuccucaaaggggauaaggucaacggccacuccauccacaagaucgagagccacuuuaacaccuccuggaugagcugggacgggugcgaccuggacuauuucugcaacaugggcgacuggcccagcugcaccuacacgggggugacccagcacaaccgcgcggccuucgugaacaugcucaacauagagaccgacuacaccaagacguuucauuuccacuccaagcgcguaaccgcacacggcgacaccccgcagcuggauuuaaaagcccgucccaccuacggcgccggagaggugacggugcucguggagguggcggaccuggagcugcauacgaagaagaucgaaguaagcggccucaaguucgcuagucugacaugcagcgggugcuaugccugcuccucuggcaucucuugcaagguccgaauccacgugaaugagcccgacgaguuuaccguacacguuaagagcaacgaccccgacgugguggcagccggcuccagccugauggcccggaagauagaguucggcgccgacuccacguucaaggcauucagcuccaugccgaagaauagccucugcuucuacaucgucgagcgggacuacugcaguagcugcaccgacgacgacacccagaaguguguaaacauaaagcuggagcacccccaguccaucuuaaucgagcacaagggcaccaucaucgggaagcagaacgacacgugcccaaccaaaaccagcuguuggcucgaguccgucaagagcuucuucuacggcuugaagaacaugcucgggggcaucuucgggaacguguuccuuggcauuuucuuauuccuggcccccuucgcucuccugauucuguucuuuuucuucggcuggcggcugcuguucugccugaagugcugccgccgaacucgcggacugcucaaguacaagcagcugaaagacgaagaggaggccgguuacaagaagaucaucgagaggcugaaugacaagaagggcaagagccgccucuucgacggggagaggcuggccgaccgcaagauagccaagcuguucuccacuaagacccacauaggcuga

SEQ ID NO: 15190 - RNA, 5094 nt, Artificial Sequence
  derived and/or modified CDS sequence (opt11) from CCHFV(79121)__AB069673.1__GP
augcuguuccacuuuaaguucaugcuccugaucaacuucauccuaugccaccuccuguggggcgggggcgggguuacaggcgguguagagaccaacagcuccagcacucaagccauccaaaccccaccgguuaccuccaacagcaccacgcccggccccagcaccgacaccgccacagagacggcgagcuccaugaccaccagcacccccgacacucaggugaccaccgacaacggcuccggggagccgagcaccgacccccugacgacuaacgaggccaccccgccccucuccgucacgacagcccagaccaccgagacaaagaagcauacgacccuggacccauccaccucgaccaaccccgaugcgacuacccccucgaucaccauccuguccgccagcaauaccucacuccccaucagcuccgugcaugcaagcccgagccccagcagcuccgaggagcccacgccccagaacgcucaccaccugagccgcucccugcucagcgccguguccaccgagaccggccagaucgcaagcgcggccaccgccgccaaggagaucacgaccaagaauagcccgcccaccgcagggaacgacaccauggucaccagcgcgcccaacggcaacauccggaauacgcccgagcaggcuaauccgaccgccccggaggccucacccaagauccaaacaacccagaaucagcagacugugaccccagaggccaccccgaucaccacgaucaccgcgcugacagaccugaccaaccgcagcaagcgggauuccaagguucagaagauccucacguucagccaggggcugaagaaauacuacucaaagauccugaaacuccugcagcugacccaggaggaggacucggaaggccuccuggaguggugcacccgcguccuggagcaggcgugcgacgacgacuacuucaauaagcggaucgaggaguucuucaucaccggcaagggguacuucaacgacguucuccaguuccgccugcacgacgcccuguccaacacggagcccgcacagaccaccagccccacggccgugccuuucaaguccuacuacgcgaagggcagcuuaacguucgacagcggguauuucuccgcccgguguuacccgcgcgcaucaaacuccggccuacagcugauaaacgucacccagcaccccgugaagaucgccaacacucccgggccgaagcucagcaaccugaagaccaucaacugcaucaaccugaagguguccacugacaaggagcauagcgagcucgaggucaacguccuguugccccagguggccguaaaccucucgaacugccacgugagcaucaagucccacgugugcgauuacagcuuggacaccgacggggcgaucaagcugccccgggucgcccacaacggcguguucauccccgggaccuacaaaaucgugaucgauaagaagaacaaccucaacgaccgcugcacccugaucacgaacugcgucaucaagggccgggaggugcgcaagggucaguccgcccugcgccaguacaagaccgagauccgcaucggccagaccuucaccggcagccgucgccuccuggcggaagggggcuccagcgacugcaucucccggacgcagcuggucaagaccgagguggcggagauccacgaggacagcuacggcgggccuggagagaagaucaccaucugcaacggcuccaccaucguggaccagggccucgggagcgaacugggcugcuacacgaucaaccgcguucggagcuacaagcugugugaaaacucggccagcgggaaguccugcgagaucgacagcauccccgugaagugcaagcagggcuuuugccucaaaauuacccaggaagggcgaggccacgugaaacuuuccagaggcaccgagaucguucuagacgugugcgauagcagcugugagcucaugauccccaaggggacgggcgacauccuaguggacugcagcgggggccagcagcacuuccugcagaacaaucugaucgaccucggaugccccaacgucccucugcuggggaaaauggccaucuauguuugccgcauguccaaccaccccaaaaccacgauggcauuccucuucugguucagcuucggguauguaauuaccugcaucgccugccguguccuguucuaucugcuaaucgcgaucgggaccgugggaaagaaacugaagcaguaccgggagcugaagccccagaccugcaucgugugugaguccguccccgugaacgcaaucgacgccgagaugcacgagcucaacugcagcuacaacaucugcccguacugcgccucccgccugagcacggacggguuaaucagacacguuacccaaugccccaagcgccgugagaaggucgaagagaccgaguuauuuuugaacuuggagcgcauccccuggcucguucggaagcugcuccagguguccgagagcaccggcauggcccucaagcgcucguguuggaugaucacgcugcugauccugcugcuggucagcaucucccccgugcagagcgcgccgguuggcaaggagcgggccauagagaccuaccaggcccgcgagacuuacaccgggaucugccucuucguccugggcucagugcuguucgcgguauccuggcucacgaaggcccugaucgacgggauagggaacagcuucucccccggacugagcgucugcaagaccugcuccauuggcagcaucaacggcuucgagaucgagucccacaagugcuacugcucccucuucuguugccccuacugccgggcgugcuccucggacaagaacacgcaccgaaugcaccugaacgugugcaagaaacggaagaugggaucaaacgugaugcucgccgucugcaaacgcaugugcuuccgggccacuauugaggccagcaacaaggcgcuccugauucgcuccaucaucaauagcacguucgugaucugcauacugauccucaccaucuguguggucuccacgagcgccguggacauggagaaccuaccagccggcaucugggagaaggaggaggaccucaccaauuucugccaccaggaaugccaggugacggagaccgagugccucugcccguacgaagccaugguccugcgaaagccccuguuuuuggacucgaccgccaaggggaugaaaagccugcugaacuccaccagccucgagacgagccucuccaucgaggcgcccuggggcgccaucaacgugcagaguaccuucaagcccaccguguccgccgccaacauagcccugagcugguccagcgucgagcaccgcgggaacaagauccucguguccggccggucagaguccaucaugaaacuggaggaacgcaccggggugagcuggaaccugggggucgaggacgcguccgagagcaagacgcucaccguguccgugauggaccuuucgcagauguacuccccggucuucgaguaccucagcggcgaccgccagguggaagaguggcccaaggcuaccugcaccggagacugcccugaacggugcggcugcaccuccagcaccugucuccacaaggaguggccgcacuccaggaacuggcggugcaaccccaccuggugcuggggcguggggaccggcugcacgugcugcgggcuggaugucaaagacuucuucaccgacuacaugcuggugaaguggaagguggaguacaucaaaaccgaggccaucgucugcguggagcucaccagccaggagcgccagugcagccugaucgaggccggcacccgguucaaccucgggcccgucacgaucacccucucugagccgcgcaacguacagcagcgcuuaccgcccgagaucgugacccugcaccccaagaucgaggagggcuuuuucgaccuaaugcacguacaaaagauccugagcgccagcacagugugcaagcugcagucuugcacacacggcgugcccggcgacuuucaaauauaucacgucggcaaccuccugcguggggacaagguaaauggccacuccauccacaagaucgagccgcacuucaauaccagcuggauguccugggacgggugcgaccuggauuacuucugcaauaugggcgauuggcccagcugcaccuacacuggcguaacccagcacaaccgugccgccuucaucaacaugcucaacaucgagaccgacuauacaaagaccuuccacuuccacuccaagcgcgucacagcgcacggugauacgccccagcuggaucugaaggcgcgucccgcguauggagcaggggaggugaccguccucgucgagguggcugaccuggagcugcacaccaagaaccuagaggugagcggccugaagaucgcuucccugaccugcagcgggugcuacgccuguuccucgggcaucuccugcaagguccgcauccacgugaacgagccggacgaguucaccguacacguccggagcucggaccccgacgugguggcggcaggcagcucccuaauggcccgcaagauagaguucggcgccgacagcacauucaaggccuucagcuccaugcccaaggauagccugugcuucuacauaguggagaaggauuacugcucuagcugcaccgacgacgacacgcagaagugcguaaacacgaaacuggaucacccccaguccauccuuaucgagcacaaaggcaccaucaucgggaagcaaaacgacacgugcagcacgaaaaccuccuguuggcuggagagcgugaagggcuucuucuacgggcugaagaacauguuauccggcaucuucggcaacgucuuccugggaaucuuccuguuccucgcgccguucguucugcugauauucuuuuucuucuucggcuggcggcuccuguuuugccugaagugcugccgccgaacccgcggguuacucaaguacaagcaccuaaaggaugaggaggaagccggcuacaagaagaucaucgagcggcugaacggcaagaaggguaagucccagcuguucgacggcgagcgccucgcggaccggaaaauagcggaauuauucuccaccaagauccacaucggguga

SEQ ID NO: 15191 - RNA, 5094 nt, Artificial Sequence
  derived and/or modified CDS sequence (opt11) from CCHFV(7001)__AB069670.1__GP
augcuguuccacuucaaauucaugcuccugaucaacuucauccugugccaccuccuguggggugggggcggggugaccggcggggucgagaccaacagcuccucgacgcaggccauccagacgccgccggugaccuccaacagcaccacccccggccccuccaccgacacagccaccgagacggcgagcuccaugaccaccagcacccccgacacgcaggucaccaccgacaacggcuccggggagccgagcaccgacccccugacgaccaacgaggccaccccgccccucuccgucaccacggcccagaccaccgagaccaagaagcacacgacccuggaucccagcaccuccaccaaucccgacgccacgacccccagcaucaccauccuguccgccaguaacacaucccuccccaucagcuccgugcacgcgagcccgagccccuccagcuccgaggagcccacgccccagaacgcccaccaccugagccgcucccugcucagcgccguguccaccgagaccggccagaucgccagcgcggccaccgccgccaaggagaucacgaccaagaacuccccgcccaccgccgggaacgacaccauggucacgagcgcgcccaacggcaacauacgcaacacgcccgagcaggccaacccgaccgcccccgaggccucccccaagauccagacuacccagaaucagcaaacggugacccccgaggccaccccgaucaccacgaucaccgcgcugaccgaccugaccaaccgcagcaagcgggacuccaagguacagauaauccucacguucagccaggggcugaagaaguacuacuccaagauccugaagcuccugcagcugacccaggaggaggacagcgagggccuccuggaguggugcacccgcguccuggagcaggccugcgacgacgacuacuucaacaagcggaucgaggaguucuuuaucaccggcaaaggguacuucaacgacgugcuccaguuccgccugcacgacgcccuguccaacacggagcccgcccagaccaccagccccaccgccgugcccuuuaaguccuacuacgcgaagggcagccucacguucgacagcggguacuucucagcccggugcuacccacgugccagcaacuccggccugcagcugaucaacguaacccagcaccccgugaagaucgccaacacccccggcccgaagcucagcaaccugaagaccaucaacugcaucaaccugaagguguccacggacaaggaacacagcgagcucgaagucaacgugcugcugccccagguggccgucaaccucuccaacugccacgugagcaucaagucccacgugugcgacuacagucuggacaccgacggugcaaucaagcugccccgggucgcccacaacggcguguucauccccgggaccuacaagaucgugaucgacaagaagaacaacuugaacgaccgcuguacccugaucacgaacugcgucaucaagggccgggaggugcgcaaggggcaguccgcccugcggcaguacaagaccgagauccgcaucggccagaccuucaccggcagccggcgucuccuggccgagggcggguccagcgacugcaucucccggacgcagcuggucaagaccgagguggcggagauccacgaggacagcuacgggggcccgggggagaagaucaccaucugcaacggcuccaccaucguggaccagcgccucggcagcgagcuggggugcuacacgaucaaccgggugcguagcuacaagcugugcgagaacuccgccagcgggaaguccugcgagaucgacagcauccccgugaaaugcaagcagggguuuugccucaagaucacccaggagggccgggggcacgugaagcugucccgcggcaccgagauaguccuggacgugugcgacagcuccugcgagcugaugauccccaagggcaccggggacauccucguggacugcagcggcgggcagcaacacuuccugcagaacaaccugaucgaccucgggugcccgaacgucccgcugcugggcaagauggccaucuacgugugccgcaugucaaaccaccccaaaaccacgauggccuuccucuucugguucagcuucggguacgugaucacgugcaucgccugccggguacuguucuaccugcucaucgcgaucggcaccguggggaagaagcucaagcaguaccgcgaacugaagccccagacuugcaucgugugcgaguccguccccgugaacgccaucgacgccgagaugcacgagcucaacuguagcuacaacaucugcccguacugcgccagucggcugagcaccgacggccugauccgccacgugacccagugccccaagcggcgcgagaaggucgaggagaccgagcuguuccucaaccuggagcggauccccuggcucgugcgcaagcugcugcaggucuccgaaagcaccgggauggcccucaagcgguccugcuggaugaucacgcugcugauccuccugcuggugagcaucuccccuguccagagcgcgccggugggcaaggagcgcgccaucgagaccuaccaggcccgggagaccuacaccggcaucugccucuucguccugggaagcgugcuguucgccgucuccuggcucacuaaggcccugaucgacggcaucgggaacagcuucuuccccggccuguccgucugcaagaccugcagcaucggauccaucaacggcuucgagaucgagagccacaagugcuacugcucgcuuuucugcugcccauauugccgcgcgugcagcuccgacaagaacacccaccggaugcaccugaacgugugcaagaagcgcaagaugggcagcaacgugaugcuugccgucugcaagcggaugugcuuccgcgccaccaucgaggccuccaacaaggcgcuccugauccggagcaucaucaacuccacguucgugaucugcauucugauccucaccaucugcguagucagcaccuccgccguggacauggagaaccuucccgccgggaucugggagaaggaggaggaccugaccaacuucugccaccaggaaugccaagugacggagaccgaaugccucugcccguacgaggccaugguccugcgcaagccccucuuccucgacaacauugcuaagggcaugaagucccugcuaaacagcaccucacucgagaccucccugagcaucgaggcgccguggggcgccaucaacgugcagagcacguucaaacccaccguguccgccgccaacaucgcccugagcugguccagcgucgagcaccgggggaacaagauccucguguccgggcgcagcgaguccaucaugaagcuggaggagcgcaccggcgugagcuggaaccugggcgucgaagacgcguccgagagcaagacccucacgguguccgugauggaccugagccagauguacuccccggucuucgaguaucugagcggggacaggcaaguggaggaguggcccaaggcgaccugcaccggcgacugccccgagcggugcggcugcaccuccagcacgugccuccacaaggaguggccgcacucccggaacuggcgcugcaaccccaccuggugcuggggcguggggaccggcugcacgugcugcggccuggacgucaaagacuucuucaccgacuacaugcuggugaaguggaagguggaguacauuaagaccgaagccaucgucugcguggagcucaccagccaggagagacagugcucccugaucgaggccgggacccgcuucaaccugggccccgucaccaucacgcucagcgagccccggaaugugcagcagcgccugccgcccgagaucgugacccugcaccccaagaucgaggagggguucuuugaccucaugcacguccagaagauccugagcgccuccaccguguguaagcugcagucaugcacccacggcgugcccggcgacuuccaggucuaccacguugggaaccuccugcggggcgacaaggugaacgggcacuccauccacaagauugagccgcacuucaacacuagcuggauguccugggacggcugcgaccuggacuacuucugcaacaugggagacuggcccagcugcaccuacaccggcgucacccagcacaaccgcgccgccuucaucaacaugcucaacauugagacggacuacaccaagaccuuccacuuccacuccaagagggugaccgcccacggcgacacgccccagcuggaccugaaagcccgccccgcguacggggccggggaagugaccguccucguggagguggccgaccuggagcugcacaccaagaagcucgaggucagcgggcugaagaucgccuccuugaccugcagcggcuguuacgccugcuccagcgggaucuccugcaaaguucggauccacgugaacgagccggacgaguucacgguccaugugcgcagcuccgaccccgacguggucgcagccgguagcucgcucauggcccggaagaucgaguucggcgccgacagcaccuucaaggccuucuccagcaugcccaaggacagccugugcuucuacaucguggagaaggacuacuguuccagcugcacugacgacgacacccagaagugcgugaacacgaagcuggaccacccccaguccauccucaucgaacacaaggggaccaucaucggcaagcagaacgacacgugcagcaccaagaccuccugcuggcuggagagcgucaagggguucuucuacggccugaagaacaugcucuccgggauauucggcaacguguuccugggcaucuuccuguuccucgcgccguucguguugcugauauucuucuucuucuucggguggcgccuccuguucugccugaagugcugccggcgcacccggggccugcucaaguacaagcaccugaaggacgaggaggaggccggguacaagaagaucaucgagcgccugaacggcaagaagggcaagagccagcuguucgacggggagcggcucgccgaccgcaagaucgccgagcuguuuuccaccaagauccauaucggcuga

SEQ ID NO: 15192 - RNA, 5094 nt, Artificial Sequence; identical to SEQ ID NO: 11906
  derived and/or modified CDS sequence (opt11) from CCHFV(YL16070)__KY354081.1__GP

SEQ ID NO: 15193 - RNA, 5094 nt, Artificial Sequence; identical to SEQ ID NO: 11907
  derived and/or modified CDS sequence (opt11) from CCHFV(YL04057)__FJ562094.1__GP

SEQ ID NO: 15194 - RNA, 5094 nt, Artificial Sequence
  derived and/or modified CDS sequence (opt11) from CCHFV(79121M18)__GU477493.1__GP
augcuguuccacuucaaguucaugcuccugaucaacuucauccugugccaccuccuguggggcgggggcggggugaccggcggggucgagaccaacagcuccagcacgcaggccauccagacgcccccggugaccuccaacagcaccacgcccggccccuccacugacaccgccaccgagacggcgagcuccaugaccaccagcacccccgacacccaggugacaaccgacaacggcuccggggagccgagcaccgacccucugacgaccaacgaggccaccccgccccucuccgucaccacggcccagaccaccgagaccaagaagcacacgacccuggaccccagcacauccaccaaccccgacgcaacgacccccagcaucacaauacuguccgccagcaacaccucccuucccaucagcuccgugcacgcgagcccgagccccuccagcagcgaggagcccacgccccagaacgcccaccaccugagccgcucccugcuuagcgccguguccaccgagaccggccagaucgccagcgcggccaccgccgccaaggagaucacgaccaagaacaguccgcccaccgccggcaacgacaccauggucaccagcgcgcccaacggcaacauccgcaacacgcccgagcaggccaacccgaccgcccccgaggccucccccaagauccagaccacccagaaccagcagacggugacccccgaggcgaccccgaucaccacgauuaccgcgcugacugaccugaccaaccgcagcaagcgggacuccaaggugcagaagaucuuaacguucucgcaggggcugaagaaguacuacuccaagauccugaaguugcugcagcugacccaggaggaggacagcgagggccuccuggaguggugcaccaggguccuggagcaggcuugcgacgacgacuacuucaacaagcggaucgaggaguucuucaucaccggcaagggguacuucaacgacgugcuccaguuccgccugcacgacgcccuguccaacacggagccugcccagaccaccagccccaccgccgugcccuucaaguccuacuacgccaagggcagccucacguucgacagcggguacuucuccgcccggugcuacccgcgcgccagcaacuccggccugcagcugaucaacgucacccagcacccugugaagaucgccaacaccccaggcccgaagcucagcaaccugaagacaaucaacugcaucaaccugaagguguccacggacaaggagcacagcgagcucgaggucaacgugcugcugccccagguggccgucaaccucuccaauugccacgugagcaucaaaucccacgugugcgacuacucguuggacaccgacggggcgaucaagcugccccggguggcccacaacggcguguucauccccgggaccuacaagaucgugaucgacaagaagaacaaccucaacgaccgcugcacccugaucacgaacugcgucaucaagggacgggaggugcgcaaggggcaguccgcccugcggcaguacaagaccgagauccgcaucggccagacuuucaccggcagccgccgccuccuggccgaagggggcuccagcgacugcaucucccggacgcagcuggucaagaccgagguggcggagauccacgaggauagcuacgggggcccgggggagaagaucaccaucugcaacggcuccaccauuguggaccagggccucgggagcgagcugggcugcuacacgaucaaccgcguccggagcuacaagcugugcgagaacuccgccucugggaaguccugcgagaucgacagcauccccgugaagugcaagcagggcuucugccucaagaucacccaggaggggcgcggccacgucaagcugagucggggcaccgagaucgugcuggacgugugcgacagcuccugcgagcugaugauccccaaggggaccggcgacauccucguggacugcagcgggggccagcagcauuuccugcagaacaaccugaucgaccucggcugccccaacgucccgcugcuggggaagauggccaucuacguuugccgcauguccaaccaccccaagaccacgauggccuuccucuucugguucagcuucggcuacgugauuaccugcaucgccugccgaguccuguucuaccugcucaucgcgaucgggacagugggcaagaagcugaagcaguaccgggagcugaagccccaaaccugcaucgugugcgagagcguccccgugaacgcaaucgacgccgagaugcacgagcucaacugcagcuacaacaucugcccguacugcgccucccgccugagcacggacgggcugauccggcacgugacacagugccccaagcgccgggagaaggucgaggagaccgaacucuuccuaaaccuggagcgcauccccuggcucgugcguaagcugcuccagguguccgagagcaccggcauggcccugaagcgcuccugcuggaugaucacgcugcugauccuccugcuggucucaaucucccccgugcagagcgcgccggugggcaaggagcgggccaucgagacauaccaggcccgcgagaccuacaccgggauuugccucuucgugcugggcagcgugcuguucgccguguccuggcucacgaaggcccugaucgacgggaucggcaauagcuucuccccggggcugagcgucugcaagaccugcuccauuggcagcaucaacggcuucgagaucgagucccacaagugcuacugcagccucuucugcugccccuacugccgggcgugcuccagugacaagaacacccaccgcaugcaccugaacgugugcaagaagcggaagauggguuccaacgugaugcuggccgucugcaagcgcaugugcuuccgggccaccauugaggccagcaacaaggcgcuccugauccgcuccaucaucaacagcacguucgugauaugcauccugauccucaccaucugcguggucuccaccagcgccguggacauggagaaccugcccgccggcaucugggagaaggaggaggaccugaccaacuucugccaccaggagugccaggugacggagaccgagugccucugcccguacgaggccaugguccugcggaagccccuguuccucgauuccaccgccaaggggaugaaaagccugcugaacuccaccagccucgagacgagcuuauccauagaggcgcccuggggcgccaucaacgugcagagcaccuucaagcccacaguguccgccgccaacaucgcccugagcugguccagcgucgagcaccgcgggaacaagauccucguguccggccgaagcgaguccaucaugaagcuggaggagcgcaccggcgugagcuggaaccugggcgucgaggacgcguccgagagcaagacgcucaccguguccgugauggaccugagccagauguacuccccggucuucgaguaccugagcggcgaccgccagguggaggaguggcccaaggcaaccugcaccggggacugccccgaacggugcggcugcacguccuccaccugucuccacaaggaguggccgcacagccgcaacuggcggugcaacccuaccuggugcuggggcguggggaccggcugcacgugcugcgggcuggaugucaaggacuucuucaccgacuacaugcuggugaaguggaagguggaguacaucaagacagaggccaucgucugcguggagcucaccagccaggagcgccagugcagccugauagaggccggcacccgcuucaaccuggggcccgucacgaucaccuuauccgagccccgcaacgugcagcagcggcugccgcccgagaucgugacgcugcaccccaagaucgaggagggcuucuuugaccucaugcacguccagaagauccugagcgccuccaccgugugcaagcugcagagcugcacgcacggcgugcccggggacuuccagaucuaccacguuggcaaccuccugcgcggggacaagguaaacggccacuccauccacaagaucgagccgcacuucaacaccagcuggauguccugggacgggugcgaccuggacuacuucugcaauaugggagacuggcccagcugcaccuacaccggcgugacgcagcacaaccgggccgccuucaucaacaugcucaacaucgagaccgacuauaccaagaccuuccacuuccacuccaagcgcgucacggcccacggggacacgccccagcuggaucugaaggccagacccgcguacggcgccggggagguaaccgugcucgucgagguggccgaccuggagcugcacaccaagaagcucgaggugagcggccugaagaucgccucccugaccugcucggggugcuacgccugcuccagcggcaucuccugcaagguccgcauccacgugaacgagccggacgaguucaccguacacguccggagcuccgaccccgacgugguggcggccggcagcucccucauggcccgcaagaucgaguucggggccgacagcaccuucaaggccuucagcuccaugcccaaggacagcuuaugcuucuacaucgucgagaaggacuacugcuccagcugcaccgacgacgacacgcagaagugcgugaacaccaagcuggaucacccccaguccauccucaucgagcacaagggcaccaucaucgggaagcagaacgauaccugcagcacgaagaccuccugcuggcuggagagcgugaagggcuucuucuacgggcugaagaacaugcucuccggcaucuucggcaacgucuuccuggggaucuuccuguuccucgcgccguucgugcugcugaucuucuucuucuucuucggcuggcggcucuuguucugccugaagugcugccgccgcacccgcgggcugcucaaguacaagcaccugaaggacgaggaggaggccggcuacaagaagaucaucgagcggcugaacggcaagaaggguaagagccaacucuucgacggggagcgucuggccgaccggaagaucgccgagcuguucuccaccaaaauccacaucggcuaa

SEQ ID NO: 15195 - RNA, 5088 nt, Artificial Sequence
  derived and/or modified CDS sequence (opt11) from CCHFV(ArD39554)__DQ211628.1__GP
augcugugccauaucaagcacauccuccuguucugcaucauccuguaucaccagcaguggaacacuggagccagcaacacaacgaucucccccaccaccaacaagagccacacggacauaucacaccagccgacgucaaucaccgccgcguccagccccgggucccccgccaccaccgcgcccccggagcguagcgugacccccucacacacacccaccaccagcgucuccgaggccgguagcggggagccgccggccgccacgcccgccuccgccaccgcccaaagccccgaacccgcguccgccgcccagccgagccccaccauccccaagcccacgacgccggacccgaccuccgaggcgcucagcacccccgccacuucccggccccaggagccgucuacgcaccccagcccccgcuccagccccuccaagccgguggagacccagagcacccggcacacggcgcgcgagcugcugagugugacgggcaccgaagccgagcagcucaucacccagaccauccacacgacaaaggaggccaccaaggccaccagcccccagcccacggccuccaaucccgacccgacccuggcgaccaccagccgguccaucaacagcaucaaccccaaagggcccgagagcacgcgcgccaccccgcagucgaccucgcccacccccgagucauccaccauccagacgcagauccugcccaucaucaccaccccuggaacccucgaggccaucauccaccccacgaaccggagcaagcgcaacuugggcaccgagaucauccugacccucccgcagggguuaaagaaauacuacuccaagguccugaagcucaugcaccugacccgggaagaggacagcgagggccuguuggaguggugcacgcgcauacuggggcagaccugcgacgacgacuacuuccaaaaacguaucaccgaguucuucaucaccggcgugggguacuucaacgaggugcugcuguucaaagaaacgaccgaugcccccacccuggccccgacacauaagggcgcgccgcccacggaacccuucaaguccuacuacgccaagggauucaucaccauggacagcggguacuucucagcaaagugcuacucccgcgccagcaacuccggccugcagcucaucaaugucaccaugcacagcuccaagaugcccaucacccccgggcccaaguacagcaaccugaagaacauaaacugcauuaaccuuaagguguccacggacaaagagcauaacgagguggagaucaacguccuccucccccaaguggccgugaaccugagcuccugucacguccucgugagaagccacgugugcgacuacucccuggacgcggacggcaugaucaagcugccgcagaucacucacgagggcaccuucauccccgggacauacaagaucaucaucgacaagaagaacaagcagaacgaccgcugcacgcucaucaccaacugugucaucaagggccgggaggugcgcaaggggcagagcgccuugcggcaguacaagaccgagauccgcgugggccaggccucaagcgggacccggcgccugcucuccgagagcaacaacaacgacugcgucucccggacgcagcugaucaagaccgagaacgcagagauccacggcgacgacuacggugggcccggcgagaagaucacaaucugcaacgggagcaccaucguggagcagcgccugggcuccgagcucgggugcuacacgaucaaccgcaucaaguccuucaaacugugcgaaaacucugcguccggcaagggcugcgagaucgacucgacccccguaaagugcaagcagggguuuugccugaagaucacccaggagggacgggggcacgucaagcucucccgcgguagcgagaucauacuggacgugugcgacuccagcugcgagaugaugaucccgaagggguccggcgacauccugguggauugcagcggcggacagcaacacuuccuccaggacaaccuggucgaccugggcugcccuaacgugccccuccuggggaagauggccaucuacaucugccggauguccaaccaccccaagaccacgauggccuuccuguucugguuuagcuucggcuacgucaucacgugcaucuucugcaaggugaucuucuacgugcuaaucaucauaggcacgcucgggaagcgcaucaagcaguaccgggagcugaagccgcagaccugcaccaucugcgaggccaccccgguaaacgcaaucgacgcugagaugcacgaccugaacugcuccuacaacaucugucccuacugcgccagcaggcucaccuccgagggccuggugcggcacgugacccaguguccgaagcgcaaggagaagauugaggagaccgagcuguaccucaaccuggagcggauccccugguucguacgcaagcugcuucaggugagcgaguccacggggguggcccugaagcggagcuccuggcuggucacccuccuagugcugcucaccgugagccugagccccguccaauccgccccgaucggacaggagcgcaccgugguaacguaccaaguccgggagagcuacaccgggaugugccuguucauccucggcuccguguuauucgccaucaguuggcugaccaagggccuaguggacuccgucgggaauaucuucuucccaggccugagcgugugcaagaccugcuccaucgggagcaucaacggcuuugagaucgagucccacaagugcuacuguagccuguucugcugccccuacugccgcuacugcuccgcggaccgcggggcccaccagagccaccucucggucugcaagaagagaaagacggggagcaacgucaugcuggccgugugcaagcggaugugcuuccgcgccacccugaagguguccagcgaggcccucauuauccgguccaucaucaacaccaccuucgucgugugcauccugauccuggucgucugcguggugagcacgucggcggucgagauggagaaccuccccgcaggcaccugggagaaggaggaagaccuuacaaacuuuugccaucaggagugccaggugaccgagacggagugucugugcccuuacgaggccuuugugcucaggaagccgcuguuccuggacucuacagccaagagcaugaagucacucuuaaacagcaccucccuggaaaccucccucuccaucgaggcgcccuggggcgcaaucaacguccagagcacguucaagcccacggcuuccaccgccaacaucgccuuaagcugguccuccguagagcaccgcgggaacaagauccuggugacugggagauccgaaagcaucaugaagcucgaggagaggacggguaucuccuggaaucugggcgucgaggacgcgagugaguccaagacccugaccgugagcgugauggaccucucccagauguacagcaccgucuuugaauaccuauccggcgaucgccagguggaggaguggcccaaggccacgugcacaggcgacugcccggagcggugcgggugcaccagcaguacgugucugcacaaggccuggccccacucccggaacuggcgcugcaaucccaccuggugcuggggcguggggaccggcugcacgugcugcgggcucgacgucaagaaucuguucaccgacuacaugcugaucaaguggaagguggaguucaucaagaccgaggccaucgugugugucgagcucacaagccaggaacggcagugcuccuugaucgaggccggcacccgcuucaaccugggccccgugaccaucacccucagcgagccgcggaacauccagcagaagcugccucccgagcuggugacgcuccacccccgcguagaggagggauucuucgacuugaugcacguacaaaaggugcuguccgcgucgaccgucugcaagcuccaguccugcacccacggcgugcccggugaccugcagguauaccacgugggcaaccugcucaagggcgacaagaucaauggcaauucguuccacaagaucgagcccaaccugaacaccuccuggaugagcugggacggcugcgaccuggacuacuacugcaacaugggggacuggcccaguugcacguacaccggcgugacccagcacaaccacgccgccuucgucaaccuccugaacaucgaaaccgacuacacgaagaacuuccauuuccacagcaagcgggugacggcccacggggagacgccccagcuggaccucaaagcccgcccgaaguacggcgcgggagaggugaccguccugguggagguggccgacauggagcugcacaccaagaagaucgagaucuccgggcucaaguuugccucgcugaccugcaccggcugcuacgccugcuccagcgggaucuccugcaagguacggcugcacguggacgagcccgacgagcucaccgugcacguuaagagcgacgaccccgacguggucgcggccuccagcagccugauggccaggaagaucgaguucggcaccgacuccaccuucaaggccuucuccuccaugcccaaggacaagcugugcuucuacaucgucgaacgggacuacugcagcuccugcagcaaggaagacacccagaagugcgugaacgcgaagcucgagcagccgcaguccauccugaucgagcacaaggguaccaucauuggcaaacaaaacgacacgugcaccgugaaggcgagcugcugguuggaguccgucaagagcuucuucuacggccucaaaaacaugcucgggggcaucuucgggaaugugauccugggcaucaucauguuccucgcccccuucgcccugcugcuccuguucuuccuguucggguggcgcauccuguucugccugcggugcugccgcagaacccgcggccuguucaaguacaagcacaucaaggacgacgaggaauccggcuacaagcggaucaucgagcgccucaacaacaagaaggggaagaacaagcuguucgacggcgagcgccuggccgacaagaagaucgcugagcuuuucagcaccaagacgcacaucggguga

SEQ ID NO: 15196 - RNA, 5088 nt, Artificial Sequence
  derived and/or modified CDS sequence (opt11) from CCHFV(AP92)__DQ211625.1__GP
augcccgaccacuucauccuguugcugcugauguacaccguguuccaccagcacccgcaggacgucagcgccaacgugcaucucguuaaucccuccaacagcaccacgggugccuccaccgcuuucaacccaguccacaacgccaccaccgacggacagaagcagagcacgucaaccaccaccauggcgcgccccagcaccgugacccagaucacaaccgcccaggccauggagguggacggcuccggggaaagcacgacccugccggcggucacccccacgcccgccgagacgaccacccacgccaaccagaaguccgccagcaccaugggcacgcugaccaccucccucgaggacacagccuuaaugacgcugaccgggcguagcauccucaccucccagagccagaccggcuccuucgaccgcacgagcaagccccagaccccgcggucuacaaaccaaccccugcgcaagcugcucucugcuguguccaccgaggccgcgccccagacgagccccaccgcugugaccgcagaccagacggaggccagcacguccccgcaggucaccaccgacaccagccccuccacaccuacgcaggucacuagcuccgccggaaguuccagcuccaacaccagcaaccacuccaagaccacgccccagcugaccagcuccgggagcgaggcucagcagacccagccgaccacaaugcccaacaccacugccuuagugacuccgacagcacacaucagccccacuaaccggagcaaacgcaacuccgaggucgagaucauccucacccugccgcagggccugaagaaauacuacagcaagauacucaaguuacuacaccucacccuggaggaggacuccgagggccugcuugaguggugcacgcguacacugaagcaagccugcgacgacggcuacuuccaggagcgcaucaaggaguucuuccugaccggggagggcuauuucaacgaggugcuccuguuccgaagccccagccagcugggcaccacggggucuccccucgccaguccacccaccgcagagcccuuuaaguccuucuacgcgaagggcuuccuaaucauggacagcggguacuucuccgcgaagugcuaccccaaggccagcaacuccggucugcagcucaucaacaucacccagcauuccaucaagguggucaacacucccggcccgaaguacucgaaccugaagacgguaaacugcaucaaccugaaggucagcaccgacaaggaccacucugagcucgaggucaauguguugcugccgcaaguugccgucaacauaucgaacugccacgugcucauuaaaucccacgucugcgacuacagccuggacaccgacgggaugauccgccugccccaggucacccacgagggcacguucaucccgggcacguacaagauagugaucgacaagaagaacaaguugaaugaccggugcacuaugaccacgaacugcgucaucaagggcaaggaggugcgcaaggggcagucaacccugcggcaauaccgcacagagauacggguuggccaaaugagcuccggcacccgccggcugcucagcgagggcggggacgggggcugcaucagccgcacgcagcugauaaagaccgagaccgccgagguccacggggacgacuacggcggucccggagaaaagaucaccaucugcaacggcuccaccauaguggaccagcggcuggggagcgagcucggcugcuacacgauaaaccgcaucaaguccuucaagcugugcgagaacucggcacaggguaagaacugugagaucgacucggcgcccgugcagugccggcagggcuacugucugaagauaagccaggagggccgcgggcacgugaagcuguccagaggcagcgagaucguacucgacgugugcgacacgucuugugagaucaugauccccaaggggaccggcgacauacuggucgacugcagcggcggucagcagcacuuucugcaguccaaccucgucgaccugggcugcccgaacaucccccugcucgggaagauggccaucuacaucugccggaugagcaaucaccccaaaaccacgauggcguuccuguucugguucucguuuggcuacgugaucacgugcauccugugcaagacccucuuuuauauccugaucaucaucgggacccuggggaagaaacucaaacaguaccgcgagcugaagccccagaccugcaccaucugcgagagcguuccggugaacgccauugacgcggagaugcacgacuuaaauugcuccuacaacauaugccccuacugcgcuagcagacucaccuccgaggggcugacccgccacgugaaccagugccccaagcggaaagagaagguagaggagacggagcuguaccucaaccuggagcgcauccccuggaucguucggaagcugcuccagguguccgaguccaccggggucgccuugaagcgcucuagcuggaugaucguacugcucauccugcugaucguguccaugagcccgguccagucagcccccaucagccaggagcgcacaguggccuuauaccagucccgcgaggacuauaugggcaucugccuggugauuauggggagcguccugcuagcggugucccugcuggugcggggccucaucgacagcaucuccucaaccuucuucccggggcuauccgucugccgaacgugccacaucggcagcaucaauggcuucgagauagagucccauaagugcuacugcgggcugcucugcugccccuacugccgggccugcagcaccgaccaggacgcccaccaguuccaccuauccgugugcaagaagcgcaaggccgggagcaacguuaugcuggccgucugcaagcggaugugcuucaaggcgaucaucgaggcguccaacaagguucucuucauccgcaacgugauaaacaccacauucguggugugcauccuggugauggucgccugcaucgcaagcagcgccgcgguggaaauggagaaccugccggccgggacgugggagcgggaggaggagcucaccaacuucugccaccaagagugccaggugaccgagaccgagugccugugccccuacgagagcuucauccugcgcaagccccucuuccuggacagcauugccaagggcgucaagaacuugcucaacuccacgagccuggagacaucccugagcauugaggcccccuggggcgcgaucaacgcccaguccaccuauaagccgaccgccagcuccgcaaauaucgcccucaccuggagcaguguggagcaccgggguaacaagauccuggugagcggucgcuccgagagcaucaugaaguuggaggagcgcacugggaucuccuggaaccucggcguugaggacgcgagcgagucccgcacuuugaccauaagcguuauggaccugucccagauguacagccccguguucgaguaccuuuccggggaucgccaggucgaggaauggccgaaggccacgugcacgggcaacugcccggagcggugcgggugcaccagcuccacgugccuguacaaggaauggccgcacagccgcaauuggcgaugcaaccccaccuggugcuggggcgugggcaccgggugcacgugcugcggccuggacgugaaggaacucuucaccgaccacaugcuagucaaauggaagguggaguauaucaagaccgaggcaauaguaugcgucgaacugaccucacaggagcgccagugcucccuuauagaagccgggacccgguucucgcucggucccgucaccauuacccuguccgagccgcgcaacauucagcagaagcucccgcccgagcugaucacgcugcacccaaagaucgaagacggguacuucgaccugaugcacguccagaaggugaugucugccuccaccgugugcaagcugcagagcugcacccacggcgugcccggcgaccugcagaucuaccacguggggaacuugcugaagggcgaccgggugaacggccacuuaauccacaaggucgagccccaccucaacaccucuuggaugagcugggacggcugcgaccuggacuauuucugcaacaugggcgauuggcccuccugcacguacacuggggucacccagcacaaccacgcugccuucgccaaccugcucaacaucgagacugacuacacaaagaccuuccacuuccacagcaagcgggugacggcccauggcgauacgccccaacuggaccugaaagcacggccgcgcuacggcgccggggagaucaccguacucguggagguggccgacauggaacugcacaccaagaaggucgaggugaccgggcugaaguucgccucccugaccugcagcggcugcuacgccugcucuagcggaauuuccugcaagguacguauccacgucgacgagcccgacgagcucaccguacacgucaaaagcucugaccccgacaucguagcggccagcagcucccugauggcccgcaagaucgaguucgggguggacagcaccuucaaggccuucucuucaaugccaaaggauucccucugcuucuacaucguggaacgggacuacugcaacagcuguaagaaugaagagacccagcgcugcgugaacgcgaagcuggagcagccgcaauccauccugaucgagcacaccggcacgaucaucgggaagcagaacgacacguguggcagucggaccuccugcuggcucgacagcuucaaguccuuuuucuacgggcugaagucuaugcuuagcggcaucuucggcaacguguuucuugggaucuuccuguuccuagcgcccuucgcccuucucuuguucuucuuuuucuucggcuggaggaucuuauuuugcuucaaaugcuguaggcgcacccggggccucuucaaguaccgccacauuaaagacgaugaggagguaggguacaagaaaauaaucgagcgccugaacaacaaaaagggcaagcaccggcugcucgacggggagcgccuggcugaccggaagaucgcagagcuguucagcacuaagacccacaucggguga

SEQ ID NO: 15197 - RNA, 5085 nt, Artificial Sequence
  derived and/or modified CDS sequence (opt11) from CCHFV(UCCR4413)__KY484038.1__GP
augcugcgcuacauccucuacgcccugcuggccagcgcgauccuccaccagcaccuguacaaggugggcgccgacacccagaagcccaccguccggacaaacaccacccacaagaucuccccgaccgccacagccaaccgcaccaccuacgagcaggccacccccagcacgacccccaaguccagcaccaagcccaccacccacaucgcgaccgcccaccuggccgaguccgacgggagcggcgagaccacccuccugcugccgacgaccgccucccaguacaccaccgaggggcagacaagccucgagcccaccgcggaggagaccggcuccaacaccauccccagcgacacgaccuccaccagccccaucaccgagaacagcgagagcacugacacccagaugaacguguccgacagcuccagcuccccgcuggccacccagggggcccggagccccgcccgcaaccugcuaagcgugcccuccgucgagcccggccagcagaccacgccgaagcagcccaccaccaagggcaccgugacgcccaccaccccgcagccgaccaccagcucccccacgcccgcccccaccagcgcgacgcuguccaccaacagcuccucuaucuccacgccggugcagaccagcagcccccugcagcccauggcccccucccacgagacccagcacgcucucuacaccacguccacugagagcacccugcgcacccuguccgccgagcgcauccacccgaccaaccggagccgccggaacuccgaggucgagaucauccucacccugccccaggggcugaagaaguacuacucccgccuccugaagcugcuccaucugaccauggaggaggacaccgagggccugcaggaguggugcgugcgggugcucgggcagacgugcgacgacuccuacuuccacaagcgccuggccgaguucuucaucaccggcaccggguucuucaacgagguccuccucuuccggagcccgagcacccccacgaccaucaaaccgucccccaccggcagccccacuguggagccguuccgcuccuacuacgcgaagggcagucugacgaucgacuccggguacuucagcgccaagugcuacccccgaaccuccaacucuggccuacagcucaucaaccugacccagcacucuguggagaucgccaacacccccgggcccaagcacagcucccugaagacgauuaacugcaucaacaucaaggccagcaccgacaaggagcacaacgaggucgagaucaacgugcuccugccccaggucgccaucaaccuguccaacugccacgucagcaucagaucccacgugugcgacuacagccucgacaccgacggcaaaauccggcugccccagaucucccacgagggcaccuuuauccccgggacguacaagauuaucaucgacaagaagaacaagcugaacgaccgcugcagccucaucaccagcugcgugaucaagggccgggagcugcgcaaggggcaguccacccugcggcaguacaagaccgagaucaagaucggccagacgaguucagggagccgccgccuccuguccgagucuuccgcgagcggcugcaucucucggacccagaugaucaagagcgagaccgccgagauccacgacgacaucuacggcgggcccggcgagaagcugaccaucugcaacgggaccacggucguggaccagcgccucggcuccgagcuggggugcuacaccaucaaccggaucaaaaccuacaagcugugcgagaacagcgugaaggagaagaccugcgagaucgacagugucccggugaagugccgccagggccugugccucaagaucacgcaggagggccgggggcacgugaagcugagccgcggcuccgagaucguccuggacaucugcgacagcuccugcgagcucaugauccccaaggggaccggcgacauccugguggacugcagcgggggccagcaacacuuccugcaggacaaccucgucgaccugggcugccccaacaucccccugcucgggaagguggccaucuacaucugccggauguccaaccacccgaagaccaccauggccuucuuauucugguucagcuucggcuacguaaucacgugcauccugugcaagauccucuucuaccugcugaucaucacggggacccuuggcaagaagcugaagcaguaccgcgagcugaagccccagaccugcacgaucugcgagagcacccccgucaacgccaucgacgcggagaugcacgaccucaacugcuccuacaacaucugccccuacugcgccagucggcugaccuccgacggcuuaauccgccaugugaaccugugcccgaagcggaaagagaagguggaggagaccgagcuguaccugaaccucgagcgcauccccugguucguccggaagcugcuccaggugagcgaguccacggggguggcccugaagcgcagcuccuggcuacugauccucgucauccugcugaccgugagcaugucccccgugcagagcgcccccaucaaccagcagcgggcggucgaggccuaccaggcccgcgagggcuacaccgggaucugccucuucauccugggguccgugcuguucaugaccagcuggcuaacgaaggggcugaucgacuccaucggcgacagcuucuucccgggccuguucgugugcaagaccugcuccaucgggagcaucaauggcuucgagaucgagucccaccggugcuacugcagccuccugugcugccccuacugccggaccugcuccgccgacaaagacagccaccagcugcaccucagcaucugcaagaagaagaaggccggguccaacgucaugcuggcggugugcaagcggaugugcuucaaggcuaccaucgaggccagcaaccgcgugcugcucauccgcuccaucaucaacacgaccuucaucaucugcaugcugauccuggucgugugcgugaucagcaccagugccgucgagauggaggaccuccccgccggcaccugggagcgggaggaggaucugacgaacuucugccaccaggagugccaggugaccgagaccgagugccugugccccuacgaggcguucgugcuccgcaagccgcuguuccugucuuccaucgucaaggggaagaagaaccuccuuaacagcgccucacuggagaccagccucaguaucgaggcccccuggggcgcuaucaacgcccagagcacguucaagcccaccauauccaccgcgaacaucgcccugagcugguccucaguggagcaccggggcaacaaggugcugguguccgggcgcagcgaguccaucaugaagcucgaggagcggacuggcaucagcuggaaccucgggguggaggacgccagcgagucccgcaugcugacggugagcgucauggaccucucccagauguaccugccgguguucgaguaccugagcggcgaccgccagguggaggaguggcccaaggcgaccugcaccggggacugccccgagcgcugcggcuguaccuccagcacgugccuccacaaggaguggccccacucccggaacuggcgcugcaacccgaccuggugcuggggaguugggaccggcugcacgugcugcgggcuagacgugaaggaccuguucaccgacuacauguucgugaaguggaaggucgaguacaucaagaccgaggccaucgugugcguggagcucaccucccaggagcggcagugcucccugaucgaggccggaacccgcuucaaccuggggcccgucaccaucacgcucagcgagccccggaacauccagcagaagcugcccuccgagaucgugacccugcacccuaagaucgaggagggcuuuuucgaccucaugcacgugcagaagguucugucagccuccaccgugugcaaacuucagucuugcacccacggcguggccggggaccuccaggucuaucacgugggcaaccugcugaagggggacaagaucaacggccacuccauccacaagaucgagccccaccucaacacgagcuggauguccugggacggcugcgaccuggacuacuacugcaacaugggggacuggcccagcugcaccuacaccggcgugacccaacacaaccaugccgcguucgucaaccugcucaacaucgagacggacuacaccaaguccuuccacuuccacagcaagcgcgugaccgcccauggggacacgccccagcuggaccugaaggcccggccgauguacggcgccggggagaucaccgugcucgucgagguggccgacauggagcugcacagcaagaacaucgagaucuccggccugaaguucgcgagccugaccugcuccggcugcuacgccugcagcuccgggaucagcugcaagguccgcauccacguggacgagcccgacgagcuggccgugcaugucaaguccgacgaccuggacguggucgccgccagcuccagccucauggcgcggaagaucgaguucggcaccgacaguaccuucaaggccuucagcuccaugccgaaggagucucucugcuucuacaucgucgagcgcgacuucugcaaguccugcgccgccgaggacacgcagaagugcgugaaggcgaaacuggagcagccccagagcauccugaucgaacauaaggggaccaucaucggcaagcagaacgacacgugcuccaccaagaccagcugcuggcucgaguccuucaagagcuuuuucuacgggcugaagaacaugcugagcggcguguucggcuccgccaucauggggauccuccuguuccuggccccguucauucuccugauacuguucuucuucuucggcuggcggauccucuucugucugcgcugcugccggcgcacccgcgggcuguucaaauacaagcacaucaaggacgacgaggaggccggcuacaagaagaucaucgagaagcucaauaacaagaagggcgggaccagcaaguugcuggacggcgagcggcucgccgaccgcaagaucgcggagcuguucuccacuaaagcucacaucggguga

SEQ ID NO: 15198 - RNA, 5076 nt, Artificial Sequence
  derived and/or modified CDS sequence (opt11) from CCHFV(SCT ex Afghanistan)__KC344856.1__GP
augcaucaugccuaccagaucauguacacccuguuggugugcgccaucuugugcccccagccguggagccuggagggcacccacgucccccucaacgggacgaagcauaacgggaccgggaucaccgcggcccccggcgggucccaggggcccaccagcccggccuccacggccgugucgcugacccccgacccuuucaccaccgagcccacggccuccgcgguggaacuggagagcuccggcgaggggcacaccagccucuccgucacuacccagggccugacgagcccggagaccacccccgggcuccccaccgugacggacaccggcguguccagcaccuccaucuucgggaucggcauccgcgucgccggcgacacccccacgagcaccacccacaccgggcucccguccucacccuccaugcccagcacggcccaaggcccccaccacgccgugcgggggcugcuguccgugagcagcacccgccccggcgaggcgucuaccaucacuguccccggcgaggccgggacggaggccaacagcuccagcuccgccaucagcaagaagcccgcccccuccccgaccgcggaagccaucaccgaggccaacaacagcuccaacccccgacagccugaacuuucaacccagcccgccaucccgggccuggugacguccagcgcccaaccaauucugcuccaguccgccaccucuaccgccgcccaggacaucuaccccucccccaccaaccguagcaagcgcaaccuugagauggagaucauccugacacucucccaggggcugaagaaguacuacggcaagauucugcgcauccucgaccugacccuggaggaggacaccgaaggcuugcuggaguggugcaagcggaaccuuggccugaccugcaacgacaauuucuuccaggagcgcaucgaggaguucuuccuuaccggcgaagggcacuucaacgaggugcugcaguucaagacgccgagcacccucucccccaccgagcccacccacacccggaccccaaccgucaagcccuuuaagagcuacuucgcgcgcggcuuccugagcaucgacuccggcuacuucucugccaagugcuauuccaagaccagcaacuccggccugcagcucaucaacaucacccagcacccggcgcggaucgccgacacccccggaccuaagauaacaaaucugaaggcuaucaacugcaucaaccugaaggccagcguguucaaggagcaccgcgagaucgagaucaacgugcuccuaccacagguugccgugaaccugucuaacugccacguguugauuaaaagccacgucugcgacuacucccuggacaucgacggcgcggugcggcugccccacgugcaccacaagggcaccuucauccccgggacguacaagaucguaaucgacaagcgcaacaagcaaaacgaccgguguacccucguaaccaacugcgugaucaagggcaaggagauccgcaaggggcagagcgcccugcggcaguaccgcaccgagauccggaucgguaaggccuccgcaggaagccgccggcugcucuccgaggagagcggcgacgacugcaucucccgcacgcagcugcugcguaccgaaacagcggagguccauaacgacaacuacggcgggccgggcgauaagaucacuauauguaacgggagcacgaucgucgaccaacgguuaggcuccgaacugggcuguuacaccaucaaccgcgucaagucauucaagcugugugagaacagcgccaccggaaaguccugcaagaucgacagcacccccgucaagugccgacagggcuucugccugaagauuacgcaggaggggcgcggucacgugaagcucucacgggggagcgaggucguguuggacgccugcgacuccucaugcgagaucaugauccccaagggcaccggcgacauccugguugacugcuccggcggccagcagcacuuccucaaggacaaccugaucgaccuggggugccccaacaucccgcuccugggcaagauggccauauacaucugccgcaugagcaaccaucccaagaccaccauggccuucuuguucugguucuccuuuggguacgucaucacgugcaucuucugcaaggugaucuucuaccuccugaucguugucggcacccugggcaagaaguuuaagcaguacagggagcucaagccucaaaccugcaccaucugcgagacgacccccaccaacgcgaucgacgccgagaugcacgaccugaauugcuccuacaacaucugcccguacugcgccucccgccugaccagugacgggcucgcgcggcauguaacgcagugccccaagcgcaaggagaagguggaggagaccgagcuguaccugaaccucgagcggauccccuggaucguccgcaagcugcuccagguguccgagagcaccggcguggcacucaagagauccagcuggcugaucguccugcucgugcugcugaccgucucccucagccccguccaguccgcaccgaucgggcacggcaagaccaucgagacguaccagacccgcgaaggguacaucagcguaugccuguucguccuuggcggcauccuuuucgucguuucaugccugaucaaggggcugguggacuccgucggcaauagcuucuuccccggacucagcaucugcaagaccuguagcaucggcuccguaaacggguucgagaucgagagccacaagugcuacugcucccugcugugcugccccuacugccggcacugcuccaccgaccgcgagauccaccagcuccaccugaguaucugcaagaagcggcgcacgggcggcaacgugaugcucgcugucugcaagcgaaugugcuuccgcgccacaauggaggugucgaacaagguccucuucauccgcaacaucauaaacaccacuuucgugaucugcauccugauccuggccguguguguggucuccacgagugccguggagauggagucccuccccgcggggaccugggagcgggaggaggaccugaccaacuucugccaccaggagugccaggugaccgagacagagugccugugcccauacgaggcccucgugcugcgcaagccccuguuccucaacucuaucgugaagggcaugaagaacuuacugaacucuaccaaucucgagaccagccuguccaucgaggcccccuggggcgccaucaacgugcagaguaccuucaagccgacggugucgaccgcgaacauagcccugagcuggagcuccguggagcaccgggggaacaagauccucgugagcggccgcuccgagagcaucaugaagcuggaggagcggaccgggaucuccugggaccugggcgucgaagacgccagcgagucaaagagccuaaccguuuccgugauggaucugagccagauguacucaccaguuuucgaguaccugagcggggaccgucagguggaagaguggcccaaggccacgugcaccggcgacugucccgagcggugcgguugcaccuccagcacgugccuccacaaggaguggccucacucccgcaacuggcggugcaaucccaccuggugcuggggcgugggcaccgggugcacgugcugcggccuggacgucaaggaccuguucaccgacuacauguucguuaaguggaagguggaguauaucaagaccgaggcuaucgucugcgucgagcuuaccagccaggagcgacagugcucccugaucgaagcggggaccagguucaaccugggccccgucaccauuacccucagcgagccccgcaacauccaacagaaacugccgcccgagaucaucacccugcacccccggaucgaggagggguuuuucgaccucaugcacgugcagaaggugcuguccgccucgaccgucugcaagcugcagagcugcacccacggcgugcccggcgaccuccagguguaccacauugggaaccugcugaagggcgacaagcucaacgggcacaugauccacaaaaucgagccgcacuucaacacguccuggaugagcugggacggaugugaccuggacuacuacugcaacaugggggacuggcccuccugcaccuacaccggcguuacccagcauaaccacgccgccuucgugaacuugcucaacaucgagacggauuacacgaagaauuuccacuuccacagcaaacgcgugaccgcccacggcgacacgccgcagcuggaccugaaggcgcggcccaccuacggggccggcgagaucaccgucuuaguggagguggccgacauggagcugcacacaaagaagaucgacaucuccgggcugaaguucgcgagccugaccugcgcaggcugcuacgcguguuccagcggcauaagcugcaagguccgcauccacguugacgagccggacgagcucaccgugcacgucaagagcgaggaccccgacaucguggccgcauccacgagccucaucgcccggaagcucgagcuggggaccgauuccaccuucaaggcguucagcgccaugcccaagaccucccucugcuuuuacaucguugagcgugaauacugcaagagcugcuccaaagaagacacgcagaagugcgucaacaccaagcucgagcacccccagggcauccugaucgagcacaaggggaccaucaucggcaagcagaacgacacgugcaccgccaaggccgggugcuggcuggagagcgugaaauccuucuucuacggacucaagaacaugcugagcggaaucuucggcaacgucuucaucggcaucuuccuguuccuggcccccuucguccugcuuauccuguucuucauguucggguggcggcuccuguucuguuucaagugcugccgccggacccgcggccuguucaaguaucgccaccucaaggaggacgaggagagcggguaccggcgcaucaucgagcgguuaaacaauaagaaaggaaagaacaagcugcucgacggcgagcgccuggcggaccggcgcaucgccgaacuguucagcaccaagacccacaucggguga

SEQ ID NO: 15199 - RNA, 5070 nt, Artificial Sequence
  derived and/or modified CDS sequence (opt11) from CCHFV(SPU 431/85)__KJ682812.1__GP
augcccgugaacaucauguacacgccccuggucugugcugucaucugccuccagcuuuggaacuuaggcgggacccucgugagcacuaaccgcacccagcacaacgagaccgggacgguugcaacccccgaggggacacugcggccccgccugcccguguccacggcccucccgacuaagagcgaccguccguccguggggcccgccgccagcuccagcgggcuagagggcucuggcgaacccaacaccagccccuccaucaccaccaaggggcugaccccgcccgagaccacccccgcccuccccaccgccacugacaccgacgccagcuccaccggagucguggacgugagcacccagaugaccaaagacauccccaugucaaccgccuacaccaacccuccgagcaccccguccgccccuagcacgccccaagggacgcaccacaccgcccgcgggcugcuguccgucgcgagcacaaaguccgaggaggugagcaugagcaccucccccgcuaagacuucuaccgagaccuccagcccuccgcccgccaccuccgagacgcccacucccucacccaccacccagguucccacgggcaacaauaaccccaacaccucccggcagcccacccccagcgcccagcccgccaugagcaacccggcgaccagcccagcccagccgaacuugagucagagcgcgccgcccaccgcggaccaaggcguccaccccucacccacgaacagaagcaagcggaacuuagagaucgagaucauccugacccucucccagggccugcgcaaguauuacgggaagauccugaagcuccuggaccugacccucgaggaggacaccgagggccugcuggaguggugcaaacggaacuuggggcugacgugcgacgacaacuucuuccagaagcgcaucgaggaguucuuccugaccggcgaaggcuacuuuaacgaggugcuccaguucaaggugcccagcacucuuuccagcacggagcccacgcacacccggccgcccaccgucgagcccuucaaguccuauuuugccaaaggguuccuaagcaugaacagcggcuacuucuccgcgaaaugcuacccgaggaccucuaacuccgggcuccagcugaucaacgugacgaagcacagcgccaagaucgccgacacccccggcccaaagaucaccaaccuaaagaccaucaacugcaucaaccuccgggccuccguguucaaggagcacagggaggucgagaucaaugugcuguuaccccagguugccgucaaucucagcaacugccacgcccagaucaagucccacgucugcgacuauagccuagccaccgacgggauggugagacugccgcacauccaccaugagggcaccuucauccccggcacuuacaagaucguuaucgauaagaagaacaagcagaacgaccgcugcacccucgugacgaacugcgucaucaaggggcgggaggugcgcaagggccagucugcccugcggcaguacaagaccgagauccgcaucggcaaggccuccuccggcagccggcgccugcucuccgaggagagcgacggggacuguaucucccgcacccagcugcuccggaccgagacgaccgagauccauuccgacaacuacggcggccccggggacaaaaucaccaucugcaacggcuccaccauagucgaccagcgccucgggagcgaacugggcuguuacacgaucaacagagucaagagcuucaagcugugugagaacuccgccaccggcaaguccugcgagaucgacuccacccccgugaagugccgccaggguuucugcuugaagaucacccaggagggccgggggcacguuaagcucagccgcggcuccgagaucguccuggacgcaugcgacucuaacugcgagauuaugaucccgaaggggacgggcgacaucuuaguggacugcuccggcgggcagcagcacuuucucaaggacaaccugauagaccugggcugucccaacaucccccuccuggguaagauggccaucuacaucugccggaugagcaaccaccccaagaccaccauggcauuccuguucugguucuccuucggcuacgugaucacgugcauccucugcaaggucaucuucuaccugcugaucguugccgggacggugggcaagaaguucaagcaguaucgcgagcuccguccgcagaccugcaccauuugcgaaaccauccccgucaacgcgaucgacgccgagaugcacgaccucaauugcagcuauaacaucugucccuacugugccucccgccuuaccagcgacggccucgcccggcacgugaugcagugcccgaagcgcaaagaaaaaguggaggagacggagcuguaccugaacuuagagcggauccccugggucgugcgcaaacuucuccagguuuccgagagcaccggggucgcucucaagcgcuccagcuggcugaccgugcugcucgugcugcugaucgucucccucucgcccgugcaguccgcgcccaucggccacgggaagacaaucgagacguaucaggcccgcgagggcuacaccagcuucugccuguucaucuuggggagcauccucuucguugucaguugccuggugaagggccuuaucgauagcguuggcaacucguucuucccggggcucagcaucugcaagaccugcuccaucggaucaaucaacggguucgagaucgagagccacaaguguuacugcagccuguucugcugccccuauugccggcacugcccagccgaccgcgagauccacaagcugcaccucuccaucugcaagaaacggaagaccggcagcaacgucauguuggcagucugcaagcgcauguguuuccgcgccacgaucgagguguccaaccgggcgcugcucauccgcaauaucauuaacaccaccuucgucguguguaucuugaccuuggccgugugcgucgugagcacguccgccguggagauggagagucuccccgccgggaccugggagaaggaagaggaccugaccaacuucugccaccaggagugccaagucaccgagacagaaugccucugcccguacgaggcccucguccugcggaagccccuguuccuagacucgaucgucaagggccgaaagaauuuacugaacagcacaucccucgagaccucacuguccaucgaggcgcccuggggcgcaauaaacguacagagcaccuucaagcccacggugucggccgcgaacaucgcgcuguccuggagcuccgucgagcaccgggggaacaaaauccucgucucuggccgcuccgagagcauuaugaagcuggaggagcggaccgggaucuccugggaucugggcguggaggacgccagcgaguccaagcuccugaccgugagcgucauggaccugucccagauguacagcccgguguucgaguaccucucuggggaccgccagguggaggaauggcccaaggcgaccugcacgggcgacugucccgagcggugugguugcacuagcagcacgugcuuacacaaggaguggccccauagccgcaacuggcggugcaacccgaccuggugcugggguguggguaccgggugcacaugcugcggccuggacgugaaggaccucuucacugacuacauguucgugaaguggaaggucgaguacaucaagaccgaggccaucgugugcgucgagcugacgagccaagagcggcaaugcagccugaucgaggccgguacccgguucaacuuagggcccgugaccaucacccuguccgaaccccgcaacauccagcagaaguuacccccggagaucaucacgcuccacccccggaucgaggagggcuucuuugaucucaugcacguucagcgcgucuuaagcgcaagcacagugugcaagcuccaaagcugcacccacggagugcccggcgaccugcaggucuaccacauagggaaccuguugaagggcgacaagguaaacggacaccugauccauaagauugaaccccacuuuaacacaagcuggaugucaugggacgggugcgaccuggacuacuacugcaacaugggcgacuggccgaguuguaccuacacgggggugacgcagcauaaccacgccgccuuuguaaaucuccugaacauugagaccgacuacaccaagaacuuccacuuccacucaaagcgaguuacggcccacggcgacacgccccaacuggaccucaaggcacgccccaccuacggggcuggcgaggugacaguccugguggagguggccgacauggagcugcacacgaagaaaaucgagaucagcggccucaaguucgccucccugaccugcaccggguguuaugccugcagcuccggcaucagcugcaaggucaagauccacguggacgagcccgacgaauuaacagugcacgucaaguccgaggacccggacaucguggcagcugggagcucccucauggcccggaagcuggaguucggggccgauagcacguucaaggccuucucggcgaugcccaagaccagccugugcuucuauaucguggagcgcgaguacugcaaguccugcagccgcgaggacacccgcaagugcgugaacaccaagcucgaccgaccccaauccauacugaucgagcacaaggguacuauaauagguaagcagaacaacacgugcacggccaaagccagcuguugguuagagagcguuaagaguuucuuuuacggccucaagaacaugcugagcgggaucuucggcaacgucuucaucggaaucuuccuguucaucgcuccguucguccuccugauccuguucuucauguucggcuggcggauccuguucuguuucaagugcugccgcagaacccgcggccucuucaaguaccggcaccugaaagacgaugaggaaacaggguacagaaagaucaucgagagacugaauaacaagaagggcaagaacaagcuccuggacggggaacgccuggccgaucggaaaaucgcagagcuguucuccaccaagagccauaucggcuaa

SEQ ID NO: 15200 - RNA, 5070 nt, Artificial Sequence
  derived and/or modified CDS sequence (opt11) from CCHFV(SPU 556/87)__KJ682811.1__GP
augaccgugaacaccgucugcacgccccuggugugcgccguguucugccuccagcuguggaaccugggcgggacccucgucccgaccaaccgcacccagcacaacaagacgggcaccauggccacccccgaggggacccugggcccccggcugcccgugagcacggcucucccgaccaaauccgaccgccccagcguggggcccgccgcgcccucgagcggccuggagggcucgggggagccgaacaccucucccuccaucacgacgaagggcuuggcccuccccgagaccacccccgccccacccaccgcgacggacaccgacgccagcuccaccgggguugugaacgugagcacccagaugaccaaggacauccccauguccaccgccuauaccaacccgcccagcacccccuccgccccuagcacgccccaggguacccaccacacggcgcgugggcugcuguccgucgccagcaccaagucggaggaggugagcauguccacgagcccgggcaaaaccagcaccgagaccuccagcccacccccagccacguccgagacccccgccccuagccccaccacgcaggcccccacgggcaacaacaaccccaacaccucccgccagcccacccccagcgcgcagcccgccaugucuaacccuaccaccagccccgcccagcccaaccuccugcagaacgccccucccacggccgaccagggggugcaccccggccccaccaaucggaguaagcgcaaccuggagauggagaucauccucacccugagccaggggcugcggaaguacuacggcaagauccucaaguuccuggaucugacccuugaggaggacacggagggccuccuggaguggugcaagcgcaaccucgggcuaaccugugacgauaacuuuuuccagaagcggauagaagaguucuuucugaccggcgaaggguacuuuaacgagguccuccaguucaaggugccguccacccugagcuccacggagcccacccauaccggcaguccgaccguggagcccuucaaguccuacuucgcaaagggguuccuuagcaugaacuccggcuacuucagugccaagugcuacccgaggacguccaacagcggccuccagcugauuaaugucacaaagcacagcgccaagaucgccgacacccccgggcccaagaucaccaaccugaagacuaucaacugcaucaaccuccgugcauccguguucaaggagcaccgcgagguggagaucaacguccuguuaccccagguggcggugaaccuuagcaacugccaugcccagaucaaaucccacgucugcgacuacagccuggccaccgacggcauggugagacugccgcggauccaccacgaggggaccuucaucccaggcaccuacaagaucgugaucgacaagaagaacaagcagaacgaccggugcacgcucgugaccaacugcgugaucaaggggcgagagguacggaagggccaguccgcccugcgccaguacaaaaccgagauccggauaggcaaagcgucuuccgguagccgccggcugcucuccgaggagucugacggugacugcaucucacgcacccagcugcugcgcacggagaccgcggagauacauucggacaacuacgggggucccggugauaaaauaacuaucugcaacggcuccaccaucguggaccagcgucucggaagcgagcuggggugcuauacgaucaaccgugugaaguccuucaagcugugugagaacagcgccaccggcaaguccugcgagaucgacagcacccccgucaagugccggcagggguucugccucaagaucacucaggagggccgcggccacgugaagcugagccggggguccgagaucgugcuggacgccugcgacagcuccugcgagaucaugaucccgaaagguacgggggauauccuugucgacugcucgggcgggcagcagcacuuccucaaggacaaucugaucgacuuagggugccccaacaucccccuccugggccgcauggccaucuacaucugcaggauguccaaccaccccaagacuaccauggcguuucuguucugguucagcuucggguacgucaucacgugcauccuaugcaaggugaucuucuaccugcugaucgucgcaggcaccguggggaagaaguucaagcaguaccgcgagcuccggccgcagaccugcacuaucugcgagaccacgcccgugaacgccaucgacgccgagaugcacgaccugaacugcuccuacaacaucugccccuacugcgcuagcagacugacguccgacggccucgcgaggcacgucaugcagugcccgaagcgcaaggagaagaucgaggaaaccgagcuguaccugaaccucgagcggauccccuggguggugcgcaagcugcugcaagucagcgaguccaccgggguagcccucaagcggucuaguuggcugaccgugcugcuuguccugcucaucgugagccucucccccgugcagagcgcccccaucggccacggcaagacaaucgagaccuaucaggcccgcgagggguacaccuccuucugccuguucauccugggcagcauacucuucaucgucuccugccuggugaaggggcucaucgauagcgugggcaacagcuucuucccugggcucucuaucugcaagaccugcagcaucggcuccgucaauggcuucgaaaucgagagucacaagugcuacugcucccuguucugcugccccuacugccgccauugcagcgccgaccgugagauccacaagcugcaucucuccaucugcaagaaacggaagacggggaguaacgugaugagugcggugugcaagcgcaugugcuuccgcgccacuaucgaggucuccaaucgggcccugcugauccgcuccaucaucaacaccaccuucgccgugugcauccugacgcuggccgugugcgucgugagcaccagcgcgguggagauggagucccugcccgccggcaccugggagagagaggaggaccucaccaacuucugccaccaagagugccaggucacggaaaccgagugccugugccccuacgaggcccuggugcuccgcaagccgcuguuccuggacuccaucgugaaggggaagaagaaccuccugaacagcacgucccuagagaccagccucucgaucgaggcccccuggggcgcgaucaacguccagagcacguucaagcccaccgugagcgccgccaacaucgcccuguccuggagcuccguggagcaccgagggaacaagauccuugucagcggccgcuccgaaagcaucaugaagcucgaggagcggaccgguaucuccugggaccuggggguggaggacgccagcgaguccaagcuccucaccgugagcgucauggaccugucccagauguacagccccguauuugaguaccuguccggcgaccgccagguagaggaguggccgaaggcgacgugcaccggggacugccccgagagaugcggcugcaccagcuccacgugccuccacaaggaguggccccacagccgcaacuggcggugcaaccccaccuggugcuggggcgucgggaccggcugcacgugcugcgggcuggacguaaaggaccuauucaccgacuacauguucgugaaguggaaggucgaguacauuaaaacagaggccaucgugugcguggagcugaccucccaggagcgccagugcagccugaucgaggccggaacccgguucaaccuggggccgguaaccaucacgcucuccgagccccgcaacauccagcagaagcugccgcccgagaucaucacccugcacccccggaucgaggagggcuucuuugaccucaugcacgugcagaagguccugagcgccagcaccguguguaagcugcaguccugcacccacggcgugcccggggaccuucaggucuaccacaucggcaaccugcugaagggggacaaggugaacggccaccucauccacaagaucgagccccacuucaacaccagcuggaugaguugggacgggugcgaccuggacuacuacugcaacaugggugauuggcccagcuguacguacacuggcgugacccagcacaaccacgccgcguucgucaaccugcucaacaucgagacggacuacacgaagaacuuccacuuccacucgaagcgcgugaccgcccauggggacaccccgcagcuggacuuaaaggcccggcccaccuacggcgccggggagguuacgguccucguggagguggccgacauggagcuucacaccaagaagaucgagaucagcggccugaaguucgcgucccucagcugcaccgggugcuacgccugcuccagcggcaucuccugcaaggugcgaauccacguggacgagcccgacgagcugaccgugcacgugaaguccgaggaccccgacaucguggccgccggcuccagccugauggcucggaaacucgaguucggggcggacuccacguucaaggccuucucugccaugccgaagaccucccugugcuucuacaucguggagcgcgaguacugcaagagcugcuccagggaggacacccagaagugcgucaauaccaaguuagaacgcccccagagcauccucaucgagcacaagggaacgaucauagggaagcagaacgacacgugcaccgccaaggcgagcugcuggcuggaguccgucaagagcuucuucuacggccugaagucgaugcucagcggcaucuucgggaauguguucaucggcaucuuccuguuuaucgcccccuuugugcugcucauccuguucuucauguucggguggcgcauccucuucuguuucaaguguugccggcgcacccggggacuguucaaguaccgccaccucaaggacgacgaggagaccggguaccggaagaucaucgagaggcugaacaacaagaagggcaagaacaagcugcucgacggcgagcgucuggccgaccgcaagaucgccgagcuuuuuagcaccaagagccacaucggguga

SEQ ID NO: 15201 - RNA, 5070 nt, Artificial Sequence
  derived and/or modified CDS sequence (opt11) from CCHFV(SPU 18/88)__KJ682810.1__GP
augcccuucaacaucauguacaccccacugcucugcgccauccugugccugcagcucuggagccuggagggcaucuacgggcuguccaauaagacccagcacaacgauacgagcaccaucaaggugcccgaggagucccagaagaccagccuccccgccaacaccgcguccccaaucacgagcgacccguccagcgccacuuccaccgcccuggccagcggccccgagggguccggcgacaccagcacgucccccagcgucaccacccaggggcccacccugcucgagacgacuccggagccccacaccaccaucgacaucgacgaguccagcacggccaucgcggacauuuccacccagaccgugaaggacauccccacccccacgacccacaccagccugccgagcacccccagcgcccccacgaucccgcaggaggcccaccacaccgcccgcggccugcucagcgugaccuccaccaagccgggcgagacgagcacccccaccucccccggggaggcgagcaccgaggccaguagcccccagccgacgaucuccgagaccccgagcccgccgcccaccacccaagcccccacggagaucaacaacccaaacaccucccggcagcccaugcccagcacccagcccgccgcccccaacuccgucaccccucccgugcagcccaccuucagccaguccgacgugagcacggucgcgcaggacauccaccccuccccgaccaaccgcagcaagcggaaccuggagauggagaucaucuuaaccuuaucccagggcuuaaagaaguacuacgggaaggugcugaagcuccuggaucugacccucgaggaggacacggagggccuguuggaguggugcaagcgcaaccucgggcugaccugcgacgacaacuucuuccagaaacggauagaggaguucuuccugaccggcgagggccacuucaacgaggugcuccaguucaagacccccagcacgcugucccccaccgagcccgcccgcgucgagagcccgacgguggagcccuucaagagcuacuucgccaagggguuccugucaauggacagcggcuacuucuccgccaagugcuaccccaagagcuccaacagcgggcuccagcugaucaacgugacccagcacuccauccggaucacggacacucccggcccgaagaucaccagccugaaaaccaucaacugcaucaaccucaaggcccuggucuucaaggagcaccgcgagaucgagaucaacgugcugcucccccagguggcggucaaccuguccaacugccacgugcugaucaagagccacgccugcgacuacucccucgacaucgacggccccgugcggcugccccggauccaccacgaggggacguucaucccgggcacguauaagauugucaucgacaagaagaacaagcagaacgaccggugcacccuggugaccaacugcgugaucaaggggcgcgagauccggaagggccagagcguccuccgccaguaccggacggagaucaagaucgggaaggccuccagcggcucccgccggcugcugagcgaggaguccaacgacgacugccucagccgcacccagcugcugcggaccgagaacgccgagauccacagcgacaacuacggcgggcccggcgacaagaucacgaucugcaacggguccacgaucguggaccagcgccucggcagcgagcuggggugcuacaccaucaaccgggugaaguccuucaagcugugcgagaacagcgccaccggcaaguccugcgagaucgacagcacccccguccgcugccgucagggcuucugccuaaagaucacgcaggaggggcggggccacgucaagcugucccgcgggagcgaggucgugcuggaugcgugcgacuccagcugcgagaucaugauccccaagggcaccggggacauccugguggacugcuccggcggccagcagcacuuucucaaggacaaccuugucgaccuggggugcccgaacaucccccuccugggcaagauggccaucuacaucugccggaugagcaaccaccccaagacgaccaugggguuccuguucugguucuccuucggcuacgugaucacgugcauccucugcaaggugaucuucuaucugcugaucgucgugggcacccucgggaagaaguucaagcaguaccgcgagcugaagccccagaccugcaccaucugcgagacgaacccgguuaacgccaucgacgccgagaugcaugaccugaacugcagcuauaacauaugccccuauugcgccucccgacucaccagcgacggucuagcgagacacgucaugcaaugccccaagcggaaggagaagaucgaggagaccgagcuguaccucaaccuggagcgcaucccguggguggugcggaaguuacuccaggucuccgaguccaccgggguugcccugaagcgcuccagcuggcuggugauccuccugguacugcucaccgugagccugucccccgugcagagcgcucccaucucccacggcgagacugucgagguguaccagaccagagagggguacaccucuaucugccuguucgugcucggcuccauccuguuccuggucagcugccucaugaagggucugguggacuccguggggaacagcuucagucccggccugagcaucugcaagaccugcuccaucgggagcaucaacggcuucgagaucgagucccacaagugcuacugcagccucuucuguugcccguacugccgccacugcuccgccgacaucgagauccacaagcugcaccugagcauuugcaagaagcggaagacuggauccaacgucaugcucgcggugugcaagcgcaugugcuuccgggccacgguggaggucagcaacaaggcccugcugauccgcaacaucaucaacaccaccuucguggugugcauccucauccuugccgucugcguggugucuacgagcgccguggagauggagaaccugcccgcgggcaccugggagaaggaggaggaccucaccaacuucugccaccaggagugccaggugaccgagacggagugccugugccccuacgaggcccuggugcuccggaagccccuguuccuggacagcaucgucaagggcaagaagaaccuccugaacuccaccagccuggagaccucucucagcaucgaggccccguggggcgccaucaacguccaguccaccuucaagccaacggugagcgccgcgaacaucgcccuguccugguccuccgucgagcaccgcgggaacaagauccuggugagcgggagauccgagagcaucaugaagcucgaggagcgcaccggcaucuccugggaccuggggguggaggacgccagcgaguccaagcugcucaccgucagcgugauggaccugucccagauguacagccccguguucgaguaccuguccggcgaccgccaggucgaggaguggcccaaagcgaccugcacgggcgacugcccggagcggugcggaugcaccagcagcaccugucuccacaaggaguggccccacucccgcaacuggcggugcaaccccaccuggugcuggggcguggggaccggcugcacgugcugcgggcuggacgugaaggaccuguucaccgacuacauguucgucaaguggaagguggacuauaucaagaccgaggccaucgugugcguggagcucaccagccaggagcgccagugcucccugaucgaagccggcacccgguucaaccugggccccgugaccaucacccucucugagccgcgcaacauccagcaaaagcugccgcccgagaucgucacgcugcauccccggaucgaggagggguucuucgaccucaugcacauccagaaggugcuauccgcaagcaccgugugcaagcugcaguccugcacccacggcguccccggggaccuccagaucuaccacaucggcaaccugcugaagggagacaaggucaacgggcaccucauccacaagaucgagccccacuuuaacaccagcuggauguccugggauggcugcgaccuggacuacuacugcaacaugggagacuggcccagcugcuccuacacgggcgugacgcagcacaaccacgccgccuucgucaacaugcugaacaucgagaccgacuacaccaagaacuuccacuuccacagcaagcgcgugaccgcgcacggggacaccccgcagcucgaccugaaggcccggcccaccuacggcgccggcgagaucaccgugcuggucgagguggccgacauggagcuccacaccaagaagaucgagaucuccgggcugaaguucgccagccucacgugcaccggcugcuacgcgugcaguagcgggauauccugcaaggugcgcauccacgucgacgagcccgacgagcucacagugcacgucaagagcgaggaccccgacaucguggccgccuccagcagccugauggcccggaagcuggaguucggcaccgacuccacguucaaggccuucagcgcgaugcccaagaccucccucugcuucuacaucguggagcgcgaguacugcaagagcugcuccaaggaggacacccagaagugcgugaacaccaagcuggagcagccgcagagcauccugaucgagcacaaggggacgaucaucggcaagcagaacgacacgugcaccggcaaggcagggugcuggcucgaguccauuaagagcuucuucuacggccugaagaacaugcuguccgggaucuucggcaacgucuucaucgggaucuuccuguuccucgcccccuucaucaugcugauccuguucuucauguucggcuggcggaucuuauucugcuucaagugcugccgccggacccgcggccuguucaaguaccggcaccugaaggacgacgaggagaucggguaccgcaagaucaucgagcggcucaagaacaagaagggcaagaacaagcugcuggacggggagcgccucgccgaccggaagaucgccgagcuguucagcaccaagacccacaucggcuga

SEQ ID NO: 15202 - RNA, 5070 nt, Artificial Sequence; identical to SEQ ID NO: 11916
  derived and/or modified CDS sequence (opt11) from CCHFV(SPU 497/88)__KJ682808.1__GP

SEQ ID NO: 15203 - RNA, 5070 nt, Artificial Sequence
  derived and/or modified CDS sequence (opt11) from CCHFV(SPU 130/89)__KJ682807.1__GP
augcccuucaacaucauguacaccccgcuccucugcgccauccuaugccugcagcucuggagcuuggagggcaucuacggguuguccaacaaaacacaacacaacgauaauagcaccaccaaggcaccagaggagucccacaagacgagccuccccgcgaacaccgccucacccaucacgagcgacccgcccuccacuacuagcaccaccuccgccagcggccccgagggguccggcgacaccagcaccuccccacccgugaccacgcaggggcccgccagccccgagaccacgcccgagccacacaccacgauagacauugacaagucuagcaccgcuaucgcggacaucuccacccagaccguaaaggacauccccacgccaaccacccacaccagccugcccuccacgcucagcgccccgaccauuccccaagaggcccaccacaccgcacgcggauugcugagcgugacccggcacaagcccggcgaggcaucaaagccaacgucgccgggggaggccuccacugaggccagcuccucacaaccaaccauuuccgagacucccagcccuccgccgaccacccaagcccccaccgagaucaacaaccccaacaccucccgucagccgaugcccucaacgcagcccgccgcaccguccagcgucacacaccccgcccagcccacccccucccagagcgacguccccaccgccgcccaggacauccaccccucccccaccaaucggagcaaacgcaaccuugagauggagaucauccucacacuaucccaggggcugaagaaauacuacgggaaggugcucaagcuccuggaucucaccuuggaggaggacaccgagggcuuacucgaaugguguaagaggaaccuggggcugaccugcgacgacaacuucuuccaaaaacgcaucgaagaguucuuccucacgggcgagggacacuucaacgaaguacugcaauucaagacccccucgacccugaguccgaccgagcccgccagggucgagagccccacgguggagcccuucaagagcuacuucgcuaagggguuccucuccauggacagcggcuacuuuuccgcuaagugcuaccccaagagcuccaacagcggguugcagcugaucaacguuacccagcaccucauccgcaucaccgacacccccggccccaagaucaccaaccuaaagaccaucaauugcauaaaccugaaggcucucgucuucaaggagcaccgggagaucgagauaaaugugcugcugccucagguggccgucaaccucuccaacugccacgugcugaucaagagccacguuugcgacuacucccuggacauagacggcccgguuaggcuccccagcauccaccacgaggggaccuucauccccggcaccuacaagaucgugaucgacaagaagaacaagcagaacgaccggugcacuuuggugaccaauugcguuaucaaggggcgcgagaucagaaaaggccaguccguucugcgccaguaucggaccgagauuaagaucgggaaagcuagcuccggcagccgccgguugcugucugaggagcccaacuacgauugucugagccgcacacagcuccugcggacggaaaacgcggagauccauuccgacaacuacggcgggccuggcgacaagauuaccauaugcaacgguagcaccauuguggaccagcgccugggauccgagcucggaugcuauaccaucaaccgcgucaagucguucaagcucugcgagaacucugcgacgggcaaauccugugagauugacagcaccccagugcggugccgccagggcuucugccuuaagauaacccaggagggucggggacacgugaaacuuucccgcgguagcgaggucgugcucgaugcuugcgacuccagcugcgagauuaugauacccaagggcacaggggacauacuggucgauugcuccggcggccaacagcacuuccugaaggacaaccucguggaccuggggugccccaacauuccgcugcucggcaagauggcuaucuacaucuguaggaugagcaaccaccccaagacgaccauggccuuccuguucugguucuccuucggauaugugaucacgugcauacugugcaaagucaucuucuacuuauugaucguugugggcacccugggaaagaaauucaagcaguacagagaacucaagccccagaccugcaccaucugcgaaacgaacccagucaacgcgaucgacgcggagaugcacgaccugaacugcagcuacaacauuugccccuacugcgccagccggcuuaccuccgacggucucgcacgccacgugaugcaaugccccaagcggaaggagaaaaucgaggagacggagcuguaucugaaccucgaacgcauucccugggucguccggaagcuguuacagguguccgagagcaccggcguggcgcuuaaacgguccucuuggcuggucgugcugcucguguuacuuaccgucucccucagcccggugcagagcgccccuaucucccacggggagacgguggaggucuaccagacccgggagggcuacacgagcaucugccuguucgugcuagggucaauauuauuccuggugagcugccugaugaagggucucgucgauuccguuggaaacagcuuuuucccggggcuguccaucugcaagaccugcucgaucggcuccaucaacggguucgagaucgaaagccacaagugcuacugcucccuguucugcugccccuauugccgccacugcagcgcagacaucgagauccacaagcuccaccuguccaucugcaagaagcguaaaaccggcucuaacguuaugcuggccgucuguaagcgcaugugcuuucgggccaccguggagguuucaaacaaggcgcucuugauccgcaacauuaucaacacgaccuucguaguuugcauccugauccucgcagugugcgucgugagcaccucggcgguggagauggagaaccugcccgcaggcaccugggagaaagaggaggaccugacgaacuucugccaccaggagugccagguaaccgagaccgaaugucucugccccuaugaggccuuggugcuucggaagccacuuagccuggacaguaucgugaagggcaugaagaaccugcucaacagcaccagcuuagaaacgagucugagcaucgaggcgcccuggggcgcuaucaacgugcaguccaccuuuaaaccaaccgugagugccgccaacaucgcacucuccuggaguuccguggaacacagggggaacaagaucuuagucagcggacgguccgagagcaucaugaagcuggaagaacgcacuggaauauccugggaccuaggcguugaggacgcgagcgaguccaagcugcuaacgguguccgugauggaccugucccagauguacagcccgguguucgaguaucuguccggggaucgccagguggaggaauggccgaaggccacaugcaccggcgacugcccggagcgguguggcugcaccagcagcacgugccuucacaaggaguggccgcauucucgaaacuggcggugcaaccccaccuggugcuggggcguagggaccgggugcacgugcugcggccuagacgugaaggaccuauucaccgauuacauguucgugaaguggaaggucgacuacaucaagaccgaggccaucgugugcguggagcugaccagccaggagcggcagugcucccucauagaggccggcaccagauucaaucugggccccgucacgaucacccuuagcgagcccagaaauauucagcagaaacucccgcccgagauagucacccugcacccccggaucgaggaaggauucuucgaucugaugcauauccagaaggugcucuccgcaagcacagugugcaagcugcaguccugcacucacggggugcccggcgaccugcagaucuaccauaucgggaaccuccugaagggcgacaaggucaauggacaccugauccacaagaucgagccgcacuucaacaccagcuggaugucaugggacggcugcgacuuggacuacuacugcaacaugggcgacuggcccagcugcuccuauaccgggguaacccagcacaaccaugccgccuucguuaacaugcugaacauugagacugacuauaccaagaacuuccacuuccacuccaagcgcgucaccgcccacggcgacaccccucagcuggaccucaaggcccggcccaccuacggggcgggcgagaucaccgugcugguagaggucgccgacauggagcuccauaccaagaaaguggagaucuccggccuaaaguuugccagccugacuugcaccgggugcuacgccugcuccagcgggaucuccuguaaaguucgcauccacgucgaugagccagacgagcuuacggugcacgucaagagcgaggauccagauaucguggccgccucgagcucccucauggcccggaagcuggaguucgggacagacagcaccuucaaggccuucuccgccaugcccaagaccucccugugcuucuauaucguugagcgcgagcacugcaagagcugcuccaaagaggacacgcaacggugcgugaacacuaagcucgaacagccucagagcauccugaucgagcacaaggggaccaucaucgggaagcagaacgacacgugcacagccaaggcguccugcuggcuggagagcaucaaguccuucuucuauggcuuaaagaacaugcugagcggcaucuucgggaacgucuucaucggcguguuucuguuccuggcccccuucaucauccucauacuauucuucauguucggguggaggauccuguucugcuucaagugcugccggaggacgaggggucuccugaaguaccgccaccugaaggacgacgaggagaucggcuaccggaagaucaucgagcgccucaacaauaagaagggcaaaaacaagcuacuggacggcgagcggcucgccgaccgaaagaucgccgagcuguuuuccaccaaaacccacaucggauga

SEQ ID NO: 15204 - RNA, 5070 nt, Artificial Sequence
  derived and/or modified CDS sequence (opt11) from CCHFV(SPU 383/87)__KJ682806.1__GP
augcccuucaauaucauguacacgccccuacucugcgccauucugugccugcaauuauggucccuggaggguaucuacgggcuguccaaccgcacccagcauaaugacaccuccaccaucaaggugcccgaggagucccagaaaaccagccuccccgccaauaccgcgucucccauuaccagcgacccucccuccaccaccagcaccgccuccgccagcggccccgagggguccggggacaccucaaccagcccacccgucacgacccaagggcccaccccgcccgagacuacucccgaaccgcacaccaccaucgacaucgacaaguccuccaccgccaucgccgacaucagcacucaaacggugaaggacauccccacgcccaccacccacaccuccuugccgagcacgcuguccgcgcccacuaucccccaggaggcccaccacacugcccgaggccugcugagcaucacuagcacgaaacccggcgaggcaucgaccccgauuagccccggggaggccuccaccgaggccucuagcccgcaacccaccauuagcgagacgccgagcccgccgcccaccgcgcaagcccccaccgagauuaacagccccaacaccucccgccagccaaugcccucgacgcagcccgccgcgcccaacuccgugacccaccccgcccagccgacccccucucaaucggacgucccaacagccgcgcaggacauacauccaaacccgaucaaccggagcaagcgcaaccuggagauggagaucaucuugacucucucgcagggccugaagaaguacuacgggaaggugcucaagcugcuagaucucacgcuggaggaggacacagaaggccugcucgagagcugcaagcggaaccugggauugaccugcgacgacaacuucuuccaaaagcgcaucgaggaguucuuucucacuggcgagggccacuucaacgagguccugcaguucaagacgcccagcacccugagccccaccgaaccagcccggguagaguccccgaccguggagcccuucaagucguacuucgccaagggguuccuaagcauggacuccggauacuucagcgccaaaugcuacuccaaaagcuccaauagcgggcugcagcugaucaacgucacgcagcaccucauccgcaucaccgacacccccggcccgaagaucaccaaccugaagacaaucaacugcaucaaucugaaggcccucgucuucaaggagcaccgggagaucgaaaucaacgugcuguugccccaggucgccgucaaccucucaaacugccacguacucaucaagagccacgugugcgauuacucccuggacaucgacggccccguccgccuuccccgcauccaccacgaggguaccuucauccccggcaccuauaagaucgugaucgauaaaaacaacaagcagaacgaccgcuguacgcuggugacgaacugcgucaucaaagggcgggagauccgcaaaggccaaagcgugcugaggcaauaccgcaccgaaaucaagaucgggaaggccuccagcggcucccggcgccuccugagcgaggaguccaaugacgacugccugagccggacccaacuccugaggaccgagaacgcggagauccacagcgacaacuacggagggccgggcgacaagaucacgauuugcaacgggagcaccaucguggaccagcgucugggcucggaguuggggugcuacacaaucaacagggucaaguccuucaagcugugcgagaauagcgccaccggcaagucuugcgaaauugacagcacgcccguacgcugccggcagggguucugcuugaagaucacccaggaggggaggggucacgugaaguugucccgggggagcgaagucgugcucgacgccugcgacuccagcugcgagauaaugauccccaaggggaccggagacauccuggucgacugcuccggcggccagcagcacuuccugaaggacaacuuaguggaccuggggugccccaacaucccccugcucggcaagauggccaucuacaucugccgcaugagcaaccaucccaaaaccacgauggcauucuuguucugguucucuuucggguacgugauaacgugcauccugugcaagguaaucuucuaccuccugguuguggucggcacccugggcaaaaaguucaagcaauaccgcgagcucaagccccagaccugcacgaucugcgagaccaacccggugaaugcaaucgacgcugaaaugcacgaccugaacugcagcuauaacauaugccccuacugugccucccgccugaccagugaugggcuagcccggcacgugauccagugcccuaaacgcaaggagaagaucgaggaaaccgagcucuaccugaaccucgagcggauccccugggucgugcgcaagcuccuccagguguccgaaagcacgggaguugcauugaagcgguccucuuggcuaguuauacuacucgugcuguugacuguuucccucagcccugugcagagcgcccccaucucucauggugagaccguggagguuuaccagacccgcgagggcuacacaagcaucugucuauuugugcuggggucuauccucuucuuggucaguugucugaugaaaggccucguagacuccgugggcaacagcuucuuccccgggcuguccauaugcaaaacgugcagcaucggcuccaucaacggcuucgagaucgagagccacaagugcuacugcucccuauucugcugucccuauugccggcacugcucagccgacaucgagauacaccgacuccaccuguccaucuguaaaaagcggaagaccggaucuaacgugaugcuggccgucugcaagcgcaugugcuuucgggcuaccguggagguuuccaacaaagcacuccugauucgcaacaucaucaauacgacguuugucgucugcauacugauccucgccgugugcgucgugucgaccucagccguggaaauggaaaaucugccggccgggaccugggagaaggaggaagaccugaccaauuucugccaccaagagugucaggucacggagaccgaaugccucugccccuacgaggcccucgugcuuaggaagccccucuuccuagacagcaucgugaagggaaugaagaaccugcucaacaguacgagccuggaaaccagccuauccaucgaggcgcccuggggcgccauaaacguccagagcaccuucaagccgaccguuuccgccgccaacaucgcccucagcugguccagcguggagcaucgcgggaacaagauccuggucuccggccgcagcgaguccaucaugaagcuggaggagcggaccgggaucagcugggaccucgguguggaggacgcguccgagagcaagcugcuaaccguguccguaauggaccucagccagauguacucccccguguucgaauaccugaguggggaccgccagguagaggaauggcccaaggcgacgugcaccggcgacugccccgagcggugcggcugcaccucguccacaugccugcacaaggaguggccgcacagccgcaacuggaggugcaacccaaccuggugcuggggcguaggcacgggcugcacgugcugcggccucgacgugaaggaccuauucaccgacuacauguucgugaaguggaaagucgauuacaucaaaacggaagccaucgugugcguggaacuuaccagccaggagcgccagugcagccucaucgaggcaggaacccgguucaaccugggcccagucaccaucacgcugucagagccccguaauauacagcagaagcuaccgcccgagaucgugacccugcacccccggaucgaggaaggcuucuucgaccugaugcacauccagaagguccucagcgcguccaccgugugcaaacugcagagcugcacccaugggguucccggcgaccugcagauauaucacaucgguaaccuccugaagggcgacaaggucaacggccaccugauccacaaaaucgagccgcacuucaacacgagcuggaugagcugggacggcugcgaucucgacuacuacugcaacaugggcgacuggcccuccugcucuuauacuggcgucacccagcacaaccacgccgccuucgugaacaugcuaaacaucgagacggauuacacaaagaacuuccacuuccacuccaagcgcguaaccgcccacggcgacacgccccaacuggaccucaaggcccggcccaccuauggcgcgggcgagaucacagugcugguggaggucgccgacauggagcuccacacgaagaagaucgagaucagcggccugaaguucgccucccugaccuguacugggugcuacgccugcagcuccggcaucagcugcaaggugagaauccacguggaugagccggacgagcugaccguccauguuaaguccgaggaccccgacauuguggccgcgagcuccagccuuauggcccggaagcuggaguucgguacggacuccaccuucaaggccuucagcgccaugccaaaaacuagccugugcuucuacaucgucgagcgcgaguacugcaaguccugcagcaaggaggacacccagaaauguguuaacacgaagcucgaacagccucaguccauccugaucgaacacaagggaaccaucuucgggaagcaaaacgauacgugcacggccaaggcgaguuguuggcuggaguccgugaaguccuucuuuuacgggcucaagaacaugcuguccggcauuuuugggaacgucuucaucggcguuuuccuguuucuugcccccuucaucauguuaauccuguuuuucauguucggguggcggauucucuucugcuucaagugcugccggcguacgcgcggccucuucaaguaccgacaccugaaggacgacgaggagauaggauaccgcaagaucaucgagcgucugaacaacaagaaggguaagaacaagcuccucgacggcgagcgccuggcugaccguaagaucgccgagcuguucagcacgaagacccacaucggguga

SEQ ID NO: 15205 - RNA, 5070 nt, Artificial Sequence
  derived and/or modified CDS sequence (opt11) from CCHFV(SPU 44/08)__KJ682805.1__GP
augcccuucaacaucauguacacaccccucuugugcgccauccugugccugcagcucuggagcuuagagggcaucuacggacuguccaacaacacccagcacaacgauaccagcaccauuaaggugcccgaggagucccagaagaccucccuccccgccaacaccgcgucccccaucacgagcgacccgccgcccacaacccccaccgccuccgccagcggcccggagggguccggcgacacgagcaccuccccgcccgucaccacccaggggcccacgccgcccgagaccacgcccgagccccacacaacgauagacaucgacaagagcuccaccgcaaucgccgacaucagcacccagaccgugaaaaacauccccacgcccaccgcgcacaccucccugccuagcacccuguccgcgcccacgaugccgcaggaggcccaccacaccgcccgcggcuugcugagcguuaccuccaccaagcccggugaggcgagcacgcccaccucgcccggggaggccuccaccgaggccagcuccccgcagcccaccauccgggaaacgccaagcccgccgccuacgacccagacccccacggagaucaacaaccccaacaccucccgccaacccaugcccagcacgcaacccgccgccccguccagcgucacucacccugcgcagcccacccccucccaaagcgacgugccgacggccgcccaagacauucacccaucccccaccaaccggaguaagcgcaaccuggagauggagaucauucucacccuaucccagggccugaagaaguacuacgggaaagugcucaagcugcucgaccucacccuggaggaggacacggagggccugcucgaguggugcaaacggaaccuggggcugaccugcgacgacaauuucuuccagaagcgcaucgaggaguucuuccucaccggcgagggccacuucaacgagguccugcaguuuaagacccccagcacgcuguccccgaccgagcccgcccggguggagagcccuaccguggagccauucaaguccuacuucgccaaggguuuccuccugauggacagcggcuacuucuccgcgaagugcuacccaaagagcagcaacuccgggcugcagcuaaucaacguuacccagcaccuuauccgcaucacggacacccccggccccaagaucaccaaccugaaaaccaucaacugcaucaaccucaaggcucuaguguucaaggagcaccgggagaucgagaucaacgugcugcucccccaagucgccgugaaccugucaaacugccacgugcuuaucaagucccacgucugcgacuacagcauagacaucgacggcccugugcgccucccccguauucaccacgaggggacguucaucccuggcaccuacaagauugugauugacaagaagaacaagcaaaacgaccgcugcacucuggucaccaacugcgugauaaaggggcgggagauccgcaagggccaguccgugcugcggcaguaccgcacggagauuaagaucgggaaggccagcuccgguagccggcgccuccugagcgaggagagcaaugacgacugccugucccggacccagcuccugcgcaccgagaacgccgagauccacagcgacaacuacggcgggcccggugacaagaucaccaucugcaacgggucuacgaucgucgaccagcggcuggguagcgagcuggggugcuacaccaucaaccgcgugaaguccuucaaacugugcgagaacagcgcgaccggcaaguccugcgagaucgacagcacuccggugcgcugccgccagggcuucugccugaagaucacgcaagagggccgcggccacgucaagcugagccggggguccgaggugguccucgacgccugcgacagcuccugcgagauaaugauccccaagggcaccggggacauccugguggacugcagcggcggccagcaacacuucuugaaggacaaccucguggaccuggggugccccaacaucccccugcucggcaaaauggccaucuacauuugccgcauguccaaccaccccaagaccacaauggccuuccuguucugguucagcuucggguacgucaucacguguauccugugcaaggccaucuucuaccuccugaucguggugggcacccugggcaagaaguucaagcaguacagggaauuaaagccacagaccugcaccaucugcgaaacgaaccccgucaacgcgaucgacgccgagaugcacgaccugaacugcucauacaacaucugcccguacugcgccagccgacugaccuccgacgggcucgcccggcacgugaugcagugccccaaacgcaaagagaagaucgaggagaccgagcuguaccugaaccucgagcggauccccuggguggucaggaagcugcuccaggugagcgaguccaccggcguggcgcuuaagcggagcuccuggcuggucauccugcucgugcugcugaccgugagccucucccccguccaguccgccccgaucagccacggggagacgguggagguguaccagacccgcgagggcuacaccaguaucugcuuguucguccugggguccauucucuuccucguaagcugccuaaugcggggccucguggacagcgucaguaacaguuucuuccccggccuguccaucugcaagaccugcagcaucgguuccaucaacggcuucgagaucgagagccacaagugcuacugcucccuguucugcugccccuacugccgccacugcuccgccgacaucgagauacacaagcuccaccuguccaucugcaagaagcggaagaccgggucaaacgugaugcuugccguaugcaagcgcaugugcuuccgggccaccgucgagguguccaacaaggcacuccugauccgcaacaucaucaauaccaccuucguggucugcauccugauccuagccguguguguugucagcacguccgccguggagauggagaaccugcccgccggcaccugggagaaggaggaggaccugaccaacuucugccaccaggagugccaggugaccgagacggagugccucugcccguacgaggcccugguccugcggaagccccucuuccuggacagcaucgugaaggggaugaagaaccugcucaacuccaccagccuggagaccucccugagcaucgaggcgcccuggggcgcuaucaacgugcaguccaccuucaagccgacgguaagcgccgccaacaucgcccucucgugguccagcguggagcaccgcggcaacaaaauccugguauccgggcgcagcgaauccaucaugaagcuggaggagcggacgggcauuagcugggaccucggggucgaggacgcguccgagucaaagcugcugaccguguccgugauggaccucagccagauguacuccccggucuucgaauaccugagcggcgacaggcaaguggaggaguggcccaaggcgaccugcacgggggacugccccgagcggugcggcugcaccuccagcacgugccugcacaaggaguggccgcacucccgcaacuggcgaugcaauccaaccuggugcuggggcgugggaacaggaugcacgugcugcgggcucgaugucaaggaccuuuucaccgacuacauguucgugaaguggaagguggauuauaucaagaccgaggccaucgucugcguggaacugacgagccaggagcgccagugcucccucauagaggccggcacccgguucaaucuggggcccguaaccaucacccuaagcgagccccgcaacauccagcagaagcugcccccggagaucgucacgcugcacccccggaucgaggagggcuucuucgauuugaugcacauccagaagguacucuccgccagcaccgucugcaagcugcagagcugcacccacggcgugcccggggaccugcagaucuaccacaucggcaaucuccugaagggggacaaggugaacggccaccugauccacaagaucgagccccacuucaacaccuccuggaugagcugggacggcugcgaccucgacuacuacugcaacaugggggacuggccguccugcagcuacacgggcgucacccagcacaaccacgccgccuucguuaacaugcugaacaucgagaccgauuacacgaagaacuuccacuuccacuccaagcgcgugaccgcccacggggacacgccucagcuggaccucaaggcccggcccaccuacggcgcgggggagauuaccguccugguugagguggcggacauggagcugcacacuaagaagaucgaaaucagcggccucaaguucgccucccugacgugcaccggcugcuacgccugcagcuccgggaucagcugcaagguccgcauacauguggacgagccggacgagcugacagugcacgucaaguccgaggaccccgacauuguggccgcgagcuccagccucauggcccggaagcuggaguucggcaccgacuccacuuucaaggccuucagcgccaugcccaaaaccuccuugugcuucuacaucguggagcgcgaguauugcaagagcugcaguaaggaggacacgcaaaagugcgucaauaccaagcucgagcagccccagagcauucugaucgagcacaaagggacgaucaucggcaagcagaacgacacuugcaccgcuaaagcgagcugcuggcucgaguccauuaagagcuucuucuacgggcucaagaacaugcugagcggcaucuucggcaacguguucaucgggaucuuucuguuccuggccccguucaucaugcucauccuguucuucauguuuggcuggcggauccuguuuugcuucaagugcugccgccggacccgcggccuauucaaguaccggcaccugaaggacgacgaggaaauuggguaccgcaagaucauagagcggcuuaacaacaagaaagggaagaacaagcuccuugacggcgagcgccuggccgaccgcaagaucgccgagcuuuucucuaccaagacucacauuggguga

SEQ ID NO: 15206 - RNA, 5070 nt, Artificial Sequence
  derived and/or modified CDS sequence (opt11) from CCHFV(Matin)__AF467769.2__GP
augagcuucaacaucauguacacccugcugcugugcgccauccugugcucccagcuguggagcuccgaggggauccacgggcugagcaacgagacccagcacggcaacgccuccaccauaaaggcccccgagguaagccaggggcugggccuccccgucucgaccgcgccgcccaucaccagcgacccgcccagcaucaccagcgccgccuccgugagcgggcccgaaggcuccggcgacaccaacaccuccccgcccgugaccacccaggggcugacccugcccgagaccacccucgagcugcugaccaccaccaacacgggcgccuccagcaccgucaucguggacguguccacccagaccgucaaggacacccccgugagcaccgcccacaccagcccgcccgggacccccagcgcccccaccacgccccagggcacgcaccacaccgcccgcgggcuccugagcgugaccuccaccaagagcgaggaggccucuacccagaccaaccccaagaagaccagcauggagaccaauuccccgggcccagcgacgagugagaccccgucccccagccccaccacccaggcccccacggagaacaacaaccccaacacgccccggcagccgacgccacccacccaacccgccaccccgucccccgucacgagccccgcccugcucgccucgagccagggcgacaccuccaccgcggugcaggacgugcacccgagccccaccaaccgcuccaagcggaaccuggagauggaaaucauccuaacgcucagccaagggcugaagaaguacuacggcaagauccugaagcuccuggaccugacccucgaggaggacaccgaggggcugcuggaguggugcaagcgcaaccucggccuggucugcgacgacuccuucuuccagaagcggaucgaggaguuuuucuugaccggcgaggggcacuucaacgaagugcuccaauucaagacgcccagcacauuaucccccaccgagccggcccgcgccggcagccccaccguggagcccuucaagagcuacuucgcacgggggcugcucuccauggacagcggcuacuucuccgcuaagugcuacccccgcgcgagcaacuccgggcugcagcugaucaacaucacucagcacagcgcccggaucaccgacaccccgggccccaagaucaccaaccucaagacgaucaacugcauaaaccugaaggccuccaccuucaaggagcaccgcgagaucgagaucaacguccugcucccccagguggcggugaaccugagcuccugccacguccugaucaagagccacguuugcgacuacucccucgacaucgacggccccgugcggcugccgcgcauccaccacgaggggaccuucauccccggcaccuacaagaucgucaucgacaagaagaacaagcagaacgaccggugcaccaucgucaccaacugcgugaucaaggggcgggagauccggaagggacagagcguccugcgccaguacaagacagagaucaagauagggaaagccucuagcggcucccggcgccuccugagcgaggaguccggcgacgacugcaucagccggacccaacugcuccgcacggagaccgcggagauccacagcgacuccuacgggggccccggggacaagaucaccaucugcaacggcagcaccguggucgaccagcggcugggguccgagcugggcugcuacacgaucaaccgcgugaaguccuucaagcugugcgagaacagcgccaccggcaagagcugugagaucgacuccacccccgugaagugccgccagggguucugccucaagaucacccaggagggccgggggcacgucaagcugagccgcggcuccgagguggugcuggacgccugcgacagcuccugcgagaucaugauaccgaaagggacgggggacauccucgucgacugcagcggcgggcagcagcacuuccugaaggacaaccucaucgaccucggcugccccaacaucccacugcuugggaagauggccaucuacauaugccggauguccaaccaccccaagaccaccaugguauuccucuucugguucagcuucggcuacgucaucacgugcauccuguguaaggucaucuucuaccugcucaucguggugggcacgcuggggaagaaguucaagcaguaccgggagcugaagccgcagaccuguaccaucugcgagaccacccccgucaacgcaaucgacgcggagaugcacgaccucaacuguuccuacaacaucugccccuacugcgccagccggcugacguccgacggccuggcccgccacgugaugcagugccccaagcggaaggagaagaucgaggagaccgagcucuaccugaaccuggagcgcaucccgugggugguccggaagcucuuacaggugagcgaguccaccgggguggcccugaagcgcagcagcuggcucgucgugcugcuggugcuccugaccgucucccugagccccgugcaguccgcgcccaucggccacgggaagacgguggagaccuaccagauccgggagggcuacaccagcgucugccucuuugugcugggcuccauccuguucaucgugagcugccucaugaagggccugguagacuccgacggcaacagcuucuucccggggcuguccaucugcaagaccugcagcaucggcuccaucaacggguucgagaucgagagccacaagugcuacugcucccucuucugcugccccuacugccgccacugcagcacggaccgggagauccacaaacugcaccuguccaucugcaagaagcgcaagaccggcagcaacgugaugcucgccgucugcaaacggauguguuuccgcgccaccgucgagguguccaacaaggcccugcugauccggagcaucaucaauaccacguucgugguaugcauccucaucuuggccguuugcguggucuccaccagcgcgguggagauggagagccugcccgccggcaccugggagcgugaggaggaccucaucaacuucugccaccaggagugccaggugaccgagacggagugccugugccccuacgaggcccugguccucagaaagccgcuguuccuggacuccaucaucaaggggaugaagaaccuccugaacagcaccucccuggagaccagccucucgaucgaggcucccuggggcgccaucaacgugcagagcaccuucaagcccacgauguccgcggccaacaucgcccugagcugguccagcguggagcaccgggggaacaagauccuggucucaggccgcagcgaguccaucaugaagcucgaggaacggaccgguaucagcugggaccuaggcguggaggacgccuccgagagcaagcugcucaccguguccgugauggaccugagccagauguacucccccguguucgaguaucugucuggcgaccgccagguggaggaguggccgaaggcgaccugcacgggggacugccccgagcggugcggcugcaccagcagcacgugccuccacaaggaguggccccacagccgcaacuggcggugcaaucccaccuggugcuggggcgugggcaccggcugcacgugcugcgggcuggacgugaaggaccuguucaccgacuacauguucgugaaguggaaggucgaauacaucaagaccgaggugaucgucugcguggagcucacgucccaggagcggcagugcagccucaucgaggccggcacccgguucaaccuggggccggugaccaucacccucuccgagccccgcaacauccagcagaagcugccgcccgagaucgucacgcugcacccgcggaucgaggagggcuucuucgaccucaugcacgugcagaaggugcugagcgcguccaccgucugcaaacuccagagcugcacccauggggugcccggagaccuccagguguaccacaucggcaaccugcugaagggggacaaggucaacggccaccucauccacaagaucgagccccacuucaacaccuccuggaugagcugggacgggugcgaccuggacuacuacugcaacaugggcgacuggccauccugcuccuauacgggggugacgcagcacaaccacgccgccuucgugaacaugcuguccaucgagaccgacuacaccaagaacuuccacuuccacagcaagcgcgucaccgcgcacggcgauacgccgcagcucgaccugaaggccagacccaccuauggcgccggggagaucaccgugcugguggaggucgccgacauggagcuccacaccaagaagaucgagaucuccggccugaaguucgccagccugacguguaccggaugcuacgcgugcuccagcgggaucuccugcaaggugcgcauccacguggaugagcccgacgagcucaccguccacgucaaguccgaggaccccgacaucguggccgccagcuccagccugauggcccggaagcuggaguucgggacggacuccacguucaaggccuucagcgcgaugccgaagaccucccucugcuucuacaucguagagcgcgaguacugcaagagcugcuccaaagaggacacccagaagugcguuaacaccaaacuggaacagccccagagcauccugaucgagcacaagggcacgauaaucggcaagcagaacgacacgugcaccgccaaggccuccugcuggcucgagagcgugaaguccuucuucuacgggcugaagaacaugcugagcggcaucuucgggaacgucuucaucggcaucuuccuguuccucgccccuuuugcccugcugauccucuucuucauguucggcuggcggauccuguucuguuucaagugcugccgccggacccgcgggcuguucaaguaccggcaccucaaggacgacgaggagacgggcuaccgcaagaucaucgagcggcugaacaacaagaaggggaagaacaagcugcucgacggagagcgcuuagcggaccgcaagaucgccgagcuguucuccaccaagacccacgugggguga

SEQ ID NO: 15207 - RNA, 5070 nt, Artificial Sequence
  derived and/or modified CDS sequence (opt11) from CCHFV(TADJ/HU8966)__AY179962.1__GP
augcccgugagcaucaugcacaugcugcuuaugugugccguacugugccugcagcucuacggccuaggaggcacccugcgcuccaacaacgguaccgagcacaacaagacgaacgugcucaccaccccgggcgacaaacucucgcccgaaccgcccguguccaccgcccugcccguuaccccagacagcuccaccgugacccccaccacgcccgcgagcgggcucgagggcucgggcgaggucuacaccaguccgcccaucaccaccaagggccucagucccagcgaggcgacguccgagcccccggcgaccaccggcauggggaucuccuccgcgagcggggucgacuuuuccacccaggcagcgcgggacacgagcacccugaccgugcucaccuccccgcccaacagccccaacacgccgcccaccucccaagacacccaccaccccguccgcagccugcugagcgucacaagcccucggcccgaggagacgaccgcccccuccaaguccgggaaggagucucccgcggccaacuccagccaccccgugaccucccgcccgaguucaccccugaucaccguacggggcccaacggagaacuccucccacaacaccacuggccagcuggaguccaugacgcaauccacgacccugguccccauggcgagcccgacccagaccgugcucucacagagcgugacauccaucgccgugcaggaugcgcacccgaguuccaccaaucgcagcaagcggaaccuggaaauggagaucauccugacccucccacaggggcugaagaaguacuacggcaaggugcugcgccugcugcaacuaacccuggaggaagacaccgaggggcugcuggaaugguguaagcggaaucucggccuggacugcgacgacacguucuuccagaagcggaucgaggaguuuuucaucaccggcgaggggcacuucaacgaggugcugcaguuucggaccccgggcacccucagcacgaccgaguccacccacgccggaagccccaccgcggaacccuucaaauccuacuucgcgaagggcuuccuuagcaucgacuccggauacuucuccgccaaguguuacucccgcacuagcaacuccggccugcgccucauuaacgucacccgccacagcacccggaucgccgacacccccggccccaagauuacuaaccugaagaccaucucaugcaucaaccugcgcgccucuaucuucaaggagcaccgggagguggagauuaacgugcuccugccccaggucgccgugaaccuguccaacugccauguggcgaucaagagccacgucugcgacuacucccuggacguggauggcaccguccgacugccccacauccaccacggcgguaccuucauccccggcacguacaagauagugaucgacaagaaaaacaagcugaacgaccguugcacccucuuuaccaacugcgugaucaagggucgcgagguccggaagggccagagcaucuugcgccaguauaagaccgaaauccgcaucggcaaggccuccacggggagucggcgccuacucagcgaggagucgggcgacgacugcauaagccggacccagcuccugcgcaccgagaccgccgagauccauggggacgacuacggcgggccgggggacaagaucacgauuuguaacggguccaccaucguggaccaacggcugggcagcgagcucggcugcuacaccaucaaccgcgugaagucuuucaagcugugcgagaacagcgccaccgggaagaauugcgagaucgacuccgucccagucaagugcagacagggcuacugccugaagaucacacaggagggccgcgggcacgugaaacucagccggggcuccgaggucgugcuggacgccugcgacucuaguugugaggugaugauccccaaggggaccggcgacaucagcguugacugcuccgggggccagcagcacuuccucaaggauaaccuuauugaccuggguugccccaagauaccguuacucgggaagauggcgaucuauauuugccgcaugagcaaccaccccaagaccaccauggcauuccuguucugguucuccuuuggcuacgugaucacccggauccugugcaaggccaucuucuaccuacugaucaucguggggaccuuaggcaagcgcuucaaacaguaccgggagcucaagccacaaaccugcacuaucugcgagacgacccccgccaacgccaucgacgcggaaaugcacgaccugaacugcagcuacaauaucugcccguacugcgccucuaggcugaccagcgacgggcuagcccggcacgucacccagugccccaagcgcaaggagcggguggaggagaccgagcuguacuugaaccucgagcgaauccccuggaucgugcggaagcugcuacaggucuccgaaagcacgggcguggcacucaaacggucuuccuggcugaucguacuacucguccuguucaccguaagccugagucccgugcagagcgcuccgaucggguacgggaacacgaucgagacguaccaggcccgcgaggaguacacguccaucugccucuucguccugggcagcauccuguucaucgucuccugucucaugaaggggcugguggacagcaucggaaacaucuuuuucccagggcugaccaucugcaagaccuguuccaucggcagcaucaacggcuuugagaucgagucccacaagugcuacugcagccuccucuguugucccuacugccgccacugcuccgccgaccgugagauccaccagcugcaucucagcaucugcaagaagcgaaagacgggguccaacgucaugcuggccguguguaaacgcaugugcuuccgggccacgauggaggugagcaacaaggcguugcuaauccgcuccaucaucaacacuaccuucgucgugugcaucuugaucuuggccgugugcaucguuuccaccuccgcaguggaaauggagagccuccccgccggcacaugggaacgugaagaggaccugaccaacuucugccaccaggagugucaggugaccgagaccgaaugccucugcccguacgaggcccucguccugcgccggccccuauuccucgacucuaucgugaaggggaugaagaacccccugaacuccacgagccuggagacuucccuguccaucgaagccccuuggggcgccauaaaugugcagaguaccuacaagcccaccgucagcacugcaaacaucgcccuguccuggagcuccaucgagcaccgagggaacaacauccuggugagcggccgguccgagagcaucaugaaacucgaggagcgcaccggcaucuccggggaccugggcguggaagacgcgagcgaguccaagcugcucaccgucagcgugauggaccuuucccaaauguacagccccguguucgaguaccuaucuggugaccggcaggucgaggaauggccgaaggcgaccugcacgggcgacuguccggagcgcugcggcugcacaucuagcacgugccuccacaaggaguggccccacucccggaacuggcggugcaacccuaccuggugcuggggcgugggaaccgggugcacuugcuguggccuggacgugaaagaccuguucaucgacuacauguucgucaaguggaagguggacuacaucaagaccgaagccaucgugugcgucgagcucaccagccaagagcggcagugcucccugguggaagcugggacccgcuucaauuuaggccccgucaccaucacucucagcgagccgcggaacauacagcagaagcugccgcccgaaaucauaacccugcauccccgcaucgaggaaggcuuuuucgaccucaugcacgugcagaaggugcuuuccgccagcacggucugcaagcugcaguccugcacccacggggugcccggugaccuccagguguaccauaucgggaaccuccucaagggcgacaaggagaacggccaccuuauccacaagaucgagccccacuucaacaccaguuggauguccugggacggcugcgaccuggacuacuacugcaacaugggcgacuggcccagcugcaccuacacugggguaacccagcacaaucacgcguccuucgugaaccugcucaacaucgagaccgacuacaccaagucguuucacuuccacuccaaacgggugaccgcccacggcgacacgccccagcuggaccugaaggcgcgcccgacguacggggcgggcgagaucaccguccucguggagguggcagacauggagcugcauaccaagaagaucgagauaacgggucugaaauucgcgagccugacaugcaccggcugcuacgccugcuccagcggcaucuccugcaagguccgcauccacguggaugagcccgacgaguuaaccgugcaugucaagagcgacgacccggaugugguggccgccucuagcagccugauggcccggaagcuggaguucgggacggacuccaccuucaaggcguucagcgccaugcccaagaccucgcuguguuucuacaucgucgaacgcgaguaccgcaaguccugcuccaaggaggacacacagaagugcguaaauacgaagcuggagcagccgcagagcaucuuaaucgagcacaagggcacaaucaucgggaagcagaacaacacgugcaccgccaaagcaagcugcuggcuggagagcgugaaguccuucuuuuacggccugaagaacaugcugagcggcaucuucgggaacgucuucguuggcaucuuccucuuccuggccccauuuauccugcucauccuguuuuucauguucggguggcggaucuuauccugcuucaagugcugccgccgcacccgaggccuccugaaacaccgccacuugaaggacgacgaggagaccggguaccggagaaucaucgagcggcucaacaacaagaagggcaagaacaaacuguuggacggugagcgccucgcggaccgccgcauugcugaacuguucagcaccaagacccacauaggguga

SEQ ID NO: 15208 - RNA, 5070 nt, Artificial Sequence
  derived and/or modified CDS sequence (opt11) from CCHFV(88166)__AB069675.1__GP
augagcuucuccgugauguacacgcccuugcucugcgccguccugugccugcagcucuggagucuggagggcucgcacgggcugaguaacaaaacgcagcacuccaacaccagcaccaccaaggccccggaggugucccaggagcucggccugcccgugagcaccgucuccacgaucaccagcgacccgcccuccaucaccagcgcggucuccgugagcggguccgaggguagcggugacacgaacacgucccccagcgucaccacacaaggccccacccugcccgagacgacccucgagccccugaccaccacggacaccgacgccuccagcaccgugguggucgacgugagcacccagacggugaaagacaccccgauauccaccaccuacacgucccugcccuccacacccucugagcccaccaccccgcagggcacacaccacaccgcccgcgggcuccuguccgucaccagcaccaagccggaggaagcauccacgcaggccaaccccggcaaaaucagcauggagacgaacagcccccggcuggcgaucagcgagaccccguccuucagccccaccacccaggcacccaccgaaaauuccaaccccaucacgagcaagcagcucaugcuguccgcccagccggugacccccaaccccaugacuagccccgugcagccggcccugucccagagcgacacuuccaccgcgauccaggacauccaccccagccccaccgggcgcagcaagcguaaucucgagauggagaucauacugacucugucccagggccucaagaaguacuacgggaagauccugaagcugcucgaccugacgcuugaggaggacaccgagggccucuuagaguggugcaagcgcaaccugggccucgucugcgacgacaacuucuuccagaagcggaucgaggaguucuuccugaccgggaagggccacuucaacgaggugcugcaauucaagacccccagcacgcucuccccgaccgggcccgcccgcaccggcagccccaccguggagccguucaaguccuacuucgcgaagggcuuccugagcauggacuccggauacuucagcgccaagugcuacccacgggccuccaacucuggccugcaacucaucaacgucacgcagcacuccacccgcaucaccgacacccccgggcccaagaucaccaaccugaagaccaucaacugcaucaaccugaaggcgucaguauucaaagagcaccgggagaucgaaaucaacgugcuccuuccgcaggucgccguaaaccuguccaguugccaugugcucaucaagucccacgugugcgacuacagcuuagacaucgacggccccgugcgccugccccggauccaccaugaggggaccuucauccccggcaccuacaaaauaguuaucgacaagaaaaauaagcagaacgaccgcuguacgcucgugaccaacugcgugaucaagggucgggagauccgcaaggggcaguccguccugcggcaguaccgcaccgagauuaagaucgguaaggccagcucagggucccggcgccugcucagcgaggaguccggcgacgacugcaucagccggacccaacugcugcgcacggagaccgccgagauccacuccgacaacuacgggggcccgggcgauaagaucaccaucugcaacgggagcaccgugguggaccaacgguuaggcuccgaacucgggugcuacacgaucaaccgcgucaagagcuucaagcugugcgagaacuccgccaccggaaagucgugcgagaucgacucaacccccgugaaaugccggcagggguucugccucaagaucacccaggagggccggggccacgugaagcucagccgcggguccgaggucgugcuggacgcgugcgacucguccugcgagaucaugauccccaagggcacgggggacauccugguugauugcagcgguggccagcagcacuuccucaaggacaaccugaucgaccuggggugcccaaacaucccgcuccugggcaaaauggccaucuacaucugccggauguccaaccacccuaagacuaccaugggcuuccuguucugguucagcuucggcuacguagugaccugcauucugugcaaggugaucuucuaccuacugaucgucguggggacgcucggcaagaaguucaagcaguaccgugaguugaagccccagaccugcaccaucugcgaaaccacccccgugaacgccaucgacgccgagaugcacgaccuuaacugcuccuacaacaucugccccuacugcgccagccggcucacgagcgacggccuggcgcgccacgucaugcagugccccaagcggaaggagaagaucgaggagaccgagcuguaccucaaccuggagcgcauccccuggguggugcggaagcugcuccagguguccgagagcacagguguggccuuaaagcgcucuagcuggcuggugguccuccuugugcugcucaccguaucccugagccccguccaguccgccccgaucggccacgggaagaccguggaaaccuaccagacccgggagggcuacaccagcaucugcuuguucgugcucggguccauccuguuuaucgucagcugccugaugaagggccucguggacuccgugggcaacagcuucuuccccgggcuguccaucugcaagacgugcagcaucggcuccgucaacggguucgagaucgagagucacaagugcuacugcucccuguucugcugccccuacugccgccacugcagcgccgaccgggagauccaucgccuccaccuguccaucugcaagaagcggaagaccuggagcaacgugaugcuggccgugugcaagcgcaugugcuuccgggcgaccgucgaggugagcaacaaggcccuccugauccguaacaucaucaacaccacguucgugcugugcauccuuauccuggccgucugcgugguguccaccagcgccgucgagauggagucccugcccgcgggcaccugggagcgggaggaagaccucaccaacuucugucaccaggagugucaggugacggagacagagugccugugcccuuacgaggccuuggugcuccgcaagccacuguuuagugacucaaucgucaagggaaugaagaaucugcucaacagcaccucccuggagaccagucuguccaucgaggcucccuggggcgcgaucaacgugcagagcacguucaagccgaccauguccgccgcgaauaucgcccucagcuggucuuccguggagcaccgcggcaacaagauccuggucucugggcguagcgaguccaucaugaagcuggaggagcgcacgggcauaagcuggaaccucgggguggaggaugccuccgagagcaagcuccugaccgugagcgucauggacuuaucgcagauguacagccccguguucgaguaccucuccggcgaccggcagguugaggaguggcccaaggccacgugcaccggggacugccccgagcgcugcggcugcaccagcuccacaugccugcacaaggaguggccgcacagccggaacuggcgcugcaaccccaccuggugcuggggcguggggaccggcugcacgugcugcgggcucgacguaaaggaccuguucaccgacuacauguucauaaaauggaaggucgaguacaucaaaaccgaggccaucguuugcguggagcugacaucccaggagcggcagugcacccucaucgaggcgggcacccgcuucaaccugggccccgucacgaucacgcuuagcgagccccggaacauccagcagaagcucccgcccgagaucgugacccugcacccccgcauugaggagggguucuucgaccugaugcacguucagaagguucucuccgccagcaccgugugcaagcuccagagcugcacccacggcgugcccggggaccuccaggucuaccacaucggcaaccuccugaagggggacaaggugaacggccaccugauccacaagaucgagccgcauuucaauacaagcuggauguccugggacggcugcgaccucgacuacuacugcaacaugggggacuggcccagcuguaccuacaccggcgugacccagcacaaccacgccgcuuucgucaacaugcugaacaucgagacggacuacacuaagaacuuccacuuccacuccaaacgggugaccgcccacggggacacgccccagcuggaccucaaggcgcgccccaccuacggagccggggagauaaccgugcuggucgagguggcagacauggaacugcacaccaagaagauugagaucagcgggcucaaguucgccagccugaccugcacgggcugcuacgcgugcagcuccgggaucagcugcaagguucggauccacgucgacgagcccgacgagcugaccgugcacgugaaguccgaggaccccgaccucgucgcggcuuccagcucccuuauggcccgcaaacuggaguucggcaccgacagcaccuucaaggccuucucugcgaugcccaagacaagccucugcuucuacauaguggagcgggaguacugcaaauccugcagcaaggaggacacccagaagugcgugaacaccaagcuggagcagccgcaguccauccugaucgagcacaaggggaccaucaucggcaagcagaacaacacuugcaccgccaaggccagcugcuggcuggagucugucaagagcuucuucuacgggcucaagaacaugcuguccggcauauucggcaauguguucaucgggguguuccuguuuuucgccccguucauccuccugauccuguucuucauguuuggcuggcgcauccucuucugcuucaagugcugccggcgcacccgagggcuguucaaguaccgccaccugaaggacgacgaggaaaccggcuaccggaagaucaucgagcgccucaacaacaagaagggcaagaacaagcugcuggacggggagcgccucgcugaccggaagaucgcggagcuguucagcacgaaaacccacaucggcuga

SEQ ID NO: 15209 - RNA, 5070 nt, Artificial Sequence
  derived and/or modified CDS sequence (opt11) from CCHFV(8402)__AB069674.1__GP
augagcuucagugugauguacacgccccugcucugcgccguccugugccugcagcucuggagccuggagggcucccacgggcugagcaacaagacccagcacuccaacaccagcaccaccaaggccccggaggugucccaggagcucggccuucccgugagcaccgucuccacgaucaccagcgacccgcccuccaucaccagcgcgguguccgugagcggguccgagggcagcggggacaccaacacguccccgagcgucaccacccagggcccgacccugcccgagacgacccucgagccccugaccaccacggacaccgacgccuccagcaccgugguggucgacgugagcacccagacggugaaggacaccccgaucuccaccaccuacacgagccugcccuccaccccgagcgagccuaccacgccccagggcacccaucacaccgcccgcgggcugcuguccgucacuagcaccaagcccgaggaggccuccacgcaggccaacccgggcaagaucagcauggagaccaaugggccccggcuggcgaucagcgagaccccgagcuucucccccaccacgcaggcccccaccgagaacucuaaccccaucaccuccaagcagcucaugcugagcgcccagccggugacccccaaccccaugaccucacccgugcagccggcccugucgcaguccgacacgagcaccgcgauccaggacguccacccaagccccaccggccgcagcaagcguaaccuugagauggagaucauccugacccugagccagggguuaaagaaguacuacgggaagauccugaagcugcucgaccugacgcuggaggaggacaccgagggccuccuggaauggugcaagcgcaaccuggggcucgugugcgacgacaacuucuuccagaagcggaucgaggaguucuuccugaccggcaaggggcacuucaacgaggugcugcaguucaagacccccuccacgcucagcccgacuggccccgcccgcaccggcucccccaccgucgagccguucaagagcuacuucgcaaagggguuccuguccauggacagcggcuacuucuccgcuaaguguuacccccgggccagcaacuccggguugcagcucaucaacgugacgcagcacagcacccgcaucaccgacacucccggccccaagaucacgaaccugaagaccaucaacugcaucaaccugaaggcguccguguucaaggagcaccgggagaucgagaucaacguccuccugccccagguggccgugaaccucucuuccugccacguacucaucaagagccacgugugcgacuacucccuggacaucgacgggcccguccgccugccccggauccaccacgagggcaccuucauccccgggaccuacaagaucgugaucgacaagaagaacaagcagaacgaccgcugcacgcucgugaccaacugcgucaucaaggggcgggagauccggaagggccagagcguucugcgucaguaccgcaccgagaucaagaucgguaaggccuccagcggcagccggcgccugcucuccgaggagagcggggacgacugcaucucccggacccagcugcugcguacggagaccgccgagauccacaacgacaacuacggcggcccgggggacaagaucaccaucugcaacggcagcacaguggucgaccagcgguugggguccgagcucggcugcuacacgaucaaccgugucaagagcuucaagcugugcgagaacuccgccaccggcaagagcugcgagaucgacuccacccccgugaagugccgccagggguucugccugaagaucacccaggagggccgggggcacgucaagcucagccgcggcuccgaggugguacuggacgcgugcgacagcuccugcgagaucaugauccccaagggcacgggcgacauccuggucgacugcagcggcgggcagcagcacuuccucaaggacaaccuuaucgaccugggcugccccaacaucccgcuccuggggaagauggccaucuacaucugccggauguccaaccaccccaagaccacgauggccuuccuguucugguucagcuucggcuacguggugaccugcauccucugcaaggucaucuucuaccugcugaucgugguggggacgcuuggcaagaaguuuaagcaauaccgcgagcugaagccccagacgugcaccaucugcgagaccacccccgucaacgccaucgacgccgagaugcacgaccugaacugcuccuacaacaucugcccguacugcgccagccggcucacuuccgacgggcuggcccgccacguuaugcagugucccaagcggaaggagaagaucgaggagaccgagcuguaccucaaccuggagcgcauccccugggugguccggaagcugcuccaggugagcgagagcaccgggguggcccugaagcgcuccagcuggcuggucguucuccuggugcugcucaccgucucccugagccccgugcaguccgccccgaucggccacgggaagacaguggagaccuaccagacccgggagggcuacaccagcaucugccuguuuguccucggguccauccuguucaucgugagcugccugaugaagggccucguggacuccgucggcaacagcuucuuccccgggcugucuauaugcaagacgugcagcaucggcuccguuaauggguucgagaucgagagccacaagugcuacugcucccuguucugcugccccuauugccgccacugcagcgccgaccgggagauccaccgccuccaccuguccaucugcaagaagcggaagaccggcagcaacgugaugcuggcggucugcaagcgcaugugcuuccgggccaccguggaaguguccaacaaggcccuccuuauccgcaacaucaucaacacaacguucguccugugcauccucauccuggccgugugcguggucagcaccuccgcgguggagauggaaucccugcccgccgggaccugggagcgggaggaggaccucacaaacuucugccaccaggagugccaggugacggagaccgagugccuuugcccguacgaggcccuaguccuccgcaagccccuguucagcgacuccaucgugaagggcaugaagaaccugcucaacagcaccucccuggagaccagccuguccauugaggcccccuggggcgccaucaacguucagucgacauucaagccgaccgucuccgcggccaacaucgccuuaagcugguccagcguggagcaccgcgggaacaagauccugguguccggccggagcgaguccaucaugaagcuggaggagcgcaccgggaucagcugggaccucggcgucgaggacgccuccgagucgaagcugcugaccguguccgucauggaccucagccagauguacagcccgguguucgaguaccuguccggggaccgccagguggaggaguggcccaaggccacgugcaccggcgauugccccgagcggugcggcugcaccagcuccacgugccugcacaaggaguggccgcacagccggaacuggcgcugcaaccccacuuggugcuggggcgucgggaccggaugcacgugcugcggccucgacgugaaggaccuguucaccgacuacauguucaucaaguggaagguugaguacaucaagaccgaggcgaucgucugcguggagcugaccucccaggagcggcagugcacacucauagaggccggcacccgcuucaaccuggggcccgugacgaucacccugagcgagccccggaauauccagcaaaagcucccgcccgagaucgucacccugcacccccguaucgaggagggcuucuucgaccuuaugcacgugcagaaagugcucuccgccagcaccgucugcaaacugcaguccugcacccacggggugcccggcgaccuccagguguaccacaucgggaaccuccugaagggcgacaaggucaacggccaccugauccacaagauugagccgcacuucaacacgagcuggauguccugggacgggugcgaccucgacuacuacugcaacaugggcgauuggcccagcugcaccuacaccggggugacccagcacaaccacgccgccuucgugaacaugcugaacaucgagacggacuacaccaagaacuuccacuuccacuccaagcgggucaccgcgcacggcgacacgccccagcuggaccucaaggcccgccccaccuacggggcaggcgagaucaccgugcugguggaggucgccgacauggagcugcacaccaagaagaucgagaucagcggccucaaguucgcgucccugaccugcacgggcugcuacgccugcagcuccggcaucagcugcaaggugcggauccacguggacgagccggacgagcugaccguccacgugaagagugaggaccccgacaucguggccgccagcagcucccucauggcccgcaagcuggaguucgggacugacaguaccuuuaaggcguucuccgccaugcccaagacgagccugugcuucuacaucgucgagcgggaguacugcaaguccugcagcaaggaggacacccagaagugcgugaacaccaagcucgagcagccccagaguauccugaucgagcacaagggcaccauaaucgggaagcagagcaacacgugcaccgccaaggccuccugcuggcuggagagcguuaaauccuucuucuacggccugaagaacauguuaagcggcaucuucgggaacgucuucaucggcguguuccuguucuucgccccguucauccuccucauccuguucuucauguucggguggcgcauccuguucugcuucaagugcugccggcgcacccggggccucuucaaguaccgccaccugaaggacgacgaggagaccggauaccgaaagaucaucgaacgccugaacaacaagaaagggaagaacaagcuccuagacggcgaacgccuggcggaccggaagaucgccgagcuguucuccacgaagacccacaucggguga

SEQ ID NO: 15210 - RNA, 5070 nt, Artificial Sequence
  derived and/or modified CDS sequence (opt11) from CCHFV(7803)__AB069672.1__GP
augcccguuuccaucaugcacaucucacugaugugcgccguccuaugccuccaacuguacggcuugggggagacccacggcagcuccaacgagaccgaacauaauaagacgaacguggugaccacgcccggcgacucgcagucccccgagccgcuggucagcaccacgcugcccgucacccucgacuccagcaccgugaccccgacgaccccggccuccgagcccgaggguagcggggaggucuacaccuccccgccaaucaccacggagggccugucucccagugaagcgaccuccgagcugcccgugacgacaggaauugggaucuccagcgccuccgacguugacagcucgacccaagccgccggcgacaccucgacccccacaguccgcacgagcccgccaaacucccccagcacgcccccuaccucccaggacacccaccaccccaugcggaaccuccucucugugacgucccucaaaagcgaggagaccuccgcccccagcaaguccgggaaggagucuccggcggccuccagcccgcaccccguugccucccgcccgcccacccaccccaucaccgcccagggcccaacggaaaacaacagccacaacaccaccgggcagcucgagucugucacucagagcgcgacccugggccccauggccucacccacccagaccgugcugagucagaacgugaccuccaucgccauccaggacacgcacccgucgcccaccaaccggagcaagcgcaaccucgagauggagaucauccugacccucccccagggccucaagaaguacuacgguaagguccugagacugcuccagcugacccuggaggaagacacugagggccuccuggaaugguguaagcgcaaccuggggcucgauugcgacgauacguucuuucagaagcggaucgaagaguucuucaucaccggggagggccauuuuaacgaggugcugcaguuccgcaccccgggaacacuuuccacgaccgagagcacccacgccgaauccccgaccgccgagcccuucaagucauauuucgcgaagggcuuccucuccaucgacagcggcuacuuuuccgccaagugcuacagccggacgucugacagcggccugcagcuuaucaacgugaccaggcacaguacucggaucgccgacaccccagggcccaagaucacgaaccucaagacuaucagcugcaucaaccugaaggccuccgucuucaaagagcaccgcgagguggaaaucaacguccuguuaccccaggucgccgugaaccugagcaacugccaugugacaaucaagucccacgucugugacuacagccuggacaucgacggcacagugcggcucccccauauccaccaugagggcacguucaucccagggaccuacaagaucgucaucgacaagaagaacaagcugaacgaccgcugcacacuguuuaccaacugcguaaucaagggccgggaggugcggaaggggcaguccguccuccggcaguacaagacggaaauccgcaucggaaaggcuagcaccgggucccggcgucugcuguccgaggagagcggugacgacugcaucucccggacccagcuccugcgcaccgagacggccgagauccacggcgacaacuacgggggcccgggggacaagaucaccaucugcaacggcucgaccaucguggaccagcgccugggguccgaaaugggcugcuacacaauaaaccgggugaaguccuucaagcugugcgaaaacuccgccacgggcaagagcugcgagaucgacuccauccccguuaaaugccgccagggguacugccugaagaucacccaggagggccggggucauguuaagcugagccgcggcagcgagguuauccuugacgccugcgacucguccugcgagguaaugaucccgaagggcaccggggacauccucguggacugcagcggcggucagcagcacuuccugaaggauaaccugauagaccucggcugccccucuaucccgcugcuggggaagauggcgaucuacaucugccggaugagcaaccaccccaagaccacgauggcguuccucuuuugguucuccuucggcuacgugaucacgugcauccugugcaaggccaucuucuaccuccucaucaucgucggcacccuggggaagagauucaagcaguaccgagagcuuaagccccagaccugcacgaucugcgagaccacccccgcuaacgcuaucgacgccgagaugcacgaccucaacugcucguacaacaucugcccguacugcgcaagccgucugaccagcgacggccuggcccggcacgucacccagugcccuaagcgcaaggagaagguggaggagacggaguuauaccuaaaccuggagcggauccccugggucgugcgcaaguugcuccagguaagcgaaucuaccgggguagcccuuaagagguccuccugguuaaucgugcugcugguccucuucgccaucagccuguccccggugcagucagccccgaucucccacggcaagaccaucgagacguaccaagcucgcgaggaguacacgagcauaugccuguucgugcucggguccauccuguucaucgugagcugccugaugaagggccucgucgauuccaucggcaacaucuucuuccccgggcugagcaucugcaagaccuguuccaucggcagcaucaacggguucgagaucgagucccacaaaugcuacugcucgcugcucugcugccccuacugccggcacugcuccgccgaccgcgagauucaccaacugcaccugucuaucugcaagaagcggaagacaggauccaacgugaugcucgccgccugcaagcgcaugugcuuccgggccaccauggaagugagcaacaaggcccugcugauccgcagcaucauuaacacgaccuucgucguauauauccucauucuggcagugugcgucgugagcaccuccgccguggagauggagucccugcccgccgggacuugggagcgcgaggaggaccucacgaacuucugccaccaggagugccaggucaccgagaccgagugccugugcccguacgaggcgcuugugcuccgacgcccccuguuccucgacagcaucgugcggggcaugaaaaacccccucaauuccaccagccuggagaccucccugagcaucgaggccccguggggcgccaucaacguccaguccacauacaagcccaccgugagcaccgccaacaucgcucucuccuggagcucuguggagcaucgcggaaacaagauccuggucagcggccgguccgagagcaucaugaaguuggaggagcggacggggaucuccugggaccucggcguggaggacgccagcgaguccaagcuguuaaccgugagcgucauggaccucagccagauguacagccccguguucgaguaccugagcggugaccgccagguggaggaguggcccaaggcgacaugcaccggcgauugcccggaacggugcgggugcacgacuucgacgugucugcacaaggaguggccccacagccggaacuggcgcugcaaccccacguggugcuggggcgucgguaccgggugcacuugcugcggcuuggacgugaaggaccuguucaccgacuacaugaucgugaaguggaaggucgaguacaucaagaccagagggauaguguguguggagcugaccucccaggagcgccagugcagccucaucgaggccgggacccgguucaaccugggcuccgucaccaucacccugagcgagccacgcaacauccagcaaaaacuaccgcccgagaucauuacccugcacccuaggaucgaggagggauucuuugaccugaugcacgugcagaagguccucuccgccagcaccguguguaagcugcagucaugcacccacggcgugcccggggaccugcaggucuaccaugugggcaaccuccuuaagggcgacaaggugaacggucaccugauccacaagaucgagccccaccucaacacgagcuggauguccugggacggcugcgaccuagauuauuacugcaacaugggggacuggcccagcugcacauacacgggcgucacccagcacaaccacgcguccuucgugaacuugcucaauaucgagaccgacuacaccaagagcuuccauuuccauucuaagcgcgucacggcccacggggacacgccacagcuggacuugaaggcccggcccaccuacggcgccggcgaaaucaccguccucguggagguggccgacauggaguucacuccgaaaaagaucgagaucagcgggcugaaauucgcgucccuuaccugcacaggcugcuacgcuugcagcucagggaucuccugcaagguccgcauccacguggaugaacccgacgaacucaccgugcacgucaagagcgacgaccccgacgucguggccgccaguagcucccugauggcacgcaagcuggaguucggcacggacaguaccuucaaggcguucuccgccaugcccaagaccaguuugugcuucuacaucguggaaagagaguacugcaaguccugcagcaaggaggacacccagaagugcgugaacacuaagcuggagcagccgcaauccauucugaucgagcacaaggggacgaucauuggcaagcagaacaacacgugcaccgccaaggccagcugcuggcuagaguccgucaagaguuucuucuacggccugaaaaauaugcuguccgggaucuucggcaacuucuucauggggaucuuccucuuccuggcgcccuucaucuugcucauccucuucuuuauguucggcuggcgcauucuguucugcuucaagugcugccgccgaacccggggccuguuuaaguaccgccaccucaaagacgacgaggagaccggguaccggcgcaucauagagcgucugaauaauaagaagggaaagaacaagcugcucgacggggagcgccuggcggaccggcgcaucgccgagcuuuucagcaccaagacccacaucggcuga

SEQ ID NO: 15211 - RNA, 5070 nt, Artificial Sequence
  derived and/or modified CDS sequence (opt11) from CCHFV(75024)__AB069671.1__GP
augcccgugagcaucaugcacaucagccugaugugcgccgugcucugccuucaacuguacgggcucggggagacucacgggucuuccaacgagaccgagcacaacaagaccaacguggugaccaccccgggugacagccagucccccgagccccuggucagcaccacccugcccgugacccucgacucuagcaccgugaccccgaccacucccgccuccggccccgaggggagcggcgaggucuacacuagcccgcccaucaccaccgaaggccugagccccuccgaggccaccagcgagcugcccgccaccaccgggaucggcaucuccagcgccuccgauguggacagcucaacccaggccgccggggacaccagcaccccaaccgugcgcacgagcccgcccaacuccagcuccaccccacccaccagccaggacacacaccacccgaugcgcaaccuccuguccgucacgagcuuaaagcccgaggagaccucagcgcccagcaagagugggaaggagagcccagccgccuccucaccgcaccccguggcgucccggccucccaccccgcccaccacggcgcaggggcccaucgagaacaacagccacaacaccaccggccagcucgaauccgugacccagucggccacgcugggacccauggccuccccgacccagacaguccugagccagaacgugaccuccaucgccauccaggacacccaccccagccccaccaaccggagcaagcgcaaccucgaaauggagaucauccugaccuugccgcaggggcucaagaaguacuacggcaaggugcugcggcugcuccagcucacccuggaggaggacaccgaggggcuccuggaguggugcaagcgcaacuuaggucucgacugcgacgacacguucuuccagaagcggauugaggaguucuucaucaccggcgaggggcacuucaacgagguccugcaguuccgaacccccggcacacugagcacgaccgagagcacucacgccgagagccccaccgcggagcccuucaagagcuacuucgccaagggguuccucuccaucgacuccggcuacuuuucggccaaaugcuacagccggacguccaacagcgggcugcagcugaucaacgucacccgccacuccacccgaauugccgacaccccgggccccaagaucacgaacuuaaagaccaucagcugcaucaaccugaaggcgucuguuuucaaggagcaccgggaggucgagaucaacgugcugcucccacagguggcggucaaccugagcaacugccacgugaccaucaagucccacgugugcgacuacucccuggacaucgacggcaccguccggcucccucacauccaccacgaggggacguucauuccgggcaccuacaagaucgugaucgacaagaagaacaaacuuaacgaccgcuguacccuguuuaccaacugcgucaucaagggccgggaggugcgcaaggggcaguccgugcuccggcaguacaagacggagaucaggaucgggaaggccagcacaggcagccggcgccugcuguccgaggagagcggcgaugacugcaucucccggacccagcuccugcgaaccgagacggccgagauucacggggacaacuacggcgggcccggcgacaagaucaccaucugcaacgggucgaccaucgucgaccagcgccugggcuccgagaugggcugcuacaccaucaaccgggucaagagcuucaagcucugcgagaacuccgcgaccgggaaguccugcgagaucgacuccaucccagugaagugccgccagggcuauugccugaagaucacccaggaggggcggggccacgugaaacugagccguggcagugaaguggugcuggacgccugcgacagcuccugcgaggucaugauccccaaggggaccggcgacauccucguggacugcagcgggggccagcagcacuucuuaaaggacaaccugauagacuuagggugccccuccaucccccugcugggcaagauggcgaucuacaucugccggaugucaaaccaccccaagaccacgauggccuuccucuuuugguucuccuucggcuacgugauaaccugcauccugugcaaggccaucuucuaccugcucaucaucguggggacccugggcaagcgcuucaagcaguaucgggagcugaagccccaaaccugcacgaucugcgagaccacccccgccaacgccaucgacgcggagaugcacgaccucaacugcagcuacaacaucugucccuacugcgccucccgccugaccagcgacgggcucgcccggcacgugacccagugccccaagcgcaaggagaagguagaggagacggagcucuaccugaacuuggagaggauccccugggucgugcgcaagcuccuccaggugagcgaguccaccggcgucgcccugaagcggagcuccuggcucaucgugcuccugguccuguucgcgaucagccuguccccuguccagagcgcaccaaucgggcacgguaagacaaucgagaccuaucaagcccgggaggaguauaccuccaucugccuguucgugcucggcucuauccuguucaucguguccugccugaugaaggggcucguggacucgaucgguaacaucuuuuuccccgggcuguccaucugcaagaccugcagcaucggcuccaucaacggguucgagaucgagagccauaagugcuacugcucccugcuuuguugccccuacugccggcacugcagcgccgaccgcgagauccaccagcugcaccuguccaucugcaagaagcggaagaccggcagcaacguuaugcucgccgugugcaagcgcaugugcuuccgggcgaccauggaggucuccaacaaagcccugcugauccgcagcaucaucaacacgacuuucguggugugcauccucauccuggccgucugcguggugagcacguccgccgucgagauggagagccugccggccggcaccugggagcgagaggaagaccucacgaacuucugccaccaggagugccaggugaccgagacagagugcuuaugccccuacgaggcgcuggugcuccggcgaccccucuuccuggacuccaucgugcgggggaugaagaaccagcucaacagcaccucccucgagacgagccugaguauagaggccccguggggcgccaucaacgugcagagcaccuauaagccuaccguguccaccgcaaacaucgcccucaguugguccagcgucgagcaccgcgggaacaagauccugguauccggccggagcgaguccaucaugaagcuggaggagcgcacggggaucagcugggaccucggcguggaggacgcguccgaguccaagcugcugaccgucuccgugauggaucucagccagauguacagccccguguucgaguacuuguccggggaccggcaggucgaggaguggcccaaggcgaccugcaccggggacugcccggagcgcuguggcugcacgaccuccacgugcuuacacaaggaguggccccacucccggaacuggcgcugcaaccccacuuggugcuggggcguggggaccgguugcacgugcugcgggcucgacgugaaagaccucuucaccgauuacaugauugucaaguggaagguggaauacaucaagaccgaggccaucgugugcgucgagcugacgagccaggagcggcagugcucccucaucgaggccggcacccgcuucaaccuggggagcgugaccaucacccuguccgagccccggaacauccagcagaagcucccgccugagauaaucacccugcacccccgcaucgaggagggcuucuucgaccugaugcacguccagaaggugcucagcgcguccaccgugugcaagcugcagagcuguacccacgggguccccggcgaccuccagguguaccacgugggcaaccuccugaagggggacaaggucaacggccacuugauccacaagaucgagccgcaccucaacaccuccuggaugagcugggacgggugcgaccuggacuacuacugcaacaugggcgacuggcccagcugcaccuacacgggggugacucagcacaaccacgccucauucguaaaccugcucaacaucgaaaccgacuacaccaaguccuuucacuuccacagcaagcgaguuacggcccacggcgauacgccccagcuggaccugaaggcccgccccacuuacggcgccggggagaucaccgugcucguggaggucgcggacauggaguucacgccaaagaagaucgagaucuccggccugaaguucgccagccugaccugcaccgggugcuacgccugcuccucaggcaucagcugcaaggugcguauccacguggacgaacccgacgagcucaccguccacgugaaguccgacgacccagacguggucgccgccagcuccucccucauggcgcgcaagcuggaguucgggacggacucaaccuucaaggcuuucagcgccaugcccaagacaucccucugcuucuacaucguggagcgggaguacugcaagagcugcuccaaggaggacacccagaagugcgugaauacgaagcuggagcagccgcagagcauucugaucgagcacaagggcacuaucaucggcaagcagaacaacacgugcaccgccaaggccuccugcuggcucgagagcgucaagucguucuucuacgggcugaagaacaugcugagcggcaucuucgggaaccucuuuaugggcaucuuccuguuucuggcgcccuucauccugcucauccuguucuucauguucgguuggcgcauccuguucugcuuuaagugcugccggcgcacgcgcggccucuucaaguaccggcaucugaaggacgacgaggagaccggcuaccgccggaucaucgaaaggcugaauaacaagaaggggaagaacaagcuccuggacggcgagcggcuggccgaccgacggaucgccgaacucuucuccaccaaaacccacaucggguga

SEQ ID NO: 15212 - RNA, 5070 nt, Artificial Sequence
  derived and/or modified CDS sequence (opt11) from CCHFV(66019)__AB069669.1__GP
augcccgccaauaucauguauacgcuccucgucugcgcgguauuaugcccgcaacuuuggucacuggaaggcacacaugucccccacaacgaaacaaaacauaacggcaccgggauaacagcugcccccggcgaaagccagggcccgaugagcccagcguccacagccguaccgcuuaccccugagccacccaacacgaagccggcagcuucggccucagaacucgagagcuccggagaaggccacaccagccuuuuagcgacgacacaagguuuaacauccccagaagcaacccccgaauuaccgaccaccaccgacacgggagucucguccaccucuguugucgacauuggcacgcagauggccaaagacacccccaccuccacugcccacacaagccuccccaguaacccguccgccccuuccacagcgcagggaacgcaccacacaauccgaggacuccucuccgucaccucaaccaagccagaggaggcgaguacacccaccgacccagggaaagccggggcagagaccggauccccacgccccgcaaucagccgcaagcccacccugucccccacggccgaagcccccacggaaauuaacaacuccuccaccccuaaacagccagaaccuagcauccaaccugcuaccccaucccugguuaucucgccggcccagcccgcguucccgcaaucggccacuuccaccgcugcacaagacaucuacuccagucccaccaaccgaagcaaacgcaaccucaagauggaaaucauccucacauuaagccaaggacuuaaaaaguauuacgguaaaauacaaaagacccucggcuugacccuggaagaagacaccgaaggccuacuagaauggugcaaacgaaaccucgggcuaaccugcgacgacaacuucuuccaaaaacgcauagaagaguucuuucuaaccggugaaggauauuucaaugaaguacuccaauucaaaacccccucaacacccgggucaacugaaccaacccauaccgaagcacccacgguaaaacccuucaaauccuacuucgcccgcggauuccucacaaucgacagcggcuauuucagcgccaaauguuacuccagaaccagcaauucuggacugcagcuaauaaacgucacgcagcacccagcccgcaucgccgacacccccggacccaagauaacaaaucucaaaaccaucaacugcaucaaccucaaagccuccguuuucaaggaacaccgagaaaucgaaaucaauguucuccucccacaagucgccgucaaccucaguaacugccacguacuuauaaaaucgcacguuugugacuacucacucgacauagacggaacaaucagacucccgcgcauuuaccacgagggcaccuucaucccuggaacauacaaaauugugaucgacaaacgagacaaacaaaacgaucgauguaccuuaguaacaaacuguguaauuaaaggucgugaagugagacgcggccaguccgcauugcggcaguaucgcacagaaauacggaucggaaaagccucagccggaucacgacgccuccucucagaggaauccggcgacgacuguaucucgcggacccaguuacuccgcaccgaaacagccgagguacacggagacaauuacggcggacccggagauaagaucacaaucugcaacgguuccaccaucgucgaucaacgccucgggagcgaguuaggguguuauacaauuaacagggucaagucguucaaacugugcgagaacuccggcacuggcaagagcugcaagaucgacaacacccccguuaaaugucgccaaggcuucugccucaaaauaacccaagaagggcgcgggcaugucaagcuaucucgcggauccgaaguaguccuugacgcgugugacucuagcugcgaaaucaugauccccaagggaaccggagacauacucgucgacuguucaggaggacagcaacacuuccuaaaagauaaccucguagaucucggcugucccaacauacccuuacucggcaaaauggcaaucuauaucugcaggaugucaaaucacccgaaaacgaccauggccuuccuauucugguucagcuucggcuacguuauaacauguaucuucugcaaaauaauauucuaccuacugauaguggugggcacacuagguaagaaauuuaaacaguaccgagaacugaaaccucaaacaugcaccaucugugaaacaacccccaccaacgcaaucgaugcagaaaugcacgaccucaaaugcagcuauaauauaugcccuuacugugccagcagacuaaccucagacggacucgcacgacacgugacgcaaugccccaaacgaaaagaaaaggucgaggaaacagagcuauaccucaaucuagagcguaucccguggaucguccggaaacucuuacaaguaucagaaucaacgggcgucgccuuaaaacguucuucguggcucauaguacuccugguccuccucacagugucacugucuccgguacaauccgcacccauaggacacgggaaaacaaucgaggcuuaccagacacgagaagguuacaccucagucugccucuucaugcugggaggaauacuauucguagucuccugccuaaugaaaggguuaguagauuccgucucuaauagcuucuucccaggacucucaauuuguaaaaccuguucuauaggcucaguaaacggcuucgaaauagaaucucacaaauguuacugcagucuccuaugcugccuauacugcagacacugcuccgccgacagagaaauacaccaacuccaccucuccaucugcaagaaacgacgcgcaggaggaaacgucauguuagccgugugcaaaagaaugugccuuagagcaacgauggaaguaagcaauaaaguccucuucauucgcuccauaauuaacacgacuuuugucauauguauccuagugcuugcgguauguaucgugucaaccucagcagucgaaauggaaucgcuccccgcagguacgugggaacgagaggaagacuuaacaaauuucugccaucaggaaugucagguaacggaaacagaaugccuaugcccuuacgaagcccucguccuucgaaaaccccucuucuccgacagcaucgucaagggaaugaaaaaucugcuaaauucgacgucacuggaaacuucucuguccaucgaggcaccauggggagccauaaauguccaauccacauucaagcccacaguaagcaccgccaacaucgcacuuucgugguccagcguggaacaccgcggaaacaagaucuuggucucaggccgauccgaaucaauuaugaaacucgaggagagaaccggcaucucgugggacuuaggcguagaagacgcuucagaguccaaacuccuuacagugucggucauggacuugucccaaauguacuccccagucuucgaauaccucagcggagacagacaaguagaagaguggcccaaagcaaccugcaccggaaauugcccggaccgcugcggaugcacaucauccacgugucuacacaaagaauggccccacagccggaacuggaggugcaacccgacauggugcugggguguaggaacgggguguacuugcugcggccuagaugucaaagacuuauucacugacuacauguucguuaaguggaaaguagaguacauaaaaacagaggcaauaguaugcgucgaacucaacucacaggaacgucaaugcucgcucaucgaagccggcaccagauucaaucuaggccccgucacuaucacgcugucagagccacgaaacauucaacaaaaacuuccgagcgaaaucaucacccuccacccucguaucgaagaaggcuucuucgaucucaugcaugugcaaaaagugcucagugccuccaccgucugcaaacuccagucaugcacgcacggaguuccuggugaccuccaaaucuaucacaucgguaaccugcucaagggcgaucgcguuaacgggcaucuaauucacaaaaucgaaccccacuucaacacaucuuggaugucgugggacgggugcgaucucgacuacuauugcaacaugggagacuggcccuccuguacguacaccggcgucacgcaacacaaucacgccgcguucgucaaccugcucaauauagaaaccgacuacaccaaaaauuuccauuuccacucaaagcgaguuacagcacacggcgacacgccccagcucgaccuaaaagcacgccccacauacggggcaggagaaaucacaguccugguagaaguagccgacauggaacugcacacaaagaaaaucgcaauuagcggccucaaauucgccagccugaccugcacaggcugcuaugcaugcagcucaggcaucucuugcaaagugagaauacacguggacgaacccgacgaacucacaguacacguuaaauccgaggaccccgacaucguugcagccuccucaucccucauggcccgcaaacuugaguucggcaccgacagcacuuucaaggccuucuccgccaugcccaagacuucucucugcuucuacauagucgaacgagaauauugcgaauccugcucaaaagaagacacgcaaaaauguguaaacacaaaacucgagcaaccacaaucaauccucaucgaacacaagggaaccauaaucggcaaacagaacgauaccugcacugcaaaggcgucguguuggcuagagucaguaaaaucauucuuuuacggccucaaaaauauguuaucggggauauucgggaacgucuucaucggaaucuuccucuuccuggcucccuucauucuccuaauacucuucuucauguucggauggcgcauacucuucuguuucaaaugcugucgacgcacucgcggccuuuucaaauaucgauaucuaaaggacgacgaagaguccggcuaccgacgaaucaucgagcgccuaaacaauaagaaggguaagaauaaacuccucgacggagaacggcuugcagaucgacggaucgcugaacuauucucaacaaaaacucauaucggcuaa

SEQ ID NO: 15213 - RNA, 5070 nt, Artificial Sequence
  derived and/or modified CDS sequence (opt11) from CCHFV(BA8402)__AF350449.1__GP
augagcuucuccgugauguauacgccccugcucugcgccguccugugccuucagcucuggagccuugagggcucccacggucugagcaacaagacccagcacucgaacaccaguacaaccaaggccccggaagugucccaggagcucggccugcccguguccaccgucuccacgaucaccagcgagccgcccuccaucaccagcgcgguguccgugucuggguccgaggguagcggggacaccaacacgucccccagcgucaccacccaaggccccacccugcccgaaacgacccucgaaccccucacgaccacggacaccgaugcuucuagcaccguugugguagacgugagcacacagacggugaaggacacccccaucuccaccaccuacacgagccugcccuccacccccagugagcccaccacgccucaggguacgcaccacacugcccgagggcuccuguccgucaccagcacaaagccugaggaggcgagcccccaagccaacccugggaagaucagcauggaaacgaacgggccucggcuggcgaucuccgagaccccuagcuucagccccacgacccaggcccccacggagaauagcaacccgaucaccuccaagcaguuaaugcugagcgcccaacccgugaccccuaaccccaugaccuccccggugcagcccgcccugagccaguccgacaccagcaccgcgauccaggacguccaccccuccccgacaggacgcagcaagcggaaccucgagauggagaucauccugacccugagccaggggcucaagaaguacuacggcaagauccugaagcugcucgaccugacccuggaggaggacacggaggguuuacuggaguggugcaagcgcaaccuggggcucguaugcgaugacaacuucuuccagaagcggaucgaggaguucuuccugaccggaaaagggcacuucaacgaggugcugcaguucaaaaccccguccacccucagccccacgggccccgcaaggaccggcuccccaaccguggagcccuuuaagagcuacuucgccaagggguuccuguccauggacagcggguacuuuuccgccaagugcuacccccgggccagcaauagcgggcugcagcucaucaacgucacccagcacagcacccgaaucaccgacacccccggcccgaagauaaccaaccugaagacgaucaacugcaucaaccugaaggcuuccguguucaaggaacaccgggagaucgagaucaacguccuccugccccagguggccgugaaccugagcuccugccacguccucauaaagucucacgugugcgacuacucgcuagacaucgaugggcccguccgccugccacggauccaccacgagggcaccuucaucccuggcaccuauaagaucguuaucgacaagaagaacaagcagaaugaccgcugcacucuuguaacgaacugcgucaucaaggggagagagauccgcaagggccagagcguucugcggcaguaccgcaccgagaucaagaucgggaaagccuccagcggcucacggcgccugcucuccgaggagagcggggacgacugcauuucccggacccagcuucugcgcacggagacggccgagauccacaacgacaacuacggcggccccggggacaagaucaccaucuguaacgggucuaccguggucgaccagcggcugggauccgagcucggcuguuacaccaucaaucgcgugaacagcuucaaccucugcgagaacacggccaccgggaaaagcugcgagaucgauagcacccccgugaagugccgucagggcuucugccugaagaucacucaggagggccgggggcacgucaagcucagccgcggcagcgaagucgugcuggacgcgugcgaguccuccugcgagaucaugauccccaaggggacgggggacaucuuggucgacugcuccggcgggcagcagcacuuccucaaggacaaccugauugaccugggcuguccgaacaucccucuacuggggaagauggcgaucuauaucugccggaugagcaaccacccaaaaaccaccauggccuuccuuuucugguuuuccuucggcuacguggugaccugcauccucugcaaggucaucuucuaccuccugaucguugugggcacgcucgggaaaaaguucaagcaguaccgcgagcugaagccccagaccugcaccaucugcgagaccaccccggucaaugccaucgacgcggagaugcacgaccugaacugcagcuacaacaucugccccuacugcgcgucccggcccacgucggacgggcucgcccgccacgugaugcagugcccuaaacggaaggagaagaucgaggaaaccgcucuguaccugaaccucgagcgcauuccgugggugguccgaaagcugcuacagguguccgagagcaccgggguggcccucaagcgcagcuccuggcuggucgugcuccucgugcugcugaccgucagccucucccccgugcagucugcucccaucggucacgggaagacugucgagaccuaccagacccgggagggcuacaccucgaucugccuguucgucuuagguagcauacucuuuaucgugagcugccucaugaagggucucguggacagcguuggcaacuccuucuucccggggcucagcauuugcaaaacgugcuccaucgggagcguaaacggguucgaaaucgagucccacaagugcuacugcagccuguucugcugcccguacugccgucacugcuccgcagacagggagauccaccgacugcaccucagcaucuguaagaagcggaagaccggcucuaacgugaugcuggccgucugcaagcgcaugugcuuccgggccaccguggaggugagcaacaaagcccugcuaauacgcaacaucaucaacaccacguucguccugugcaucuuaauccucgcuguaugcguggucuccaccagcgccguugagauggagagccugcccgccggaaccugggagcgggaggaggaccugaccaacuucugccaucaggaaugccaggugacggagaccgagugcuugugccccuaugaggcccuggucuuacgaaagccccucuucuccgacucuauagugaaggggaugaagaaccugcugaacuccaccagcuuggagacuucccugagcaucgaggcucccuggggcgcgauaaacgugcaguccacguucaagcccaccgucagcgccgccaacaucgcucuuagcuggucauccguggagcacagggggaauaaaaucuuggugucaggccgguccgagaguaucaugaagcuggaggagcgcaccgggaucaguugggaccugggcgucgaggacgccucagaguccaaacuccugaccgugagcguaauggaccugucccagauguacagccccguguucgaguaccucagcggggaccgccagguggaggaauggccuaaggcgacgugcaccggcgacugucccgagcgaugcggcuguacuuccagcacgugccugcacaaggaguggccccacucccggaacuggcgcugcaaccccaccuggugcuggggcgucgggaccgggugcacgugcugcggccuggacguaaaggaccucuuuaccgacuacauguucaucaaauggaagguggaguacauuaagaccgaggccaucgucugugucgagcugaccagccaggagcggcagugcacucugaucgaggcaggcacccgguucaaccuagggccgguuacgaucaccuuauccgagccccggaacauccagcagaagcugccgcccgagaucgucaccuuacacccccgcaucgaggagggcuucuucgaccuuaugcacgugcagaaggugcuguccgccuccaccgucugcaagcuccagagcugcacccacggggugcccggagaccuccagguauaccacaucgggaaccugcugaaaggcgacaaggucaacggccaccugauccacaagaucgagccacacuucaacacguccuggaugagcugggacgggugcgaccugcacuacuacugcaacaugggcgacuggcccucgugcaccuacacgggcgugacccaacacaaccacgccgcguucgugaauaugcucaacaucgagacggacuacaccaagaacuuccacuuccacagcaagcgggucaccgcccacggcgacaccccgcagcuggaccugaaggcucgacccacguacggggccggcgaaaucaccgugcuugucgaggucgcggauauggagcugcacaccaagaagaucgagaucuccggccugaaguucgcaagccugacuuguaccgggugcuacgccugcuccagcggcaucuccugcaaggugcggauccacgucgacgagcccgacgagcugaccguccacgucaagagcgaagaccccgauaucguggccgcauccucgagccugauggcgcgaaagcucgaguuugggaccgacagcaccuucaaggccuucagcgccaugccgaagacaucccuaugcuucuacaucguggagagggaguacugcgagagcugcuccaaggaggacacccagaagugcgugaacaccaagcucgagcagccccaaucgauccucaucgaacauaagggcaccauaaucgggaagcaauccaauacgugcaccgccaaggcaagcugcuggcuggaguccgucaagagcuucuuuuacggccugaaaaacauguuauccggcauauucgggaacguguucaucggcgucuuccucuucuucgcgcccuucauccugcuaauacucuucuucauguuuggguggcgcauccuauucugcuuuaagugcugccggcgcacccggggccuguuuaaguaccggcacuugaaggacgacgaggagaccggcuaucggaagaucaucgaacgccugaacaacaagaagggaaagaacaagcugcucgacggcgagcgccuggcugaccggaaaaucgccgagcuuuucagcacgaaaacccacaucggguaa

SEQ ID NO: 15214 - RNA, 5070 nt, Artificial Sequence
  derived and/or modified CDS sequence (opt11) from CCHFV(BA66019)__AF350448.1__GP
augcccgccaacaucauguauaccuuacucgugugcgccguccugugcccgcagcuguggagccucgaggggacccacguuccccacaacgagacgaagcacaacgggaccggcaucaccgcggcccccggggagucccagggccccaugagcccggccuccaccgccgugccccugacgcccgagccuccgaacaccaagcccgccgcgagcgccuccgagcuggagucauccggggagggccauaccagccuccuggccaccacgcagggccugaccucccccgaggccacacccgagcucccgaccacgaccgacaccggagucagcuccaccagcgugguggacaucggcacccagauggccaaggacacccccaccuccaccgcccacacgagcuuacccuccaaccccagcgccccguccaccgcccaggggacccaccacaccauccgcggccugcuuagcgucacguccacuaagcccgaggaggccagcacccccaccgaccccgggaaggcgggcgccgagacgggcagcccgcggcccgccaucucccgcaagcccacccugagccccaccgcagaggccccgaccgagaucaacaacuccagcacgcccaagcagcccgagcccuccauccagccugcgacccccagccuggugaucucccccgcucagccggccuucccccaaagcgccaccuccaccgccgcgcaggacaucuacagcucccccacgaaccggagcaagcgcaaccucaagauggagaucauccugacccugucccaggggcucaagaaguacuacggcaagauacaaaagacccuggggcugacccucgaggaggacaccgagggccugcuggaguggugcaagcggaaccucggccugacgugcgacgacaacuucuuucagaagcgcaucgaggaguucuucuugaccggggagggcuacuucaacgaggugcuccaguucaagaccccgagcaccccggggucaacggagcccacccacgccgaggccccuaccgucaagcccuucaagagcuacuucgcgcggggcuuccugaccaucaacuccggguacuucagcgccaagugcuauuccuggacgagcaacagcggccugcaguugaucaacgugacccagcacccggcgcgcaucgccgacacccccggucccaagaucaccaaccugaagacgaucaacugcaucaaccugaaggccuccguguuuaaagagcaccgggagaucgagaucaacguccuccugccccagguggccgugaacuuaagcaacugccacguccucaucaagucccacguaugcgacuacagccuggacaucgacgggaccauccgccugccgcggaucuaccacgagggcaccuucauccccgggacauacaagaucguaauugacaaacgcgacaagcagaacgaccggugcacgcucgucaccaacugcgugaucaaaggccgcgaggugcgaaaggggcaguccgcgcugcgccaguaccggaccgagauccggaucggcaaggccagcgccggcucccggcgccugcucagcgaggaguccggggacgacugcaucagcagaacccagcugcugcgcacggagaccgccgagguccacggcgacaacuacgggggccccggggacaagaucaccaucugcaacggcuccaccaucguggaccagcgccucggcagcgagcugggaugcuacacgaucaaccgggugaaguccuucaagcugugugagaacagcggcaccgggaaguccugcaagaucgacaagcaccccgucaagugccgccagggcuucugccucaagaucacccaggagggccgggggcacgugaaguuaagccgcggcuccgaggucgugcuggacgccugcgacagcagcugcgagaucaugaucccgaaggggaccggagacauccugguggauugcuccgggggccagcagcacuuccucaaggacaacuuggucgaccugggcugccccaacaucccccuccuggggaagauggcgaucuacaucugccggaugagcaaccaccccaagacgaccauggccuuccuguucugguucaguuucggcuacgugaucacgugcaucuucugcaagaucaucuucuaccuccugaucguggucgggacccugggcaagaaguucaagcaguaccgcgagcucaagccgcagaccugcaccaucugcgagaccacccccacgaacgccaucgacgccgagaugcacgaucugaagugcagcuacaacaucugccccuacugcgccucccggcugaccagugacgggcucgcgcgccacgugacccagugccccaagcggaaggagaagguggaagagaccgagcuguaccugaaccucgagcgcaucccguggaucguccggaagcugcuccagguguccgagagcaccggcguggcccugaagcgcuccagcuggcugaucguucugcucgugcugcugacggugucccucagccccguccaguccgcccccaucggccacgggaagaccaucgaggccuaucagacccgggagggcuacaccagcgugugccuguucaugcucgggggcauccuguuugugguauccugccugaugaaggggcugguggacucuguguccaacagcuucuucccgggccucaguaucugcaagacgugcagcaucggcucggucaacggguucgagaucgaaucccauaagugcuacugcagccugcugugcugccucuacugccgccacugcagugccgaccgggagauccaccagcugcaccugagcaucugcaaaaagcgccgggcgggcgguaacgugaugcucgccgugugcaagcgcaugugccugcgggccaccauggaggucuccaacaaggugcuguucauccgcagcauaaucaacaccaccuucgugaucugcauccucguccuggccgugugcaucguguccacgagcgcggucgagauggagucccugcccgccggcaccugggagcgcgaggaggaccucaccaacuucugccaccaggagugccaggugaccgagacggagugccugugccccuacgaggcccuggugcuccggaagccccuguucagcgacuccaucgucaagggcaugaagaaccugcucaacagcaccucccuggagaccagccugagcaucgaggcgccguggggcgccaucaacgugcagagcaccuuuaagcccacgguguccaccgcgaacaucgcccuuagcugguccagcgucgagcaccgcggcaacaagauccuggugagcgggcgguccgagagcaucaugaagcuggaggagcgcaccggcaucuccugggaccucgggguggaggacgccagcgaguccaagcugcugaccgucagcgugauggaucucucccagauguacucgcccguguucgaguaccuguccggcgaccggcaggucgaggaguggcccaaggccacgugcacuggcgacugcccagaccgcugcgggugcaccagcuccaccugucugcacaaggaguggccccacagccggaauuggcgcugcaaccccaccuggugcuggggcguggggaccggcugcacgugcugcgggcucgacgugaaggaccuguucaccgacuacauguucgucaaguggaagguggaguacaucaagaccgaggccaucgugugcgucgagcugaacucccaggagcggcagugcagccucaucgaggcgggcacccgcuucaaccuggggcccgugaccaucacccugucggaaccgcggaacauccagcagaagcucccgcccgagaucaucacgcugcacccccgcaucgaggagggguucuucgaccugaugcacgugcagaagguccucagcgccuccaccgugugcaagcugcagagcugcacccacggcguccccggggaccugcagaucuaccacauuggcaaccucuugaagggggaccgggugaacggccaccugauccacaagaucgagccccacuucaacaccuccuggaugagcugggacggcugcgaccucgacuacuacugcaauaugggagacuggcccaguuguacguacaccggcgugacccagcacaaccacgccgccuucgucaaccugcugaacaucgagacugacuacaccaagaacuuccacuuccacuccaagcgcgugacggcccacggggacacuccccagcucgaccugaaggcgcggccgaccuacggcgccggggagaucaccgugcuggucgagguggccgacauggagcuccacaccaagaagaucgccaucagcgggcugaaguucgcgucccugaccugcaccggcugcuacgccugcagcuccgggaucagcugcaaggugcgcauccacgucgacgagccggacgagcucaccgugcacgugaaguccgaggaccccgacaucgucgccgccagcuccagccugauggcccggaagcuggaguucggcacagacuccaccuucaaggcguucagcgccaugcccaaaaccucccucugcuucuacaucguggagcgcgaguacugcgagagcugcuccaaggaggacacccagaagugcgugaacacgaagcuggagcagccgcagagcauccuuaucgagcacaaggggaccaucaucggcaagcagaacgacacgugcaccgccaaggccuccugcuggcucgagagcgucaaguccuucuucuacggccugaagaacaugcugagcgggaucuuuggcaacguguucaucgggaucuuccucuucuuggccccuuucauccuccugauccucuucuucauguuuggcuggcggauccuguucugcuucaagugcugccgccgcacccgcggacuguucaaguaccgcuaccucaaggacgacgaggagagcggcuaccgucgcaucaucgagcggcugaacaacaagaaaggcaagaacaagcugcuggacggggagcggcuggcggaccggcgcaucgccgagcuguucaguaccaagacccacaucggcuga

SEQ ID NO: 15215 - RNA, 5070 nt, Artificial Sequence
  derived and/or modified CDS sequence (opt11) from CCHFV(BA88166)__AF338470.1__GP
augagcuucuccgugauguacacgccccugcucugcgccguacugugccugcagcucuggucccuggagggcucccacgggcuuagcaacaaaacccagcacucaaacaccuccaccaccaaggccccggaggugucccaggagcucggccugccggugagcaccgucuccaccaucaccagcgacccgcccucgaucaccuccgcagugagugugagcggauccgaaggcagcggggacacaaacacgucccccagcguuaccacccagggccccacccugcccgaaacaacccuagagccccuaaccacuacggacacggaugccuccagcaccgugguggucgacgugagcacccagacugugaaggauaccccgaucucaaccaccuacacgagccugccguccaccccgagcgagcccaccaccccgcagggaacgcaccacaccgcccgcgggcugcuguccgucaccucgaccaaacccgaggaggccuccacgcaggccaacccgggcaagaucagcauggagacuaauagcccccgucuggcgaucagcgagacgccguccuucucgcccacgacgcaagcacccaccgaaaacaguaaccccaucaccagcaagcagcucauguugagugcccagcccgugacccccaaccccaugaccaguccggugcagcccgcccugucccagagcgacacgucuaccgcgauccaagauauccacccuagccccacugggcgcucuaagcggaaccuggagauggaaauaauccugacccugucacagggccucaagaaguacuacgggaagaucuugaagcuguuagaccugacacuagaagaggacaccgagggacuccuggaguggugcaagaggaaucugggccuggucugugacgacaauuucuuucagaagcgcaucgaggaguuuuucuugaccggcaagggccacuucaacgaagugcugcaauucaaaacccccucuacguuauccccgacagggcccgcccgcaccggcagcccgaccguggagccguucaagaguuauuuugccaagggcuuccuaagcauggauuccggguacuuuuccgccaaaugcuauccccgggcguccaacagcggccugcagcucauuaacgucacacagcacaguacccgcauuaccgauacacccgggcccaagauaacgaaccuuaagaccauuaacugcaucaaccugaaggcgucuguauucaaggaacaccgggagaucgaaaucaacgugcuccugccgcaagucgccgugaacuugucuagcugucacgugcucaucaagagucacgugugcgacuacagccuggacaucgauggccccguacgccugccccggauccaccacgaggggaccuucauccccggcaccuacaagaucgucaucgacaagaagaacaagcagaacgaccgcugcacgcucgugaccaacugugugaucaagggccgggagauccgcaagggucaguccguccugcggcaauaccgcaccgagaucaagaucggcaaggccagcagcgggagccgucgccugcucagcgaggaguccggcgacgacugcaucagccggacccagcugcugcgcaccgagaccgccgagauccacuccgacaacuaugggggcccgggggacaagaucaccauaugcaacgggucaaccgugguggaccagcggcugggcuccgagcucggcugcuacacuauuaaccgcguaaagagcuucaagcugugcgagaacuccgccacuggaaagagcugcgaaaucgauagcaccccggugaaaugccgccaagguuucugccugaagaucacccaggagggucggggccacgugaagcucagccgcggcuccgaggucgugcuggacgcgugcgacagcuccugcgagaucaugauccccaagggcacuggugacauccuaguggacugcagcggcggccagcaacacuuccucaaggacaaccuaaucgaccuugggugcccaaacaucccucuccuggggaagauggccauuuacauaugccggaugucaaaucaccccaaaaccaccaugggcuuccuguucugguucagcuuuggguacgucguuaccugcauacugugcaaaggaaucuucuaccugcucaucguggucgguacucucggcaagaaguuuaagcaauaccgcgagcuaaaaccgcagaccugcaccauaugcgagaccacccccgugaaugccaucgacgccgagaugcaugaccucaacugcuccuauaauaucugcccguacugcgcgagccggcucacgagcgauggguuggcacgccacguaaugcagugccccaagcggaaggagaagaucgaggagaccgagcucuaccucaaccuugaacgcauacccugggucgugcgcaagcugcuacagguguccgagucgaccggcgucgcccugaagcgcuccagcugguugguggugcuccugguccugcucaccgugucccugucuccagugcaguccgccccaaucgggcacggcaaaacggucgaaaccuaucagacccgggaaggguacaccagcaucugccuguucgugcucggcuccauccuguucaucguuagcugucugaugaagggccucgucgacucgguggggaacagcuucuuccccggccuguccauaugcaaaacaugcagcaucgggucagugaacggcuucgagaucgagagccauaaaugcuauuguucccuguucugcugucccuacugccgccacugcucagcagaccgcgagauccaucgccuccaccuguccaucugcaagaagcggaagaccuggagcaacgucaugcuggccguguguaagcgcaugugcuucagggcgaccguggaggucagcaacaaggcccuccugauccgcaauauuaucaacaccaccuucgugcugugcauccucauccuagcagugugcguggugucaacgagcgccguggagauggaaucucugcccgcggggaccugggagcgggaggaagaucucaccaacuucugccaccaagaaugucaggucacggagacagagugccugugcccguacgaagcccugguccuccgcaagccccuuuaccuggacagcaucgugaaaggcaugaagaauuuacuuaacuccacgagccuggagaccucccucagcaucgaggcgcccuggggcgccaucaacguccaguccacguuuaagccgacuaugagugcugcgaacauagcccuguccuggagcuccguggagcaccgcgguaacaagauccugguaagcggccggagugagagcauaaugaaauuggaggaacgaaccgggauaaguuggaaccugggcgucgaggacgccagcgaauccaagcugcucacggucagcgugauggaccugagccagauguacucgccgguauucgaguaccuuagcggggaccgccagguggaggaguggcccaaggccacgugcaccggcgacugccccgagcggugcgguuguaccaguaguacgugccuccacaaggaguggccgcacucacggaacuggcgcugcaaccccaccuggugcuggggcgucggcaccggcugcacguguuguggccuagacgugaaagaccuguucacggacuacauguucaucaaguggaagguggaguacaucaaaaccgaggccaucguaugcguggagcucaccagccaggaacggcaguguacccugauagaggcgggcacccgcuucaaccugggucccguuaucaucacgcucuccgagccccggaauauccagcaaaagcugccgcccgaaauagucacccugcacccccgaauagaggaaggcuucuucgaccucaugcacguccagaaagugcugagcgccuccacugucugcaagcugcagagcugcacccauggagugccaggcgaucuccagguguaccacaucgggaauuuacugaagggcgacaaagugaacggccaucucauccacaagaucgagccgcacuucaacacauccuggaugagcugggacgggugcgaccuggacuacuacugcaacaugggugacuggcccuccugcacguauaccggggucacccaacacaaccaugccgccuucgugaacaugcugaacaucgagaccgacuacacgaaaaacuuucacuuccacagcaagagagucaccgcccacggcgacacgccccagcucgaccugaaggcgcgcccuacuuacggggccggagagaucaccguguuaguggagguagccgacauggagcuccacaccaaaaagauagagaucuccggccugaaguucgccucgcugaccugcacgggcugcuacgcgugcuccaguggcaucucuugcaaggugcggauccacguugacgaaccggacgaacucacgguccacgugaagagugaagacccagacaucguggcugcuagcuccagccugauggcccgcaaguuagaguucgggaccgacuccaccuucaaagccuuuagcgcgaugcccaagaccucccugugcuucuacaucgucgagcgugaguacugcaagagcugcuccaaggaggacacucaaaagugcgugaacaccaagcuggagcagccucagagcaucuuaaucgagcacaaaggcacuaucaucgggaagcagaacaauaccugcaccgccaaggccuccugcuggcucgaaagcgugaaguccuucuucuacgggcucaagaacaugcugagcggaaucuucggaaacguauucaucggcguguuccuguucuucgcccccuucauccuccuuauucuguucuucauguucggcuggcgcauccuguucugcuuuaagugcugccggcgcacacggggcuuguucaaguaccgccaccugaaagacgacgaggagaccggcuaccggaagaucaucgagcgccucaacaacaagaaggggaagaacaaauuacuggauggcgagcgucucgccgacaggaagaucgcggagcuguucuccaccaagacgcauauaggguga

SEQ ID NO: 15216 - RNA, 5070 nt, Artificial Sequence
  derived and/or modified CDS sequence (opt11) from CCHFV(UCCR4459)__KY484032.1__GP
augagcuucuccaucauguacacgcccuuacucugcgccgugcugugccugcagcuauggucgcuggagggcucccacgggcugagcaacaagacucagcacuccaacaccagcacuaccaaggccccggaggucucacaggaguucggccuacccguaagcaccguguccacgaucaccagcgacccgcccuccaucaccagcgcggucuccgugagcggauccgagggcucgggggacaccaacacgucccccagcgugaccacccagggccuuacccuaccugagacgacgcucgagcugcugacgacgacggacaccgacgccuccucaacagucgugguggacgucagcacccagacuguuaaggauacccccaucuccaccacacacacgagccuccccuccacaccaucugccaccaccacgccacagggcacccaccacaccgcccgcgggcugcuguccgugacaagcacgaagcccgagggggccuccacccaggcgaaccccgagaaaaucagcauggagaccaacuccccgcggcucgccaucagcgaaacccccuccuucucucccacgacccaggcccccaccgaaaacuccaacccgauaacuagcaagcagcugaucuucuccgcccagcccgucaccccaaaccccgucacuccgcccgugcaaccggcgcucagccaguccgauaccuccaccgccauccaagacauccacccuuccccgacgagccgcagcaagcggaaccucgaaauggagaucauccugacccugucccaggggcucaagaaguacuacggcaagauccugaagcugcucgaccugacgcuggaggaggacacugaagggcuccuggaguggugcaagcgcaaccugggccucgucugcgaugacgacuucuuccagaagcggaucgaggaguucuuccugaccggcgaagggcacuuuaaugaggugcugcaguucaagacacccagcacucugucccccaccggccccgcacguacagggagcccgacgguggagcccuucaaguccuacuucgccaagggcuuccugaguauggacuccggcuacuucagcgccaagugcuacccccgggcguccaacuccgggcuacagcucaucaacgucacccagcacuccacucgcaucaccgacacgccgggccccaaggugaccaacuugaagaccauuaacugcaucaaccugaaagccagcguguucaaagagcacagggagaucgagaucaacguccuccuuccccagguggccgugaaccuuuccagcugccacgugcucaucaagucccacgugugcgacuacagccucgacaucgacgggcccguccgcuugccacggauccaccacgagggcaccuucauacccgggacguacaagcuggugaucgacaagaagaacaagcagaacgaccgcugcacacuuaucaccaauugcgugaucaaaggccgagagauccgcaaaggccagucaguuuugcggcaguacaggacagagaucaagauugggaaggccagcagcggcucccggcgcuuacugagcgaggaguccggggaugacuguaucagccggacgcagcugucccgcaccgagaccgccgagauccacagcgacaacuacggcgggcccggagauaagaucacaaucugcaacggauccaccaucguagaccagcggcuagggucugagcucggcugcuauaccaucaaccgcgugaaaucuuucaaguugugcgagaacucggcgaccgggaaauccugcgaaaucgacucaacccccaucaaaugcaggcagggcuucugucugaagaucacgcaggaggggcgggggcacgucaaacuaucccgcggcagcgaggugguguuagaugccugcgacuccagcugcgagaucaugauuccgaaggggaccggcgacauccuggucgacugcuccgggggccagcagcacuuccucaaagacaaucugauagaccugggcugccccaacaucccgcuccuggggaaaauggccaucuauaucugccggaugagcaaccaccccaaaaccaccauggccuuccuguuuugguucuccuucggcuacguuaucacgugcauccucuguaaggugauuuucuaucugcugaucgucguggggacccucggcaagaaguucaagcaguaccgcgagcugaagccgcagacuugcacaaucugcgagacaacgcccgugaacgcuaucgacgcggagaugcacgaucugaauugcagcuacaacaucugccccuacugcgccagccggcuuaccuccgaugggcuggcccgccauguaaugcagugcccaaagcgaaaggagaagguggaggagaccgagcuguaccucaaccuggagcgcaucccgugggugguccggaagcugcuccaggugagcgaguccacgggcguggcccugaaacgcagcuccuggcugguugugcuccuggugcugcuuacggucagccuguccccugugcaaagcgccccaaucggccacgggaagaccguggagaccuaucagacccgggaaggcuacacguccaucugccuguucguccucgggagcauccuuuucaucguguccugccugaugaagggccucguggacagcguaggaaacuccuucuuccccgggcugagcaucugcaagaccugcucaaucggcagcaucaauggguucgagaucgagucccacaagugcuacugcucgcuguucugcugcccguacugccggcauugcuccgcagaccgggagauccacaaacuccaccugagcaucugcaagaagcgcaagaccggcagcaacgugauguuagccgugugcaagcggaugugcuuccgcgccaccgucgagguguccaacaaggcccuccugauccggaacaucaucaacacgacguucguggucugcauccugauccuugcggucugcguggucagcaccuccgccguggagauggaaagccugcccgccgggaccugggagcgcgaggaggaccugacaaacuucugccaccaggagugccaagugaccgagaccgaaugccucugccccuacgaggcccugguccugcggaagccccucuucuccgacagcaucgugaagggcaugaagaaccugcugaacucaaccagccucgagacgucccugagcaucgaggcccccuggggcgcaaucaacgugcaaaguaccuucaaacccaccgucagcgccgccaacauagcgcugagcuggagcuccguggagcauagagguaauaagauccucgugagcggccgcuccgagagcaucaugaaacuggaggaacggaccgggauauccugggacuugggcguagaagaugccuccgagagcaagcucuuaaccguauccaucauggaccugagccagauguacucccccguguucgaguaccucagcggggacaggcaggucgaagaauggccgaaggcgaccugcaccggcgacugucccgagcggugcgggugcaccuccucaacuugccugcacaaggaauggccccauucccgcaacuggcggugcaaccccaccuggugcuggggcgugggcaccgggugcacgugcugcggccuggacgucaaggaccucuucaccgacuacauguucgucaaguggaagguggaguacaucaagacagaggccaucgucugcguggagcugaccagccaggagcgucagugcucccugauugaggccgggacccgguucaaccucggccccgugacaauuacacugagcgagccccgcaacauccagcagaagcugccgccggagaucgucacccuccacccccggauugaggagggcuucuucgaccuuaugcacgugaagaaagugcuguccgccagcacgguaugcaagcuccagaguuguacccacggggugcccggcgaccuccagguguaccacaucgggaaccugcucaagggcgacaaagucaacgggcaccugauccacaagaucgagccccacuucaauacgagcuggaugaguugggacggcugcgaccuggacuacuacugcaacaugggcgacuggcccagcugcucuuacaccggggugacccagcacaaucacgccgcguucgugaacaugcucaacaucgaaaccgacuacacgaaaaucuuucacuuccacagcaagcgcgucaccgcccacggcgacaccccgcagcuggaccugaaggcccggccaaccuacggagccggcgaaauuacggugcuuguggaagucgcugacauggagcugcacacgaagaagaucgagaucuccgggcugaaguucgccagccugacuugcaccggaugcuacgccugcagcuccggcaucagcugcaagguacgcauccacguggacgagcccgacgagcugacgguccacgugaaguccgaggaccccgacaucguggccgccaguuccagccugauggcacggaagcucgaguucgggaccgacagcaccuucaaggccuucucugccaugccuaagaccagccugugcuuuuacaucgucgagcgcgaguacugcaagucaugcucuaaggaggacacgcagaagugcgugaacaccaagcuggagcagccccagagcauccucaucgagcacaagggcaccaucaucgggaagcaaaacgacacaugcacguccaaggccggcugcuggcuggagagcgugaaguccuucuuuuacgggcugaaaaacaugcugagcggcaucuucggcaacgucuucaucgggaucuuccucuuccuggcccccuuuauccugcuaauccuguuuuucauguucggcuggcggauccuguucugcuucaagugcugccgccggacccgcggcuuauucaaguaccggcaccugaaggacgacgaggagaccggcuaccgcaagaucaucgagcggcugaacaauaagaagggcaagaacaagcuccuagacggggagcgcuuggcggaccgcaagaucgccgagcuguucaguaccaagacucacaucggcuga

SEQ ID NO: 15217 - RNA, 5070 nt, Artificial Sequence
  derived and/or modified CDS sequence (opt11) from CCHFV(K168_125)__KX013460.1__GP
augcccauaagcaccaugcacaucagccugaugugcgccgugcucugcuuacagcuguacggccucgggggcacccacggccugcacaacggcacggagcacaacaagaccaacgccgucaccacgucauccaacagccaguccagcgaguccccggcgcgcacggccccgcccgugacccccgacucgcccaccgucacucccacgaccccagccuccgccccggaggggagcggcgaggcccacuccagcccgcccaacaacaccgagggccccucccugccggaaagcaccuccgagccgcccgcggccacgagcaccgggauccccuccgcuagcgacgucaacaguagcacccaggccgcccgggacacgagcacgcccaccgugcgcaccuccccgcccaacagccccuccaccccgccaacgccccaggagacccaccaccccgugcggaaccuccugagcgucaccucccacaagcccgaggagaccagcgccccguccgagagcgguaaagagucccccgccgccaacagcccccaccccguggccuccaggccgcccacacccagcaccacggcgcaggggccgaccgagaacaacaacuacaacacgaccggccagcuggagucccucacccagagcaccacgcuggggcccaugaccucccugacccagaccgaccucccccagucggugacguccaucgccguccaggacacccaccccucuccgaccaaccgguccaagcgcaaccuggagauggagaucauacucacccucccccagggccugaagaaguauuacggcaaggugcuacggcuccugcagcugacccucgaggaggauacagaagggcugcuggaguggugcaagcgcaaccuaggccuggacugcgacgacaccuucuuccagaagcggaucgaagaguuuuucaucaccggggagggccacuucaacgaggugcugcaguuucgcacccccggcacccucagcaccaccgaaagcacccacgccgggcugcccacggccgaaccguucaaguccuacuucgccaagggcuuccugagcaucgacuccgguuacuucagcgcgaagugcuacucccggaccagcaauuccggccuccagcugauuaacgucacccgccacagcacccggaucgccgacacgcccgggcugaagaucaccaaccucaaaaccaucaguugcaucaaccugaaggcgucgguauucaaggagcaccgcgagguugagaucaacguccugcucccccaaguugccgugaaccuguccaacugccacgucaccaucaaaagccacgugugcgacuacucccuggacaucgacggcacggugcggcucccccacauccaccacgacggcaccuucauuccggguaccuacaagauagucauagaccgcaaaaauaagcugaacgaccgguguacccuguucacgaacugcgugaucaagggccgcgagguccggaaggggcagagcguccuccgccaguacaagacagagauccggaucggcaaggccuccaccgggagccgccgccugcuguccgaugagagcggggacgacugcaucagccggacccagcuccugcgcacggagaccgcggagauccacggggacaacuaugggggccccggggacaagaucaccaucugcaacggcuccaccauaguugaccagcggcugggcagcgagcucggcugcuacacgaucaaccgcgucaaguccuucaagcugugcgagaacagcgccaccggcaaguccugugagguggacagcauccccgugaagugccggcagggguacugucuaaagaucacccaggagggccgagggcaugucaagcuguccaggggcucggaagugguguuggacgccugcgacuccagcugcgagguaaugauccccaagggcaccggggacauccugguggacugcucuggcgggcagcagcacuuccugaaggacaaccucaucgaccugggcugcccaaagguuccccugcuggggaagauggccaucuacaucugccgcaugagcaaccaucccaaaacgaccauggccuuccuguucugguucagcuucggcuacgucaucacgugcaucguguguaaggcgaucuucuaccugcuuaucaucgugggcacccuggggaagcgguucaagcaguaccgcgagcugaaaccccagaccugcacaauaugcgaaacgaccccgacgaacgccaucgacgccgagaugcacgaccucaacuguagcuacaacaucugcccuuacugcgccucccggcugacgagcgauggacuggcgcgccacgucacucacugccccaagcggaaggagaaaguggaggagaccgaacucuaccugaaccuggagcgcauccccugggugguccggaagcuccuccaggugucggagagcaccgggguggcccugaagcgcuccagcuggcugaucguccuguuaguccucuucgccguaucauuaucaccagugcagagcgcccccaucggccacggcaagacgauagagaccuaucaggugcgggaggaguacaccuccaucugccuguucgugcucgggaguauccuguucaucgucucgugccucaugaagggccucgugaacagcguggggaacaucuucuuccccggccuguccauaugcaagaccuguagcaucggguccaucaacggcuucgagaucgagagccacaagugcuacugcagccugcucugcugcccguacugcagacacugcucggccgacagggagauccaccagcugcaccugucgaucugcaagaagcgcaagacggggagcaacgucaugcucgcggugugcaagcgcauguguuuccgggccaccguggaggucuccaacaaggcccugagcauccgcuccaucaucaacaccaccuucgugguuugcauccugauccucgcggucugcguggugagcacuucugccgucgagauggagagccugcccgcgggcaccugggagcgggaagaggaccuuaccaacuucugccaccaggagugccaggugaccgagacugagugucucuguccauacgaggcccugguacugcggaggccccucuuccuggacucaaucgucaagggcaagaagaacuuacucaacuccaccagccuggagacgucccugagcaucgaagccccguggggcgccaucaacgugcaauccaccuacaagcccacggugagcgccgcgaacaucgcccuauccuggagcuccgucgagcaccgcgggaacaagaucuuagugagcggucgcuccgagagcaucaugaagcuggaggagcgcaccggcaucuccugggaccucgggguggaggacgccagcgaguccaagcugcugaccgucagcgugauggaucucucccagauguauagccccguguucgaguaccuguccggcgaucggcaggucgaggaguggcccaaggcgaccuguacgggugacugcccggagcgcugcgggugcaccagcuccacuugccugcauaaggaauggccacacagccggaacuggcgcugcaaucccaccuggugcuggggcguugggaccggcugcacguguugcggccucgacgugaaggaccuguucaccgacuacauguucgucaaguggaagguggaguacaucaagaccgaagccauugucugcguagagcugacuagccaggagcggcaaugcucccucaucgaagccgggacccgcuucaacuugggccccgugaccaucacccugagcgagccgcggaacauccagcagaagcucccucccgagauaaucacgcugcacccccgcaucgaggagggguucuucgacuugaugcacgugcaaaaggugcucuccgccagcaccgugugcaagcugcaguccugcacccauggcgugcccggggaccuccagguguaccauaucggcaaccugcugaaaggcgacaaggugaacgggcaccugauccacaagaucgagccccacuucaacaccagcuggauguccugggauggaugcgaccucgacuacuacugcaacaugggggacuggcccagcugcaccuauacgggcgucacccagcauaaccacgccuccuucaucaaccugcugaauaucgagaccgacuauaccaagucauuccacuuccacuccaagcgggugacggcccacggggacacgccccagcucgaccugaaggcgcgcccgaacuacggcgccggcgagaucaccgugcuggucgagguggccgacauggaacugcacaccaagaagaucgagaucagcgggcugaaguucgccucccugaccugcaccggcuguuacgccugcucguccgggaucagcugcaaggugcggauccacguggacgagcccgacgagcucaccgugcacguaaaguccgacgaccccgacgucguggcggccagcagcucccugauggcccgcaagcuggaguucggcaccgacagcacauucaaggccuucuccgccaugcccaagaccagcuuaugcuucuacaucgucgagcgggaguauugcaaguccugcagcaaggaggacacccagaagugcgucaacaccaagcuggagcacccgcaguccauccuaaucgagcacaagggaacgaucaucgguaaacagaacaauacgugcaccgcgaagaccagcugcuggcucgaguccgucaagagcuucuucuauggccuaaagaacaugcucuccgggaucuucggcaacguguucguggggaucuuccuuuuccuggcuccguucauccugcugauucucuucuucauguucggcuggcgcauccuguucugcuucaagugcugccgccgaacucgcggccuguuccgguacaagcaccucgaggacgacgaggagaccgguuaccgacggaucaucgagcgccugaauaacaagaagggcaaaaacaagcugcucgacggggagcggcucgccgaucgccggaucgccgagcuguucagcaccaagacccacaucgguuga

SEQ ID NO: 15218 - RNA, 5070 nt, Artificial Sequence
  derived and/or modified CDS sequence (opt11) from CCHFV(K168_40)__KX013457.1__GP
augcccaucaguacuaugcacaucucccugaugugcgcagugcucugccuucagcuauacggccucggaggcacccauggccugcacaacggcaccgagcacaacaagaccaacgccgugaccaccagcuccaacagccagucguccgagucuccggcccgcacggccccgccagugaccccggacucgcccaccgugacaccaacuacgccugccagugcucccgaggggagcggcgaggcccacuccagcccgcccaacaacacagagggccccucccugcccgagagcaccuccgagccgccagcggccaccaguaccggcauccccuccgccagcgaugugaacucuagcacucaggccgcgcgggacacauccacaccuaccgugcgcacuagcccucccaacagcccguccaccccgcccacgccccaagagacccaccacccgguucggaaccuccugucagucacgucgcacaagccagaggagacguccgcaccaucugaguccggcaaagaguccccggccgcaaauucaccacaucccguggccuccaggccacccacgcccucgacaaccgcgcaagggccgacagaaaauaacaacuacaauacgaccggccaacuggagucccuaacccagagcaccacgcuugggccgaugaccaguuuaacccaaaccgaccucccacaguccgucacgaguauagccguccaggauacccaccccagcccaacaaacagauccaagcgcaaccuggagauggaaaucauccugacccucccacagggccuuaagaaguacuacggcaagguguugcggcucuuacaacugacccuugaggaagacacggaggggcugcuggaguggugcaagagaaaucucgggcuggacugcgacgacaccuucuuucaaaaacggauagaagaauuuuucaucaccggcgaaggccauuucaacgaggugcugcaguuccgcaccccaggcacccugagcacuaccgagagcacccacgcgggacugccgacugccgagccuuuuaaguccuacuuugcuaagggcuuccugagcauagacuccggguacuucucugccaagugcuacucccggaccagcaacuccggucuccagcugauaaaugugaccagacacagcaccagaaucgcagacacgcccgggcccaagaucacaaaucuuaaaaccaucuccugcaucaaucucaaggccagcguuuuuaaggagcaccgagagguggagaucaauguccugcucccccaggucgccgugaaccucucgaacugccacgucacgaucaagucacaugugugcgacuacucuuuggacaucgauggcacggugcggcugccgcacauccaccacgacggcaccuucaucccugggacguacaagaucguaaucgaccgcaagaacaagcucaacgacagguguacccuguucacgaauugcguuauaaagggucgggaggugcggaagggccagagcguccugcgccaguacaagaccgagauucggauaggcaaggccuccaccggaagcaggagacuccuuuccgacgagagcggcgacgauugcauuagccggacccagcugcuccgcaccgagaccgcggagauccacggcgacaacuacgggggcccgggggacaagaucacgaucugcaacggcuccaccauaguggaucaacggcuugggagcgagcucggaugcuacacgaucaaccgcguuaaaucauucaagcucugcgagaauagcgcuaccggcaagucgugcgaggucgacagcauccccgugaaaugccggcagggcuacugccugaaaauuacacaggagggacgcggccacgucaagcugucccguggcagcgagguggugcuggaugccugcgacuccagcugugaggucaugauccccaagggaaccggggacauccuuguggacugcuccggagggcagcaacacuuccucaaggacaaccugaucgaccuuggcugccccaagaucccccugcuagggaagauggcaauauauaucugccguaugaguaaucaccccaagacgacgauggcauuccucuuuugguuuaguuucggcuaugugauuacaugcauugucugcaaggcaaucuucuaccuucucaucaucgugggcacgcucgggaagcgguucaaacaguaccgcgaacugaagccgcaaaccugcaccaucugcgagacgaccccaacgaacgccaucgacgccgagaugcacgaccugaacugcucauacaacaucugcccauacugcgccucuagacucacgagcgauggacuggcgaggcacgugacgcauugccccaaacguaaagagaaggucgaggagaccgagcuuuaucucaaucuugagcgcaucccguggguaguucggaagcugcuccaagucuccgagucgacagggguggcgcugaagaggaguaguuggcucaucgugcuccugguccuguucgccgugagccucucccccgugcagagcgcacccaucggccacgggaagacgaucgagaccuaucagguccgggaggaguacaccucaauuugccuguucgugcugggaagcauccuuuuuaucgugucgugucugaugaagggcuuagucaacucaguugguaacauuuucuucccggggcucuccaucugcaaaacaugcagcaucggguccauaaacgguuucgagaucgagucgcacaaguguuacugcucccugcugugcugccccuacugucgccacugcagcgccgaccgggagauccaccaacuccaccucuccaucuguaagaagaggaaaacggggagcaaugugaugcuggcuguaugcaagcgaaugugcuuccgugcuaccguggagguguccaacaaggcgcuuaguauacgcuccauaaucaacaccaccuuugucgugugcauccuaauccuggccgugugugucgugagcacgucugccguggagauggaaagucucccagcgggcacaugggagagagaagaggaccugaccaauuuuugucaccaggagugccaggucaccgagacggaaugccugugccccuacgaggcacuugugcugcgucggccgcuauucuuggacgguaucguuaaggggaugaagaaccuacugaacucgaccucccucgagaccagccugucuaucgaggcccccuggggcgcgaucaacgugcagagcaccuacaaacccacgguguccgcggcgaacaucgcccuguccugguccagcguggagcaccgcgggaacaaaaucuuagucucgggacgguccgagagcaucaugaagcuagaggaaaggaccgggaucuccugggaccuugggguggaggacgccuccgagagcaagcuccugacaguguccgugauggaccuuagccagauguauuccccuguauucgaguaccucagcggcgaccgucagguggaggaguggcccaaggcgaccugcacgggggauugcccugagcggugcggaugcaccuccuccacgugccuacacaaggaauggccacacagucggaauuggcgcugcaacccgaccuggugcuggggcgucgggaccggguguacgugcugcgggcucgacgugaaggaccucuucaccgacuauauguuugugaaguggaagguagaguacauuaagaccgaggccaucgucugcgucgagcugacgagccaggagagacaguguagccugaucgaggccgguacccgauuuaaccucgggccggugaccaucacccuguccgagcccagaaacauacagcaaaagcucccgccggaaaucauaacgcuccauccaagaauugaggagggcuucuucgaucugaugcacgugcagaaaguucugagcgccuccacggucugcaaacuccagagcugcacucauggggugcccggcgaccuacaggucuaccacaucggcaaccuguugaagggcgacaaggugaacgggcaucugauccacaagauagagccccacuucaacaccuccuggaugagcugggacgggugcgaccuggacuacuacugcaauaugggcgacuggccauccugcaccuacacggggguaacccaacacaaccacgccucauuuauuaaucuccugaacauagaaaccgauuauaccaaaucguuucacuuccauagcaagcgcgucacggcccacggcgacaccccgcagcucgaccuaaaggcgcgccccaacuacggcgccggagagaucacuguucugguggaggucgcagacauggagcugcacaccaagaagauagagauuuccggccucaaauucgccagccucacgugcaccgggugcuacgccugcucaagugguaucucaugcaaggugcggauccacguagacgagcccgacgagcugaccguccaugucaaaucagacgacccugacgugguggcggccucauccagccucauggccaggaagcuggaguucgguaccgauuccaccuuuaaagccuucagcgccaugccaaaaacgagucugugcuucuauaucguggagcgggaguacuguaagagcugcuccaaggaggauacucagaaaugcgugaacaccaagcucgagcacccccagucaaucuugauugagcacaagggcaccauaaucggcaagcaaaacaacacguguaccgcgaaaaccuccugcugguuagaguccgugaaaucauucuucuacgguuugaagaacaugcugagcggcauuuuugggaacguauucguaggcaucuuccuguuucuggcccccuucauccuccuaauccuuuucuucauguucggcuggcgcauccuuuucuguuucaaguguugccgccgcacccgcgggcuauuccgguacaagcauuuggaagacgacgaagaaacaggcuauaggcggaucaucgaacgcuugaauaacaaaaaggggaaaaacaagcugcucgacggagagcggcucgcugaccgccggauagccgagcuguucucaaccaaaacccacauuggcuga

SEQ ID NO: 15219 - RNA, 5070 nt, Artificial Sequence; identical to SEQ ID NO: 11933
  derived and/or modified CDS sequence (opt11) from CCHFV(K128_76)__KX013454.1__GP

SEQ ID NO: 15220 - RNA, 5070 nt, Artificial Sequence
  derived and/or modified CDS sequence (opt11) from CCHFV(Hodzha)__KX013448.1__GP
augcccgugagcauuaugcacauccugcucaugugcgccguccugugccugcagcaguacggccucggggagacccaccgcccgaauaacggcaccgagcacaacaagacgaacgugcugaccacaccauccgacaagcugagccccgagccgccggugucaaccgcccucagcgucacgcccgacucgagcaccgugacccccacaacacccgucuccgggcuggagggcagcggggaggucuacaccuccccgcccgugacaacgaagggccugagccccuccaaggcgacgagcgagcuccccgccaccaccggcaucgacaccuccagcgccuccgacguggacagcuccacccaggccgcccgggacacuagcaccuuaaccguccggacguccccgcccagcagccccuccacgcccccgaccagccaggacaccuaccaccuggugcggaaccuccugagugucaccaguccccgccccgaggagaccaccgcgcccuccaagucggggaaggaguccccggucgccaacagcccccaccccgugaccucccggcccucuuccccgcccaucaccgugcagggccccaccgagaacagcucccacaacaccaccgggcagcuggagagcauggcccaguccacgacccucguccccauggccagcccgacucagaccguucucucacagagcgugacgucccuggcgguccaggacgcccaccccagccccaccaaccgcagcaaacggaaccucgagauggagaucauccuaacccugccccagggccucaagaaguacuacgggaaggugcuacgccuguuacaguuaacccuagaggaggacaccgagggccuccuggaauggugcaagcggaaccugggccucgacugcgacgacacauucuuccagaagcgcaucgaggaguucuucaucaccggcgagggccacuucaacgaggugcugcaauucaagacccccuccacccuguccacgaccgaguccacccacgccgucagccccaccgccgagcccuucaaauccuacuucgcaaagggguuccucagcaucgacuccggcuacuucagcgcgaagugcuacucgaagacgagcaacuccggccuacaguugaucaacgugacccggcacagcacccgcaucgccgacaccccggggcccaagaucacgaaccugaagaccaucuccugcaucaaccugaaggccucaguauucaaggagcaccgcgaggucgagaucaacgugcugcucccccaggucgccgugaaccuguccaacugccaugugaccaucaagagccacgucugcgacuacucccuggacgucgacgggaccgugcgccucccccacauccaccacgggggcacguucaucccggggacauacaagaucgugauugacaagaagaacaagcugaacgaccggugcacccuguacaccaacugcgugaucaagggccgcgaggugcggaagggccagagcauccuccgccaguacaagacggagauccggaucgggaaggccagcaccggcucgcgccggcuguuaucugaggaguccggggacgacugcaucagccgcacccagcucuugaggaccgagacggcggagauccacggcgacgacuacgggggccccggcgacaagaucaccaucugcaacggguccacaaucgucgaccagcggcugggcagcgagcuggguuguuacacgaucaaccgcgugaaguccuucaaacucugcgagaauagcgccacgggcaaguccugcgagaucgauagcacccccgugaagugccggcagggguacugccugaagaucacccaggagggccgcggccacgucaagcugucccgggggagcgagguggugcucgacgccugcgacagcagcugugaaguaaugauccccaagggcaccggggacauccugguggacugcuccggcggccagcaacacuuucugaaggacaaccucaucgaccuggggugcccgcgcaucccccugcucggcaagauggccaucuauaucugccggaugagcaaccaccccgagacgaccauggccuucuuauucugguucuccuucggguacgugaucacgugcauucugugcaaggcgaucuucuaucuccugaucaucgucggcacccuggggaagcgcuucaagcaguaccgggaacucaagccccagaccugcaccaucugcgagaccaccccggccaacgccaucgacgccgagaugcacgaccugaacugcagcuacaacaucugccccuauugcgcuucccgccugaccuccgacggccucgcgcggcacgugacgcagugccccaagcgcaaggagaagguagaggagaccgagcuguaccugaaccucgagcggauccccuggaucguccgcaagcuguugcaagugagcgaguccaccggcguggcccugaagcggagcuccuggcuuaucguccugcucgugcuguuugccgugagucuguccccgguccagagcgcccccauagggcacggcaagaccaucgagacguaccaggcgcgcgaggaguacacuagcaucugccucuucgugcuggggagcauccuguucaucguguccugccuuaugaagggccuggucgauagcaucgggaacauuuucuuccccggcuugacaaucugcaaaaccugcagcaucggcagcaucaacggguucgagaucgagucccacaagugcuacugcagccucuugugcugccccuauugccgucacugcccggccgacagagagauccaucagcugcaccucuccaucugcaagaagcggaagacgggcagcaacgugaugcuggccgucugcaagcgcaugugcuuccgagccaccauggaggucuccaacaaggccuuacucauccgcagcaucaucaacaccaccuucguggugugcauccugauccuggccgucugcgugguguccacgagcgcagucgagauggagagccuccccgccgggacuugggagcgcgaggaggaccugacuaacuucugccaccaggaaugccaggugaccgagacggaaugccugugccccuacgaggcccucgugcugagacgcccacuguuccucgacuccaucgucaagggcaagaagaaccugcugaacagcaccucccuagagaccagccuguccaucgaggcccccuggggcgcgaucaacgugcaaagcacauacaagcccaccguguccaccgccaacaucgcccugagcugguccucggucgagcaccgggggaacaagaucuuaguguccggcagaagcgaguccaucaugaagcuggaggagcggaccgggaucagcugggaccucggcguggaggacgcguccgagagcaagcuccugaccgucuccgugauggaccugucucagauguacucccccguguucgaguaccucagcggggaccgccaggucgaggaguggccuaaggcaacgugcaccggcgauugcagcgagcguugcgggugcaccuccagcacgugucugcauaaggaguggccccacucacgcaacuggcgaugcaaccccaccuggugcuggggcgugggaaccgggugcacgugcuguggccuggacgucaaggaccuauucaccgacuauauguucgugaaguggaagguggauuacauuaagaccgaggcgaucgucugcguggagcugaccagccaggagcgccagugcucccuaguggaggccgggacccgguucaaccucggccccguuaccaucacgcugagcgagccgcgcaacauccagcagaagcugccgcccgagaucaucacccuccacccccggaucgaggaggguuucuucgaccugaugcacgugcagaaggugcuguccgcaagcacagucugcaagcuccaguccugcacccacggggucccuggcgaccuccagguguaccacaucgggaaccugcugaagggugacaagguuaacggacaccugauccacaagaucgagccccacuucaacaccagcuggauguccugggauggcugcgaucuggacuacuacugcaacaugggcgacuggcccagcugcacauacacgggggugacacagcacaaccacgccuccuucgugaaccuccugaacaucgagaccgacuacaccaagagcuuccauuuccacuccaaacgcgucaccgcgcacggagacacgccccagcuggaccucaaagcccgcccgaccuacggggccggcgagaucaccguucuaguugaggucgccgacauggagcugcacacuaaaaagauagagaucacggggcuaaaguucgccagccugacuugcacgggcuguuacgcgugcucgagcggaaucuccugcaaggugcgcauccacguggacgagcccgacgagcugaccguccacgucaagagcgacgaccccgacgugguugccgccagcucuagccucauggcccggaagcuggaguucgggaccgacuccaccuucaaggccuucagcgcgaugcccaagacgucccugugcuucuacauaguggagcgcgaguacugcaagagcugcuccaaggaggacacccagaagugcgugaacacaaagcucgagcagccgcagagcauccugaucgagcaaaagggcaccaucauagggaagcagaacaacacguguaccgccaaggccuccugcuggcuggagucggucaaguccuucuucuacggccugaagaacauguuaagcgggaucuucggcaacguguucgugggcauuuuccuguuccuggcccccuucauccuccucauccuguucuuuauguucggguggcggauccucuucugcuucaagugcugccgccggacccggggccuguucaaguacaagcaccugaaggacgacgaggagaccggguaccggcggaucaucgagcgucuaaacaacaagaagggcaagaacaagcugcuggacggcgagcgguuggccgaccgccggaucgccgagcuuuucuccacgaaaacgcacauuggguga

SEQ ID NO: 15221 - RNA, 5070 nt, Artificial Sequence
  derived and/or modified CDS sequence (opt11) from CCHFV(Hy13)__AY900145.1__GP
augagcuucuccaucauguacacuccccugcucugugcagugcugugccugcagcucuggagccuggagggcucccacgggcugaguaacaagacccagcauuccaacaccagcaccaccaaggcgccggaggugucgcaagaguucggccuccccgugagcaccguguccacgaucaccagcgacccgcccuccaucaccagcgcggugagcgugagcggguccgagggcagcggcgacaccaacacgucccccagcgugaccacccagggccugacccugcccgagacgacccucgagcugcugacgaccacggauaccgacgccuccagcaccgucgugguggacgugagcacccagacggugaaggacacccccauuuccacgacccauacgagccuuccuuccaccccgagcgccaccaccacgccccaaggcacccaccacaccgcgcgggggcugcugagcgugaccagcacgaagcccgagggcgccuccacccaggccaacccugagaagaucagcauggagaccaacuccccgcggcucgccaucagcgagacccccucguucagcccaacgacccaggcccccaccgagaacuccaauccgaucacgagcaagcagcugaucuucuccgcccagcccgucacccccaaccccgucacgccgcccgugcaacccgcgcucucacaaagcgauacgagcaccgccauccaggacauccaccccuccccgaccagccgaagcaagcggaaccucgagauggagaucauccugacgcugucccagggguugaagaaguacuacggcaagauccugaagcugcucgaccugacacuggaggaggacacugagggguugcuagaguggugcaagcgcaaccugggccucgucugcgacgccgacuucuuccagaagaggaucgaggaguucuuccugaccggcgaggggcacuucaacgaagugcugcaguuuaagacucccagcacccucucccccaccggcccugcccgcaccgggagcccgacgguggagcccuucaaguccuacuuugccaaggguuuccugagcauggacuccggcuacuucagcgcgaagugcuacccccgggccuccaacagcgggcugcagcucaucaacgugacccagcacuccacccgcaucaccgacacgccgggccccaaggugaccaaucugaagaccaucaacugcaucaaccugaaggccucgguguucaaggaacaccgagagaucgagaucaacguucuccugccccaaguggccgugaaccugucaucgugccacguccucauaaagucccacgugugcgacuacucucuggacaucgacgggcccgucagguuaccgcggauccaccaugagggcaccuucauucccgggacguacaagcucgugaucgacaagaaaaacaagcagaacgacagaugcacacugaucaccaacugcgugaucaagggcagggagauccgcaagggccaguccguccugcggcaguaccguaccgagaucaagaucgggaaggccagcucgggcucccggcgccuccugagcgaggagucuggggacgacugcaucagccggacgcagcugucccgcacggaaacagcggagauccacagcgacaacuacggcgggcccggcgacaagaucaccaucugcaacggcuccacgaucguagaccagcggcuggggagcgagcucggcuguuacaccaucaaccgcgugaaguccuucaagcugugcgagaacagcgccaccgggaaguccugugagaucgacagcaccccgaucaagugccgccagggcuucugccugaagaucacgcaggaggggcggggccacgucaaguugucccgcggcagcgagguugugcuggaugccugcgacuccagcugugagaucaugaucccgaaggggaccggcgacauccuggucgacugcuccgggggucagcagcacuuccucaaggacaaccugaucgaccugggcugccccaacaucccucuccuuggaaagauggccaucuacaucugccggaugagcaaccaccccaaaaccaccauggccuuccuguucugguucuccuucggcuacgugauaacaugcauccucugcaaggugaucuucuaccuguugaucgucguggguacccugggcaagaaguucaagcaguaccgcgagcugaagccgcagaccugcaccaucugcgagaccacgcccgugaacgcgaucgacgccgagaugcacgaccugaacugcagcuacaacaucugccccuauugcgccagccggcucaccuccgacgggcuggcccgccacgucaugcagugccccaagcgcaaggagaagguagaggagaccgagcuguaccucaaccuggagcgcaucccgugggugguccggaagcugcuccaggugagcgagaguaccggcguggcccugaagcguagcuccuggcuggucgugcuccuggugcugcucaccgucagccugucccccguucagagcgcgcccaucggucaugggaagaccguggagacguaccagacccgggagggcuacacgagcaucugccuguucguccucgggagcauccuguucauuguguccugccugaugaagggcuuaguggacagcgucgggaacuccuucuuccccggcagcuccaucugcaaaaccugcaguaucggcuccaucaacggguuugagaucgagagccacaagugcuacugcucacuguucugcugcccguacugccgccacugcagcgccgacagagaaauccacaagcugcaccucucgaucugcaagaaacgcaaaaccggcuccaacgugaugcuggccgugugcaagcggaugugcuuucgcgccaccgucgaggugagcaacaaggcguuacucauccggaacaucaucaacacgaccuucguggucugcauccugauccuggccgugugcguggucucgaccagcgccguggagauggagucacuccccgccgggaccugggagcgcgaggaggaccugacgaacuucugccaccaggagugccaggccacggagacugagugccugugccccuacgaggcgcucguccugcggaagccccuguucagcgacuccaucgucaagggcaugaaaaaccuccugaacagcaccucccuggagaccagccucuccaucgaggccccguggggcgccaucaacgugcagagcaccuucaaacccaccguauccgccgccaacaucgcccugagcugguccucggucgagcaccgcgggaacaagauccugguguccgggcggagcgaguccaucaugaagcucgaggagcggaccgggaucagcugggaccuggggguggaggacgccagcgaguccaagcuacuaacggucagcauaauggaccugucccagauguacagcccuguguucgaguaccuguccggggaccgccagguggaggaguggccgaaggcgaccugcaccggcgacugccccgagcggugcgggugcacuagcuccacgugccuccauaaggaguggccccacagccgcaacuggcggugcaaccccaccuggugcuggggcgucggcaccgggugcacaugcugcggccuggacgugaaggaccuguucaccgaccacauguucgucaaguggaagguggaauacauaaaaaccgaggccaucgugugcgucgagcucaccucccaggagcgccagugcagccugaucgaggcggggacccgguucaaccucggccccgugacgaucacccucuccgagccccgcaacauccagcagaagcugccgcccgagaucgugacccugcacccccggaucgaggagggcuucuucgaccucaugcacgucaagaagguauugagcgccuccaccguuugcaagcugcagagcugcacccacggcgucccgggcgaccuccagguguaccauaucgggaaucugcugaagggcgacaaagugaacgggcaccucauccacaagaucgagccccacuucaacacguccuggaugucuugggacgguugcgaccuggacuacuacugcaacaugggcgacuggccguccugcagcuacaccggggucacccagcauaaccacgccgccuucgugaacaugcugaacaucgagacggacuacacgaagaucuuccauuuccauuccaagcgcgugaccgcccacggcgacaccccgcagcucgaccugaaagcgcggcccaccuacggcgccggcgagaucacgguccugguggagguggccgacauggagcuccacaccaagaagaucgagaucagcgggcugaaguucgccucccugaccugcaccggcugcuacgccugcuccucugggauaaguugcaaaguccguauccacguggacgagcccgacgaguugacgguacacguuaagagcgaggaccccgacaucguggcagccuccagcucccugauggcccggaagcuggaguucgggaccgacagcacguucaaggccuucuccgccaugccuaagacaagccucugcuucuacaucguggagcgcgaguacuguaaguccugcagcaaggaggacacgcagaagugcgucaacaccaagcuggagcagccccaguccauccugaucgagcacaaaggcaccaucaucgggaagcagaacgacacuugcaccagcaaggcgggcugcuggcuagaguccgucaagagcuuuuucuacgggcugaagaacaugcuguccggcaucuucgguaacguguucaucgggaucuuccuguuccucgccccuuucauccugcugauccucuucuucauguucggcuggcggauacuguucugcuucaagugcugccgccgcacccgcggucuguucaaguaccggcaccucaaagacgacgaagagaccggcuaccgcaagaucaucgagcggcuuaacaacaagaagggcaaaaacaaacuucucgacggggaacgccuggccgacagaaagaucgccgaguuguucuccaccaagacgcacaucggcuag

SEQ ID NO: 15222 - RNA, 5070 nt, Artificial Sequence
  derived and/or modified CDS sequence (opt11) from CCHFV(SPU415/85)__DQ211635.1__GP
augcccgugaacaucauguacaccccgcuggucugcgccgugaucugucuccaacuauggaaccugggcgggacccucguguucaucaaccguacucagcacaacgagaccggcacggucgccaccccagaggggacgcuucggccacgccugccagugagcacugcgcuuccgaccaaguccgaccggcccucgguggguccagccgccuccagcaguggguuagagggcucaggcgaacccaacaccucgccgagcaucacgacuaaggggcugaccccacccgagacgacgcccgcccucccgacagccaccgacaccgacgcguccucuacgggcgugguggacguguccacccaaaugacuaaagacauacccaugaguacggccuacacgaacccgccuuccacgcccagcgcaccaaguacuccccaggggacacaccacacagcgcgcgggcuacugagcgucgccucaaccaagagcgaggagguguccaugagcaccucccccgccaaaaccuccacggagaccucuuccccuccacccgccaccagcgaaacccccacgccgagccccacgacccaggugcccacugggaacaacaaccccaauacgagucggcagccgacgccuagugcucaacccgccaugucgaacccggcgaccucccccgcacagcccaaucucucacaguccgcuccacccaccgccgaccaggggguccaucccagccccaccaaccgauccaagcggaaccucgaaaucgagauuauacugacgcucagccaaggcuugcgcaaauauuacgggaagauccucaaacuccuggaccuaacacucgaggaggauaccgagggacuauuagaguggugcaagcggaaccucggccugaccugcgaugacaauuucuuccagaagcgcaucgaggaguuuuuccugacaggcgagggguacuucaacgagguauugcaguucaaggugcccuccacccugagcucuacagagcccacacacacgcggcccccuaccguugaaccuuuuaagucauacuucgccaaaggguuccucuccaugaacuccggcuacuucagcgcgaaguguuauccacgaaccucaaauuccgggcuccagcugaucaacguaaccaaacacuccgccaaaaucgcugacacucccggccccaagaucacuaaccugaagaccauaaacuguaucaacuugagggccagcguguucaaagaacaccgcgaggucgagaucaacgugcuccugccccaggucgcuguuaaccucuccaauugccacgcgcagaucaagucucacguaugcgacuacucguuagccacugacgggauggugcgucugccccauauccaucaugagggcacguucauccccgguaccuacaagaucgucauagauaagaaaaacaagcagaaugaccguugcacuuuggugaccaauugcgucaucaagggccgagaggugcgcaaaggucagucagcccuaagacaguauaagacggaaauccgcauugggaaggccuccagugggucccggcgccugcuguccgaagaguccgacggggacugcauuagccgcacgcagcugcuacguaccgagacuacggagauccacagcgacaacuacgguggccccggugacaagaucaccaucuguaauggcagcacaaucguggaccaacgccucggguccgagcugggcugcuacaccauuaaucgcgucaagaguuucaaguuaugcgagaacagcgccacggggaaaagcugcgaaaucgacagcacccccguaaagugccgccagggcuucugucugaaaaucacccaggaagggcgggggcacgugaagcugucacgcggcagcgagaucguccucgacgcgugcgacuccaacugcgagaucaugaucccgaagggaaccggggacauccuuguggacugcagcggcgggcaacagcauuuccugaaggacaaccucaucgaccuggggugccccaauaucccucuccuggguaagauggcaauuuacaucugcagaauguccaaccaccccaagacaaccauggccuuccuguuuugguucagcuuuggcuacgugaucacuugcauccucugcaaggucaucuucuaccugcugaucgucgccggcaccguggggaagaaguucaaacaguaccgagagcuccggccucagacgugcaccauuugcgagaccauccccgucaacgcgaucgacgccgagaugcacgaucucaacugcucauacaacaucugcccuuacugcgccagccggcugaccuccgacggacucgcccggcacgugaugcagugcccaaagcgcaaagagaagguggaggaaacggaguuauaccucaaccucgagcggauacccugggucgugcgcaaacugcuccaggugagcgaauccacgggggucgccuugaaacggagcuccugguuaacaguucuacucguccuuuugaucguaagccucucccccguacagagcgcgcccauugggcacgggaagaccauagagaccuaccaagcucgagagggcuacacguccuucugccuauucauccucggaagcauacucuuugucguaagcugccuggugaagggccugaucgacuccgugggcaauagcuucuucccgggccucuccaucugcaagaccugcucaaucggcaguaucaauggguucgagaucgagucucauaaaugcuacugcucucuauuuugcugucccuacugccggcacugcagcgccgaucgcgagauccauaagcugcaccucuccauaugcaaaaagagaaagaccggcuccaaugucaugcuggccguuugcaagaggaugugcuuccgcgccaccauugaggugagcaaccgggcgcuccuaauccgcaacaucaucaacacgaccuucguagugugcauccugacucuggcagugugcgucguaagcacuucggccguggagauggaaagccuccccgccgggacgugggagaaggaggaggaucugaccaacuucugucaccaggagugccaggucacggaaaccgaaugccuaugccccuacgaggcacucgugcuucggaaaccgcuguuccucgacuccaucgugaagggcaugaagaaucugcugaauagcacguccuuagagaccagucugucgaucgaggcgcccuggggcgccauaaacgugcagaguacuuucaagcccacugugucagccgcaaacauugcacuguccuggagcuccguggagcaccgcgggaacaaaauauuggucagcggacggucggagaguaucaugaaguuggaggagcgcacuggaaucuccugggaccugggcguggaggacgcaagcgaguccaaacuccugacggugagcgucauggaccugagccagauguacagccccguuuucgaguaccucuccggagaccgucagguggaggaauggccgaaggcuaccugcacgggcgacugccccgagcgcugcggcugcacgagcucaaccugccuacacaaggaauggccgcacucccggaacuggcgauguaacccaaccuggugcuggggcguugggaccgggugcacaugcugcggccuagauguuaaggaucucuucaccgacuacauguucguaaaguggaaagucgaguacaucaagacggaggccaucgugugcgucgaacucacaucucaggagcggcaaugcagccuuaucgaggccggcacgcgcuucaaucuugggccugugaccaucacacuguccgaaccccggaacauccaacagaaacugccacccgagauuauaacccuccacccccgcaucgaggaaggcuucuucgaucugaugcacgugcagcguguccugagcgcaagcacggugugcaaguugcagucguguacccacggagugccuggcgaucugcaggucuaccacaucggcaaucugcucaaaggcgacaaggugaacgggcaccuaauacacaagaucgaaccacauuucaacacgagcuggauguccugggacgggugcgaucuggacuacuauugcaacaugggagauuggcccucuugcaccuacaccggggugacgcagcauaaccaugcugccuucgucaaccuauuaaauaucgagaccgacuacaccaagaauuuccacuuucacuccaagcgcgugacagcgcacggagauacgccccagcucgaccucaaggcccgacccaccuauggagccggcgaggugacgguccuagucgagguggcagacauggagcuacacaccaagaagauagaaauaagcggccucaaauuugccucccugacaugcaccggaugcuacgcuugcagcuccggcaucucuugcaagguaaaaauacacguggacgagcccgacgagcugaccguccacguaaaauccgaggaccccgacauaguggccgcgggcagcucccuuauggcccgcaaauuggaguucggcgccgacucaacuuucaaggccuucagcgcgaugccgaagacaagucugugcuucuacaucguggagcgggaauauuguaagucuuguagccgugaggacaccagaaagugcgucaacaccaaacucgaccguccccaguccauccugaucgagcauaagggcaccaucaucggcaagcagaacaauaccugcaccgccaaggcaucuugcuggcuggagagcgugaaguccuucuuuuacggcuuaaagaacauguugagcgggaucuucggaaacguguucaucgggaucuuccuguucaucgcacccuucgugcuccucauccuguucuucauguucggcuggcgcauacuguucugcuucaagugcugcaggcggacccggggccucuucaaauaccgccaccugaaggacgacgaagaaacgggguaccggaagaucaucgagcgccugaacaacaagaagggcaagaacaaguuacuggacggcgagcgucuggcggaccguaaaauagcggagcuguucucgacgaagagucacauaggcuaa

SEQ ID NO: 15223 - RNA, 5070 nt, Artificial Sequence
  derived and/or modified CDS sequence (opt11) from CCHFV(SPU97/85)__DQ211633.1__GP
augaccgugaacaccgucugcacgccccucgucugcgccguguucugccuccagcuauggaaccugggcgggacccucgucccaaccaaccgcacccagcacaauaaaaccggcaccauggccacccccgaggggacccugggcccccggcugcccgugagcacggcacugccgaccaagucugaccgccccagcgugggcccugccgcccccuccucaggccuggagggcucaggggagccgaacaccagccccuccauaaccacgaagggacuugcccucccggagacuacccccgcaccgcccaccgcgacggauacggacgcuagcuccaccggagucgugaacgugagcacccagaugacuaaggacauccccauguccaccgccuacaccaauccgcccagcacccccuccgcccccagcacgccccagggcacccaucacacugcgagagggcuccuguccguugcgagcaccaaguccgaggaggugagcaugucgacgagcccgggcaaaacaagcacggagaccuccagcccacccccagccaccuccgagacccccgccccgucccccaccacccaggcccccacggguaacaacaacccaaacacaucucgccaacccacccccagcgcucaaccagccauguccaaccccaccaccagucccgcgcagcccaaucuccugcaaaacgccccgcccacggccgaccagggggugcaccccggucccaccaaccgguccaagcgcaaccuggagauggaaaucauccucacccugagccagggccugcggaaguacuacggaaagauccucaaguucuuggaccugaccuuggaggaggacacggaaggucugcuggaguggugcaaacgcaaccucgggcuaacgugcgacgauaacuuuuuccagaagcggaucgaggaguucuuccugaccggcgagggguauuucaacgagguccuccaguuuaaggucccgucaacccugagcucaacggagcccacgcacaccggcagcccaaccguggagccguucaaguccuacuuugcaaagggguuccugagcaugaacuccggcuauuuuagcgcgaagugcuacccgagaacguccaacagcggccuccagcugaucaauguuacuaagcacagcgccaagauagccgacacacccgggccuaagaucaccaaccugaagacgaucaacugcaucaaccuccgagcuuccguguucaaggagcauagggagguggagaucaacgugcuguugccccagguggccgugaaccucucaaacugccacgcccagaucaagucccacgucugcgacuacagccuggccaccgacggcauggugcggcugccgcgcauucaccaugaggggaccuucauccccggcacuuacaagaucguuaucgacaagaaaaacaaacagaacgaucguugcacgcucgucaccaacugugugaucaaaggucgagagguccggaagggccagucggcacugcgccaguacaagaccgagauccggaucggcaaagccagcuccgggagccgccggcugcucuccgaggaaagcgacggcgacugcaucucccgcacccagcuguugcgcacugagaccgcggaaauccacagcgacaacuacgggggcccaggggacaagaucaccaucuguaacggguccaccaucguggaccagcggcucggcagcgagcuggggugcuacacgauuaaccgcgugaaguccuucaaacuuugcgagaacagcgccaccgguaaauccugcgagaucgacucuacccccgucaagugccggcagggguuuugccucaagaucacucaggagggacgcggccacgugaagcugagccgggggagcgaaauugugcuagacgcaugcgacagcuccugugagaucaugauccccaagggaacaggggacauccuaguagacugcagcggcggccaacagcacuuccucaaggacaaccuaaucgaccugggcugccccaacauccccuugcugggccgcauggccaucuacauaugccggauguccaaccaccccaagaccaccauggcguuucuguucugguucagcuucgguuacgugaucacgugcaucuuauguaaagugauauuuuaccugcugaucgucgccgggaccgucgggaagaaguucaaacaguaccgcgagcuccggccacagaccugcaccaucugcgagaccacccccguuaacgccauugacgccgagaugcacgaccugaacugcuccuacaacaucugucccuauugcgccucucgccugacguccgacgggcucgcgcggcacgucaugcagugcccgaagcgcaaggagaagaucgaggagacugagcuguaccugaaucuugaacggauccccugggucguccgcaagcugcugcaggucuccgaguccaccgguguggcccugaaacggagcucuuggcugaccgugcugcucguccugcugauugugagccucucccccgugcaguccgcccccaucggacacggcaagacgaucgagacauaccaggcccgcgagggguauaccucguucugccuguucauccuagguagcauccucuucaucgucuccugccuggugaaagggcugauugacuccgugggcaacagcuuuuucccgggccucuccauuugcaagaccugcaguaucggcucuguuaacggcuucgagaucgagucacacaagugcuacuguucacuguucuguugcccauacugccggcacugcuccgccgaucgcgagauacauaaacugcacuuaucuaucugcaagaagcggaagacagggagcaacgugaugcuagcgguaugcaagcgcaugugcuuccgcgcgaccaucgaggucuccaaccgggcccugcucauccgcucuaucaucaacaccaccuucgccgugugcauccugacgcuagcagugugcguaguguccaccagcgcaguggagauggagucccuccccgccggcaccugggagcgggaggaggaccugaccaacuuuugccaccaagagugccaagucacggagaccgagugucugugcccguacgaggcccucgugcuucgcaagccgcuguuccucgacagcaucgugaaggggaagaagaaccugcugaacuccaccagccucgaaacaagucugagcaucgaggcccccuggggcgcgauaaacguccagucaacuuucaagcccaccgucucugccgccaacaucgcccugagcuggucuuccguggagcaccgcgggaacaagauccucguguccggccgcagcgaguccaucaugaagcuggaggagcgaacaggaauaucaugggaccugggggucgaggacgcuuccgagagcaagcuccugacaguauccgugauggaccugagccagauguacucccccguguucgaguaccucagcggggaccgccagguggaggaguggccgaaagcgacgugcaccggcgauugcccagagcgaugcggcugcaccaguucgacgugccugcauaaggaguggccccacucccgaaacuggcggugcaaccccaccuggugcuggggcgucgggaccggcuguacgugcugcgggcuggacgugaaagaccucuuuaccgacuacauguuugugaaguggaaggucgaguacaucaagaccgaggccaucgugugcguggaacucaccagccaggagcgccagugcucccugaucgaggcuggcacccgguucaaccucggaccggugaccauaacucugagcgagccccgaaacauacagcagaaguugccgcccgagaucauuacgcuccacccccggauugaggaaggcuuuuucgaccugaugcacgugcagaaggucuuauccgcuagcacagucugcaagcuccagagcuguacccacggcgugcccggugaucugcaaguguaucacauaggcaaccugcucaagggugacaagguaaacggacaccugauccauaagauugagccccacuucaacaccaguuggaugaguugggacgggugcgaccuggacuacuacugcaacaugggcgacuggccgucgugcacguacaccggcgucacccagcacaaccacgccgcguucgucaaucuccugaacauugagacugacuauacgaagaacuuccacuuccacucuaagagggugaccgcgcacggggacaccccacagcuggaccucaaggcccgucccaccuacggagccggggaggugacgguccugguugagguggcugauauggagcuucacaccaagaagaucgagauuuccggccucaaguucgcuagccuguccugcaccgggugcuacgccugcucaucggggaucagcugcaagguccgcauucacguggaugagcccgacgaauuaacggugcacguaaagucagaggaccccgacaucguggccgccggcagcagucucauggcccggaagcuggaguucggggccgacuccacguucaaggccuucuccgcuaugccgaagaccagcuuaugcuuuuacaucguugaacgcgaguacugcaagucuugcucccgggaggacacccagaagugcgucaacaccaaguuggagcgaccccagucaauccugaucgagcacaaggguacgaucaucggaaagcagaacgacacgugcaccgccaaggcgagcugcugguuggagagugugaagucauucuucuauggccucaagucaaugcuguccggcaucuucgggaauguguucauaggcauuuuucuguucaucgccccauucguucuccuaauccuguucuuuauguucggguggcgaauccuauucuguuucaagugcugccggcgcacccgggggcuauucaaguaccgccaccugaaggaugacgaagagaccggguaccggaaaaucauagagcgccugaacaacaaaaagggcaagaacaagcucuuggacggcgaacguuuggcugaccgcaagaucgccgagcuguucagcaccaagucccacauuggguaa

SEQ ID NO: 15224 - RNA, 5070 nt, Artificial Sequence
  derived and/or modified CDS sequence (opt11) from CCHFV(C-68031)__DQ211629.1__GP
augagcuucucuaucauguacacgccccugcucugugccgugcugugucuucagcuuuggagccuggagggcucccacgggcugagcaacaaaacccagcauuccaacaccagcaccaccaaggccccggaggucagucaggaguucggacuccccgugagcaccguauccacgauaaccagcgacccgcccuccauaaccagcgcggucuccgugaguggauccgaaggcagcggggacaccaacacgucccccagcgugaccacccagggccugacccugcccgagacgacacuugagcugcugaccaccacggacaccgacgccuccuccaccguagugguggacgugagcacccagacggugaaggacacccccaucuccaccacccacacgagccuccccuccaccccgagcgccccaaccacgccccagggcacccaccacaccgcccgcgggcuacuguccgugacgagcaccaagcccgagggcgccuccacgcaggcgaacccggagaagaucagcauggagaccaacagcccccggcucgccauaagcgagacccccucguucagccccaccacgcaggccccgaccgagaacuccaaccccaucaccagcaagcagcugauccugucggcucagccggucacccccaacccggugaccccucccgugcagcccgcccucucacaguccgacacgagcaccgccauccaggacauccaucccucccccacuagccgaagcaagcggaaccuggagauggagaucauccugacccucucccaggggcugaagaaguacuacggcaagauccugaagcugcuggaccugacgcucgaggaggacaccgagggacugcuggaguggugcaagcgcaaccucggccuggucugcgacgacgauuucuuccagaagcggaucgaggaguucuuccuuaccggugagggucacuucaacgaggugcuccaguucaagaccccaucuacgcugucucccaccggaccggcacgcaccgggagucccaccguggagcccuuuaaguccuauuucgccaagggcuuccugucgauggacuccggcuacuucagcgccaagugcuacccgcgggcguccaacagcgggcuccagcugaucaacgucacgcagcacuccacacguaucacugacacccccggcccaaaggugacgaaccugaagaccaucaacugcaucaaucucaaggccagcguguucaaggagcaccgggagaucgagaucaacguccugcuaccccaaguagccgugaaucucuccucaugccacguccugaucaagucccacgucugcgacuacagccuggacauagauggcccgguccgccucccucggauucaccacgaaggcacguucauacccgggaccuacaagcuggugaucgacaagaagaacaagcagaaugaucgcugcacgcugaucaccaacugugugaucaagggccgggagauccgcaagggccaguccguccuacggcaguacaggaccgagaucaaaaucggcaaggccagcagcggcucccggcgccuauuaagcgaggaguccggggacgacuguaucagccggacccagcugucccgcacggaaaccgccgagauccacagcgacaacuacggcgggcccggcgacaagaucaccaucugcaacggcuccaccaucguggaccagcggcucgggagcgagcugggcugcuacacgaucaaccgcgugaaguccuucaagcugugcgagaacagugcgaccgggaagucaugcgagaucgacagcaccccgaucaaaugccgccagggcuucugccucaagaucacccaggaggggcggggccacgucaagcugagucguggcagcgaaguggugcuggaugccugcgacuccagcugcgagaucaugauccccaaggggacaggcgacaucuuagucgacugcuccggcggccagcagcacuuccugaaagacaacuugaucgaccucggcugccccaacaucccucugcuggggaagauggccauauacaucugccggaugucaaaucacccgaagaccaccauggccuuccucuucugguucuccuucggcuaugugaucacgugcaucuugugcaaggugaucuucuaccugcucaucgucguggggacccugggcaagaaguucaagcaguaccgcgagcugaagccccaaaccugcaccaucugcgagacuacccccgugaacgccaucgacgcggaaaugcacgaccucaacugcagcuacaacaucugucccuacugcgccagccggcugacguccgacgggcuggcccgccacgucaugcagugcccgaagcggaaggagaagguggaggagaccgagcucuaccugaaucuggagcgcauacccuggguuguccggaagcuccuccaagugagcgaguccacgggcguggcccugaagcgcagcuccuggcucgucgugcugcuugugcuccugaccgucagccugaguccagugcagagcgcgcccaucggccacgggaagacgguugagaccuaccagacccgggagggcuacaccuccauaugccucuucguccuggggagcauccuguucaucgucuccugccucaugaagggccugguagacagcgucgggaacuccuucuucccgggccugagcaucugcaagacgugcuccaucggcagcaucaacggguucgagaccgagucccacaagugcuacugcagccucuucugcugccccuacugccgccacugcuccgcggaccgggagauccacaagcugcaccugucuaucugcaagaagcgcaagaccggcagcaacgugaugcucgccgugugcaagagaaugugcuuccgcgccaccguggagguguccaacaaggcccugcugauccggaacaucaucaacacuaccuucguggugugcaucuugauccuggcgguaugcguggucagcaccucggccguggagauggagucccugcccgccgggaccugggaacgcgaggaggaccucacgaacuuuugccaccaggagugccaggugaccgagacugagugccugugccccuacgaggcccugguccuccggaagccgcuguucuccgacagcaucgugaaggggaugaagaaccugcuuaauuccaccagccuggagacgagucugagcaucgaggcacccuggggcgcgauaaacgugcaaaguaccuucaagcccaccgucucagccgccaacaucgcccucuccuggagcuccguggagcaccgcgggaacaaaauccugguaagcggccgcuccgagagcaucaugaagcuggaggagcggaccgggaucuccugggaucucggcgucgaggacgcuagcgagagcaaguuacugacgguguccauaauggaccucagccagauguauuccccgguguucgaguaccugucaggggaccgccaggucgaggaguggcccaaggcgaccuguaccggcgacugccccgagcggugugggugcaccuccaguacgugccugcacaaggaguggccccacucccgcaauuggcggugcaacccgaccuggugcuggggcgugggcaccgggugcacgugcugcggccuugacgucaaggacuuguucaccgauuacauguucgugaaguggaagguggaguacaucaagaccgaggccaucgucugcguggagcugacaagccaggagcgccagugcucccucaucgaggccgggacccguuucaaucuuggccccgugacgaucacccugagcgagccccgcaacauccagcagaagcugcccccggagaucgucaccuuacacccccguauugaggagggcuucuucgacuuaaugcacgugaagaaggugcucuccgccucuaccgucugcaagcugcagucaugcacccacggggugccuggcgaccuccagguguaccacaucgggaaccugcugaagggcgacaaggucaacgggcaccugauucacaaaaucgagccccacuucaacacgagcuggaugucuugggacggcugcgaccucgacuacuacugcaacaugggcgacuggccgagcugcuccuacaccggggugacccagcacaaccacgccgcguucgugaacaugcugaacauugagaccgacuacacgaagaucuuucacuuucacagcaagcgcgucacugcccacggcgacacgccccagcuggaccucaaggcccggccgaccuacggggccggcgagaucaccguacugguggagguugcugacauggaacugcauaccaagaagaucgagauauccggucucaaguucgccagccugaccugcaccggcugcuacgccugcagcuccggcaucagcugcaaggugcgcauccauguagacgagcccgacgagcugacuguccacgugaagucggaggacccggacaucguggccgccucauccucccuaauggcucgaaagcuggaguucgggaccgacuccaccuucaaggccuucagcgcaaugcccaagaccucccugugcuucuacauagucgagcgcgaguacugcaagagcugcuccaaggaggacacgcagaagugcgugaacaccaagcucgagcaaccccagagcauccugaucgagcacaagggcaccauuaucgggaagcagaacgacacgugcaccuccaaggccggcugcuggcuggagucagugaaguccuucuucuacgggcugaagaacaugcucagcggaaucuucggcaacgucuucaucgggaucuuccuguuccuggcccccuuuauacuccugauccucuucuucauguucggcuggcggauccucuucugcuucaagugcugccgccggacccgugggcuguucaaguacagacacuugaaggacgacgaagagaccggcuaccgcaagaucaucgaaagguuaaacaacaagaaggguaagaacaaacugcuggacggggagcgccucgccgaccgcaaaaucgccgagcuguucuccaccaagacacauaucggcuga

SEQ ID NO: 15225 - RNA, 5070 nt, Artificial Sequence
  derived and/or modified CDS sequence (opt11) from CCHFV(Baghdad 12)__AJ538197.2__GP
augcccgucucaauaaugcacaucagccucaucuacgccguccucugucuucaacucuauggacugggcgaaacucacggcagcagcagcgguaccgaacacaaccgcacaaacguuguagccacuccaggcggcagucaaucaccggagccacucgucagcacaaccuugccggucacccuagacucuucaacaguaaccccagccacccaggccucagguccugaagguagcggagagguauacaccucuccgcccaccacuaccgaaggucucucccccuccgaugccacauccgaacuacccacgacaacuggcauaggaauaucaaguucaagcgacgucaauucaucgacacaagcagccggugauaccucgacucccacagcccgcacuucgcuaccagacucaccgucaacaccacccacgucccaagauacgcaucaccccaugcgaaaccugcuuucagugaccucgcucaaaccagaagaaacacccgcccccucgaaaagcggcaaagaauccccugcugcaaguucgccucauccagucgcaucacgcccacccacucccagcacuacagcccaaggccccaccgagaauaacucacgcaacacaacuguccaacuaaaauccguuacccaaucagcuaccuugggaccaauggcuucccccacgcagaccguccuauuacagucagucacaagcaucgcgauccaggauacgcauccgagccccacuaauagaucccgccggaaccuggaaauggaaaucauucucacccucccccaggggcuaaagaaauacuacggcaaaguucuccgauuacuccagcucacacuugaagaagacacagagggccuacuagaaugguguaagcgcaaccuuggacuagacugcgacgacacauucuuccaaaaacgaaucgaagaauuuuucauaaccggagagggucacuucaacgagguccuacaguucaggacccccggaacacuuagcaccacagaaucaacccacgccggcagucccacagucgaacccuuuaaaucauacuuugcaaaaggauuucuacucauugauagcgguuauuucagcgcuaagugcuacagccgcaccuccaacucaggucuacaacuaaucaacgucacucggcacucaaccaaaaucgccgacacccccgggcccaaaauaacaaaccuaaagacgauaucuugcauaaaucugaaggcauccaucuucaaagaacauagagagaucgaaaucaacguccuguugccacaagucgcuguaaacuugagcaacugccacguaacgaucaagagccacgucugcgauuacucccuaaacauagacggcaccgucaaauuaccacacauacaccacgaaggaauauucauuccuggcacuuauaaaaucguaauagacaagaaaaauaaauuaaacgaccgcuguacccuauuuacuaacugcgucaucaaaggacgggaaguacgaaaaggucaguccguauuaagacaauacaaaaccgagauaagaaucgguaaagccucgaccgguucacgccgacuacuaagcgaagaaucgggagacgauugcaucucccggacucgacuacuccgcaccgaaacggccgaaauacacggcgacucuuacggaggaccaggcgauaaaauaacaauaugcaacggcucaacaauaguagaccaacgauuggguucagagaugggaugcuacacgaucaaccgggugaaauccuucaaacugugcgagaacucagcaaccggaaaaucuugcaaaaucgacagcauacccguuaaaugccgccaggguuacugucuuaagauuacacaagagggccggggccacguuaaguugagccgcggguccgaaguaguacucgacgccugcgauucauccugugagguaaugauaccaaaagggacuggggacauacucguagacugcagcggugggcaacaacacuuccugaaagacaaccuaauugaccucggguguccgaacaucccgcugcuggggaaaauggcaauauauaucugcagaauguccaaccaccccaaaacuaccauggccuuccucuucugguucagcuucggguacguaauuaccugcauucuuugcaaagcuauauuuuaccuccuaaucauagucggaacacuaggcaagcgcuucaaacaguacagagaauuaaagccccaaacauguacuaucugcgaaacgacgccggucaacgccaucgacgcugaaaugcacgaucucaacugcucguacaacaucugcccauacugcgccuccagacugacgagcgacggccucgcgcgccacguaacccaaugccccaagcgaaaagagaaagucgaggaaacugaacucuaccucaaccucgagcgcaucccgugggucguccgcaaacuccugcaagugucagagucgaccggagucgcacuaaaaagaagcucuuggcuaaucguacuucugguacuacuagccguaucauccagcccaguacaaagugcucccauagguuacggcaaaaccauagaaaccuaccaagcuagggaaggguacacaucaaucugccuauucguccucggcucaauccuuuuuaucguaaguugccuaaccaagggucuagucgacagcauaggcaacaucuucuucccggggcuaucuauuugcaaaaccugcuccaucggcucaauaaacgguuucgagguugagucacacaaaugcuacugcagucuccuaugcugcccauauugccgccacugcuccgcggaccgggaaauacaccagcuacaccuauccauaugcaaaaagagaaaaacagguucaagcgucauguuagcugucugcaaaaggaugugcuuuagggccacgauggaaguaucaaacaaagcacuacugauacgauccauaaucaacacuacauuuguaguaugcauacuuacccucgccguaugcgucguauccacaagcgcaguggaaauggaaucacuccccgcuggcacgugggaaagagaagaagaccucaccaacuuuugccaucaagaaugccaaguuaccgaaacagaaugccucuguccauacgaagcacucgugcugcgcaaaccacucuuccucgacucgaucgucaaaggcaccaaaaaccugcucaacagcacaucccucgaaacgucccucuccauagaagcuccguggggcgccaucaacguacaaucgaccuacaaaccaacagucagcacggcgaacaucgcucuaucguggucaagcgucgaacacagggggaacaagaucuugguuucggggcgcucggaaagcauuaugaaacuagaagaacgcacgggcaucuccugggaccugggggucgaggacgccucggagucaaagcuccucaccgucagcguaauggaccuaucacagauguacuccccaguguucgaguaccugaguggugaucggcaagucgaagaguggcccaaagccacgugcacaggugacuguccugagcgauguggaugcacaaccuccacaugccuacacaaagaauggccgcauucacgcaacuggcgcugcaauccaacaugguguuggggaguaggcacagggugcaccuguugcggccucgauguaaaagaccuauucacugacuacauguuugucaaauggaaaguagaauauauaaaaacggacgcuauaguuugcgucgaacuaacgagccaagaacgccaaugcagcuuaauagaagccgguacccgcuucaacuuaggcucggucaccauaacacuauccgaaccuagaaacauacaacaaaagcucccacccgaaauaauaacccugcacccacgaaucgaagagggcuucuucgaccucaugcacguccaaaaaguauuaagcgcauccacaguauguaaacuacaaaguuguacacauggagugccaggugaccuacaggucuaccacaucggaaaccuucucaagggcgacaagguaaacggccaccuaauacacaagauagagccacacuuuaacacuagcuggaugucgugggacggaugcgaucuugauuacuauugcaauaugggcgacuggcccucgugcaccuacacgggcgucacccaacacaaucaugcaucauucguaaaucuccucaacaucgagaccgauuacacgaaaucauuccacuuccacagcaaacgcgucacagcccacggggacacgccccagcuagaccucaagguccgacccaccuacggagcgggcgaaaucacuguucuaguagaaguagccgacauggaacugcacacgaagaaaauagagauauccgggcucaaauuugccagccuuaccugcaccgggugcuacgccugcaguagcgggaucuccugcaaggugagaauacacgucgacgaaccagacgaacuaacaguacauguuaaaucggaugaccccgacgucguugcagcaagcagcucucuaauggcucgaaaacuagaauuuggcaccgacuccacauucaaagccuucagugcuaugcccaaaacaucacuaugcuucuacauugucgagcgagaauacugcaaauccugcucuaaggaagauacacaaaagugcgucaacacaaaacuugagcaaccccaaaguauccuaaucgaacacaaagggacgaucaucggcaaacaaaauaacacaugcacggccaaaacauccugcuggcucgaaaguguuaaguccuucuucuacggccucaaaaauaugcuuucggguauauucggcaacuucuucaugggaaucuuccuuuuccuggcccccuuuauccuccuaauccucuucuucauguucggcuggagaauacucuucugcuuuaaguguugccggagaacccgcggccucuucaaguaccgccaccucaaagacgacgaagaaacaggguacagacggaucauagagagacugaacaacaagaaaggcaaaaacaaacuccuagacggcgaacgacuggccgaccgacgcauagcggaacucuucucaacgaaaacacacaucggcuaa

SEQ ID NO: 15226 - RNA, 5070 nt, Artificial Sequence
  derived and/or modified CDS sequence (opt11) from CCHFV(Hodzha)__AY223476.1__GP
augcccguguccaucaugcacauccugcucaugugcgcaguccugugccugcagcaguacggccucggggagacccaccgcccgaacaacggcaccgagcacaacaagacgaacgugcugaccacccccggggacaagcugucccccgagcuccccgugagcacggcccuguccgucacgccggacagcuccaccgugacccccaccacgcccgugagcggccuggagggguccggcgacgucuauaccuccccgcccgugaccaccaagggccucucccccagcaaggcgacguccgagcugcccgccagcuccgggaucgacaccagcuccgccagcgacguggacuccagcacccaggccgcccgggacaccuccacgcugaccguccgcaccagcccgcccagcucccccagcaccccgcccacgucccaggacaccuaucaccucgugcggaaccuguugagcgugaccucccccuggcccgaggagaccacggcgcccagcaaguccggcaaggagagccccguagccaacucgccgcaucccgugaccagccgccccuccagcccgcccaucaccguacaggggcccacagagaacucgagccacaacacgaccggucagcucgaguccauggcccagagcaccacccuggucccaauggccucccccacgcagaccgugcugagccaguccgugaccucucucgccguccaggacgcccacccgagcccuaccaaccgguccaagcgcaaucuggagaugguaaucauccugacgcucccccagggacugaagaaguacuacggcaagguacugcggcuccugcagcugacccucgaggaggacaccgagggccugcuggaguggugcaaacgcaaccucgggcuggacugcgacgacaccuucuuccagaagcggaucgaggaguucuucaucaccggcgagggucacuucaacgagguccugcaguucaagacgccgagcacccucuccaccacagagagcacgcacgccgugucccccacugccgagcccuucaagagcuacuuugccaagggcuuccuguccaucgacagcggcuacuuuuccgcgaagugcuacagcaagaccucaaacagcgggcugcagcucaucaacgugacccgacacaguacgcggaucgccgacacccccggcccgaaaaucaccaaccugaagacuaucucgugcaucaaccugaaggccuccgucuucaaggagcaccgcgagguggagaucaacguccuccugccccagguggccgugaaucucagcaacugccacguaacgaucaagucccacgugugcgacuacagccucgacguggacgggaccguccggcugccccacauccaccacggcgggaccuucauccccggcaccuacaagaucgugaucgacaagaagaacaagcucaacgacaggugcacgcucuacaccaacugcgugaucaagggcagggagguccgcaaggggcagagcauccugcgccaguacaagaccgaaauccgcaucggcaaggccuccacugggagccggcgccugcucuccgaggagagcggcgacgacugcaucucccggacgcagcugcugcgcaccgagaccgcggagauccacggggacgacuacggcggcccgggggacaagaucaccaucugcaacggcagcacgaucgucgaccagcgccugggguccgagcucgguugcuacaccaucaaccgggucaagagcuucaagcugugcaagaacuccgccaccggcaagagcugcgagaucgacuccacucccgugaagugcaggcagggguacugccugaaaaucacgcaggagggccgggggcacgugaagcucagucgcggcuccgagguaguccuggacgccugcgacagcuccugcgaggugaugauccccaaagggaccggcgacauccugguggacugcagcggcgggcagcagcacuuccucaaggacaaccugaucgaccugggcugcccccggaucccgcuccuggggaagauggccaucuacauaugccgaauguccaaccaccccaagaccaccauggccuuccuguucugguuuagcuucggcuacgucaucacgugcauccucugcaaggcaauauucuaccugcugaucaucguggggacccucggcaagcgguucaagcaguaccgcgagcugaagccccagaccugcaccaucugcgaaacgacccccgccaacgccaucgacgccgagaugcacgaccugaacugcaguuacaacaucugcccguacugcgcaagccggcucaccagcgacggccuggcgcgccacgugacccagugccccaagcggaaggagaaggucgaggagaccgagcuguaccuaaaccuugagcgcauccccuggaucgugcggaagcugcuccagguguccgagagcacgggggucgcccugaagcgcuccagcuggcugaucgugcuucuggugcuguucgccgucuccuugagccccgugcaguccgccccgaucggccacgggaagaccaucgaaaccuaccaggcgagagaggacuacaccagcauuugccuguucgugcugggcuccauccucuucaucgucagcugccugaugaaggggcugguggacuccaucggcaacaucuucuuccccggccucacgaucugcaagaccugcagcaucggguccaucaacggcuucgaaaucgagagccacaagugcuacugcucccuacugugcugccccuacugccgccacugcagcgccgaccgggagauccaccaguuacaccuguccaucugcaagaagcgcaagaccggaagcaaugugaugcuggccgucugcaagcggaugugcuuccgcgccaccauggagguguccaacaaggcccuccugauccgcagcaucaucaacacgaccuucguggucugcauccugauccucgcggugugcguggucagcaccuccgccguggagauggagagucugcccgccggcaccugggagcgggaggaggaccuuacgaacuucugccaccaggagugccaggugaccgaaaccgagugccucugcccguacgaggcccugguccugcgccggccccucuuccuggacuccaucgugaaggggaccaagaaccugcucaacagcacgucccuggagaccagccugucaauagaggcccccuggggcgcgaucaacgugcagagcaccuacaagccgaccgucuccacggccaacaucgcccucagcuggucgagcguggagcaccgcggcaacaagauccugguguccgggcggagcgaguccaucaugaagcuggaggagcgcaccggcaucagcugggaccucggggucgaggacgccuccgagagcaagcugcugaccguguccgugauggaccucagccagauguacagccccgucuucgaguaccuguccggcgaccgccagguggaggaguggcccaaggcgaccugcacgggggacugccccgagcggugcggcugcaccagcagcacgugccugcacaaggaguggccgcacucccggaacuggcgcugcaaccccaccuggugcuggggcgucgggaccggcuguaccugcugcgggcucgacgucaaggaccuguucaccgacuacauguucgugaaguggaaggucgacuacaucaagaccgaggccaucgugugcgucgagcugaccucccaggagcggcagugcagccucgucgaggccggcacccgcuucaaccugggccccgugaccauuacccuguccgagccccggaacauccaacaaaagcucccgcccgagaucaucacgcugcacccccgcaucgaggagggguucuucgaccugaugcacgugcagaagguccucagcgccuccacuguuugcaagcugcagagcugcacccacggggugcccggggaccugcaggucuaccacaucggcaaccuccugaagggggacaaggugaacggccaccugauccacaagaucgagccgcauuucaacaccuccuggaugagcugggacggcugcgaccucgacuacuacugcaacaugggggacuggcccuccugcaccuacacgggcgugacccagcacaaccacgccagcuucgucaaccugcugaacaucgagaccgacuauaccaaguccuuccacuuccacagcaagcgggugacagcgcauggagacacgccccagcucgaccugaaggcccgccccaccuacggggccggggagaucaccgugcuggucgagguggccgacauggagcuccacaccaagaagaucgagaucaccggccuuaaguucgccucccugacuugcaccggcugcuacgcgugcagcuccgggaucagcugcaaggugcggauccacgucgacgagccggacgagcucacggugcacgucaagucagacgaccccgacgugguggccgcuuccagcucccugauggcccgcaagcuggaguuuggcaccgacagcaccuucaaggccuucuccgcgaugcccaagaccagccucugcuucuacaucguggagcgggaguacugcaaguccugcucuaaggaggacacgcagaagugcgucaacaccaagcuggagcagccccaguccauccugaucgagcgcaaggggaccaucaucgguaagcagaacaacacgugcaccgccaaggccagcugcuggcuggaguccgucaagagcuucuucuacggguugaagaacaugcuguccggcaucuucggcaacguguucguggggaucuucuuauuccucgccccguucauccugcugauccucuucuucauguucggcuggcggaucuuguucugcuucaagugcugccgccgcaccagagggcuguucaaguacaagcaccucaaggacgacgaggagaccggcuaccgccggaucaucgagcgccugaacaauaagaagggcaagaacaagcugcucgacggggagcggcuggccgaccgccggaucgcggagcuguucucaaccaagacgcacauuggcuga

SEQ ID NO: 15227 - RNA, 5067 nt, Artificial Sequence
  derived and/or modified CDS sequence (opt11) from CCHFV(Kosovo/9553/2001)__AY675511.1__GP
augcccaucaacaucaugcacacccugcucgugugcuucauccuguaccugcagcuccugggccuagggggagcccacgggcaaagcaacgccaccgagcacaacggcacgaacaccaccaccgcgccggggacgucccaaagccccaagccgcccgccuccaccacccccagccaugcccccgaguccucuaccauuaagcucacgacccccaccuccgagacugagggcagcggggagacgacgcccccgaccuccaccacgcaggggagcccgccccuggaaaccacccccgagcgcuccacuacgaccgccaccagcaccuccggaacggacaacaugaacagcacgacccagaugaccgacaacacccccacccugacggccuccaccagccccuccagcucccccagcacgcccagcaccagccaggggcuccacuacccgguccggagccugcucucugugucuucccccaagaccgugaccacgccgacccccaugagcccgggcgagauguccagcgagaccucaagccagcacuccgcgaugagccgcacccccacgccccacaccgccacccaggucuccaccgagaacgccaaccggagcaccucccgccagucugaguccagcgcccagcccgcgacgcaguccccgguuaccagccccgcccagagcauccuccugauguccgccacccccaccacaauccagaacauccaccccaguccuaccaaccgguccaagcgcaaccuggagauggagaucauccugacccugagccaggggcugaagaaguacuacggcaagauccugaagcugcugcaccucacccuggaggaggacacggagggccuccuugaguggugcaagagaaaccugggguccaacugcgacgacgacuucuuccagaagcgcaucgaggaguuuuucauuaccggcgagggguacuucaacgaggugcugcaguucaaaacccucagcacccccucccccacagagccgucgcacgcccgacugcccaccgccgagcccuucaaguccuacuucgcgaagggcuuccugagcaucgacuccggcuacuucagcgccaagugcuacccccguuccucaacguccgguuuacagcugaucaacgucacccagcacccggcccggaucgccgagacgcccggccccaagauuacgagccugaagaccauaaacugcaucaaccuccgcgcauccguguucaaggagcaccgcgagguggagaucaacguccugcugccucagaucgcggugaaucucagcaauugccacguggucaucaacucucacgugugcgacuacucccuggacaccgacgggccggugcgccugccccggaucuaccacgagggcacguucaugcccgggaccuauaagaucgucaucgaccgcaagaacaagcucaacgaccgcugcacccucgugaccaacugcgugaucaagggccgcgagguccggaaggggcagagcgugcugaggcaguacaagacggagaucaaaaucgguaaggcccccacaggcucccggaaacuccugagcgaggagccuggcgacgacugcaucuccagaacucagcugcuccgcaccgagacggccgagauccacgacgacaacuacggcgggcccggcgacaagaucacgaucugcaacggcagcaccaucgucgaccagcgacuggguuccgagcuggguugcuacaccaucaaccgcgucaagagcuucaagcucugcgagaacuccgccacggguaagaccugcgagaucgacagcaccccagugaagugccggcagggcuucugccugaagaucacccaggaggggcgcggccacgugaagcugucccggggcucagagguugugcuggacgccugcgacaguagcugcgaggucaugauccccaaggggaccggcgacauccucguggacugcuccgggggccagcagcacuucuuaaaagacaaccugaucgaccucggcugcccgcacaucccccugcuggggaagauggcuaucuacaucgcccgcaugagcaaccacccuaagacgaccauggccuuccucuucugguucuccuuaggcuaugucauuaccugcauccuuuguaaggcccucuuuuacagccuuaucaucaucgggacucuuggcaagaagaucaagcaguaccgggagcucaagccccagacgugcaccaucugcgagaccgccccggucaacgcgaucgacgccgaaaugcacgaccugaacugcuccuacaacaucugcccuuacugcgccagccgccuuaccagcgacgggcucgcccggcacguaaagcagugccccaagagaaaggaaaagguggaggagacggagcuguaccucaaccucgagagaauccccugggucgugcgcaagcugcugcagguaucagagagcaccggcgucgcgcucaagcgguccagcuggcugaucgugcugcuuguauuacugacugucucccucagcccagugcaguccgccccggugggccacgggaagaccaucgagacguaccagacccgcgagggcuucaccagcauaugccuguucaugcugggguccauccucuucaucguuagcugccuggugaagggccugguggacuccgucagcgacuccuucuuucccgggcucagcgugugcaagaccugcucgaucggcuccauaaacggcuucgagaucgagucccacaagugcuacugcagccuguucuguugcccguacugccggcacugcuccgcugaccgcgagauccaccagcugcaccucagcaucugcaagaagcggaagacggggagcaacgugaugcuggcugucugcaagcgcaugugcuuccgggccaccaucgaggcgucccgccgcgcccugcucauccggagcaucaucaacaccaccuucgugaucugcauccugacgcugaccaucugcguggcuuccaccagcgccgucgagauggagacccuccccgcagcgacgugggagcgcgaggaggaccugaccaacuucugccaccaggagugccaggugcccgagaccgagugccugugccccuacgaggcccucgugcugcggaagccgcuguuccucgacuccaucgucaagggcaugaagaaccugcucaacagcaccucccucgagacgagccuguccaucgaggcccccuggggcgccaucaaugugcaaagcacauucaagcccaccguguccaccgccaacaucgcgcugagcugguccagcgucgagcaccgcgggaacaagauccucgugacggggcgguccgagagcaucaugaagcuggaggagcgcaccggcguguccugggaucugggagucgaggacgccagcgaguccaaacuccugaccgugagcaucauggaccugagccagauguacuccccaguauucgaguaccucagcggggaccggcagguugaggaguggccuaaggcgaccugcacgggcgacugccccgagcgcugugggugcaccucguccaccugucugcacaaggaguggccccacagccggaacuggcgcugcaaccccaccuggugcuggggcguagggaccggcugcacgugcugcggcguggacguaaaggaccuguucaccgaccacauguucgugaaguggaagguggaauacaucaagaccgaggccauugucugcguggagcucaccagccaggagcggcagugcucauugaucgaggccgguacgcgcuucaaccucggcccugugaccaucacccucagcgagccccggaacauccagcagaaacuuccacccgagaucaucacccugcacccgaagaucgaggagggcuucuucgaccuuaugcacguacagaaggugcuguccgccagcacggugugcaagcugcaauccugcacccacggcauccccggggaccuccaggucuaccacaucgggaaccugcugaagggcgacagagugaacggccaccucauccacaagaucgaaccccacuucaacaccagcuggaugucgugggacggcugcgaucuggacuacuacugcaacaugggggacuggcccagcugcaccuacacgggcgugacccagcacaaccaugcagcuuucgucaaccugcucaacaucgagaccgacuacaccaagacguuccacuuucauuccaagcgcgugaccgcgcacggcgacacaccgcagcuggaccugaaggcgcgccccaccuacggggcaggcgagaucacgguccucguggagguggccgacauggagcugcacaccaagaaggucgagaucagcgggcugaaguucgccucccucgccugcaccggcugcuacgcgugcagcuccgguaucagcuguaaggugcggauccacguggacgagcccgacgagcugaccguccacgucaagagcuccgaccccgacgugguggccgccagcacuucccugauggcccgcaagcucgaguucgggaccgacagcaccuucaaggccuucuccgcgaugccuaagaccagccuaugcuucuacaucguggagaaagaguacugcaaguccugcagcgaggacgacacgaagaagugcguggacaccaagcuggagcagccccaguccauccucaucgagcaccguggcacgaucaucgggaagcccaacgacaccuguccugcuaagacgagcugcuggcuggaguccgucaagagcuucuucuacggucuuaagaauaugcucggguccguguucggcaacuucuucaucgggauccuguuguuccuggcaccguucuucuuauggauguugagcuucauguucggcuggaagauccuguucugcuucaaauguugccgccggacccgcggccuguucaaguaccgccaccugaaggacgacgaggagaccggguaccggagaaucaucgagcggcugaacaacaagaaggguaagaaccgucuccuggacggggagcggcuggcagaccgcaagaucgcggaacucuucuccaccaagacgcacaucgguuga

SEQ ID NO: 15228 - RNA, 5067 nt, Artificial Sequence
  derived and/or modified CDS sequence (opt11) from CCHFV(200406546-Turkey)__KR864902.1__GP
augcccaccaacaucacccacacccuacuggugugcuucauccuguaccugcagcuucugggucgcgggggcgcacacgggcagagcaaugccaccgagcacaacggcacgaacaccaccaccgcgcccgggaccagccagucgcauaagccccuggugagcaccaccccgccccacacgcucgagucaagcaccaucaaacacaccacccccaccagcgagacugagggcagcggcgagaccaccccgccgccuaauaccacccaggggcccuccccgcccgaggcuacccccgagcggcccgccaccaccgcaaccuccacccccucgacggacaacacgaacuccaccacccagaugaacgauaacaaucccacgagcaccauauccacgagccccuccagcucccccagcacgccgcccacgccgcagggcauccaccaccccgcacgcucccugcuuagcgugagcucucucaagaccgcgacgacccccacgcccaccagucccggggagauuuccagcgagacauccagccagcacuccgcgaugagccggaccccgacccugcacacaaccacccaggugucuacugagagcacgaaccacucaacaccccgccagucagaguccagcgcccagcccacuacccccucucccaugacgagcccugcccagucgauccugcccaugagcgcggccccgaccgccauccagaauauccacccaucccccaccaaccggucgaagcgcaaccucgagguugagaucauccucacccugagccagggcuuaaagaaguacuaugggaagauucugaaacugcuacaccugacccuggaggaggacaccgagggccuacuggaguggugcaagcggaaccugggcuccagcugcgacgacgacuucuuucagaagcgcauugaggaguucuucguaacaggagagggcuacuuuaaugagguucuccaauucaaaacucuguccacgcuuagccccaccgaaccgucccacgccaagcuccccaccgucgagccauucaagagcuacuucgccaagggauuccuguccaucgacaguggcuacuucuccgcgaaauguuauccccggagcuccaccagcggccugcagcucaucaacgugacgcaacauccggcccgcaucgccgagacccccgggcccaagacaaccucccugaagacgaucaacugcaucaaccugcgggccagcguguuuaaggagcaucgcgagauugagaucaacguccuacugccucagaucgccgugaaccuguccaacugccacgcggugaucaagucgcacgucugcgacuauucacucgacaccgacggcccagugcggcugccccacaucuaucacgaggggaccuucaucccuggcaccuacaagaucgugauagacaagaagaacaaacugaacgaccgcugcauccuugucacgaacugcgugaucaaagggcgggaggugcgcaagggccagucuguacugcggcaguacaaaacagagaucaagauaggcaaggccagcaccgggucccgcaagcugcucagcgaggagccuggcgacgacugcaucucccggacccaguugcugcgcacagagaccgccgagauccacgacgacaacuaugggggcccgggagacaagauuaccaucugcaacggcagcacgaucguggaucagcggcucggcuccgagcuggggugcuacacgaucaaccgcgucaagagcuucaagcugugcgagaacuccgcuaccgggaagacaugcgagaucgacagcacccccgucaagugccgccaggguuucugccucaaaaucacccaggaaggccggggacacguaaagcuguccaggggcagcgaagugguccuggacgugugcgacaguagcugcgaggucaugaucccaaaggggacgggugacauccugguggacugcucaggcgggcaacagcacuuucucaaggauaaccugaucgacuuggggugcccccacgugccgcuccugggccggauggccaucuacauaugccgcaugucgaaccacccccggaccaccauggcguuccuuuucugguucuccuucgguuacgucaucacguguaucuucugcaaggcccuuuucuacagccugaucaucaucggcacgcucgggaagaaauucaagcaauaccgcgagcucaaaccccagaccugcaccauaugcgagacugccccagugaacgcaaucgacgccgagaugcacgaccugaacugcuccuacaacaucugcccguauugcgcgagccggcugacguccgacggccucgcacgccacgugccccagugccccaagcggaaggagaaggucgaggagaccgagcuguaccugaaccucgaacgcauaccguggaucgugcggaagcugcuccaagugagcgaaucgaccggggucgcacuuaagcgcaguagcuggcugaucgugcugcucguacuccugaccgucucccucagucccgugcaauccgcucccgugggccacggcaagaccaucgagaccuaccagacccgggagggguucacgagcaucugccuguucaugcugggcuccauucucuucauugucagcugccuggugaaggggcugguggacucagucucugacuccuuuuuccccggccucagcguuugcaagacauguucgauagggagcaucaacggcuucgagaucgagucccacaagugcuacuguucucuguucugcugcccguacugccgccacugcuccgcagaccgugagauccaccagcugcaccucagcaucugcaagaaacgcaaaacggggucaaacguaaugcuggcagucugcaaacggaugugcuuccgcgccaccaucgaagcuagccggcgcgcccugcucauccggagcauaauaaacaccacguucgugaucugcauccugacccugaccaucuguguggucuccaccagcgcgguggagauggagaaccucccagcagggacgugggagcgggaggaagaccugaccaacuucugccaccaggagugccaggugacggagaccgagugccugugcccauacgaggcgcucgugcugcgcaagccccuguuccucgacuccaucgugaagggcaugaagaaccugcugaacagcaccucccucgaaaccagccuguccaucgaggccccguggggcgccaucaaugugcagaguacuuucaagcccaccgucuccacggcgaauaucgcucugagcugguccaguaucgagcaccggggcaacaagauccucgugaccgggagguccgagagcaucaugaagcuggaggagcggaccggcguguccugggaccuuggcguggaggacgcuagcgaauccaagcuccugaccgugagcaucauggaccugucccaaauguauagccccguguucgaguaccucagcggggaccgccaagucgaggaguggcccaaggccacgugcaccggcgacugcccggaacggugcggguguaccuccuccacgugccugcacaaggaguggccccacucccgcaauuggcggugcaaccccaccugguguuggggaguggggaccggcugcacgugcugcggcguggacgucaaggaccuguucacugaccacauguucgugaaguggaagguggaguacaucaagaccgaggccaucgugugcguggaacucacgagccaggagcgccagugcucucugaucgaggcggggacccgguucaaccugggucccgugacuaucacccucagcgagccgcgcaacauccagcagaagcugccgcccgagaucaucacgcugcaccccaaggucgaggagggguucuucgaccucaugcacgugcagaaggugcugucugccagcaccgucugcaagcugcagucuugcacccacgggaucccgggcgaccuccagguguaccauaucgggaaccuccugaagggggaccgggugaacgggcaccucauccacaagauagagccccauuucaacaccagcuggauguccugggacggcugugaucuagacuacuacugcaacaugggagacuggccaucgugcacguacaccggcgucacccagcacaaucacgccgcguucgugaaccuacucaacaucgagacagacuacacgaagacuuuccauuuccacuccaagcgugucaccgcgcacggcgacacgccccagcuggaccugaaggcccggccgacuuacggggccggcgaaaucaccgugcucguagaggucgcagacauggagcugcacaccaagaagguggagaucagcgggcugaaguucgccagucucgcgugcaccggcuguuacgccugcagcuccgggaucagcugcaaggugcgcauccacgucgacgagccagacgaguugacgguacacgugaaguccagcgaucccgacgucguggccgccucaaccucccugacagcccggaagcucgaguucgguaccgacucaacguucaaggcguucuccgccaugcccaagaccagccugugcuucuacaucguggagaaggaguacugcaaguccugcaacgaagacgacacacaaaagugcguggacaccaagcuggagcagccgcagagcauccuuauugaacacaagggcacgaucaucggaaagcagaacgacacgugcacugccaaggccuccugcugguuggaaagcgugaaguccuucuucuacggcuugaagaacaugcucgggagcguguucggcaacuucuuuaucgggauucuguuauuucucgcccccuucgugcugcuuguucuauucuucauguucggcuggaagauccucuucugcuucaagugcugcaggcggacccgcggccuguuuaaguaccggcaccugaaggacgaugaggagacgggguacaagcgcauaaucgagcgccucaacaacaagaagggcaagaaccggcugcuggacggggagcgccucgcggaccggaaaaucgccgaacucuucaguaccaaaacccacauaggcuaa

SEQ ID NO: 15229 - RNA, 5067 nt, Artificial Sequence
  derived and/or modified CDS sequence (opt11) from CCHFV(Haskovo-V46/13)__KR092379.1__GP
augcccaccaacaucaugcacacccugcucgugugcuucauccucuaccuccagcuccugggccucgggggcgcccacgggcagagcaacacgaccgagcacaacggcaccaacaacaccacggccccggggaccucccagagccccaagccccacauguccaccacgcccccgcacgcgcccgagagcuccaccaucaagccgaccacccccaccagcgagacggagggcuccggcgagaccaccccgcccagcaacaccacgcagggccccuccccgcccgagaccaccagcgagcgccccgccaccacggccaucucaaccagcuccaccgacaacaugaaccccaccagccagaugaccgacaacacccccaccuccaccgucagcaucuccccgagcuccagccccagcacgcccuccacgccgcagggcaugcaccacccggcccggagccugcuguccgugagcucccccaaaaccgccaccacccccacccccaccagcccgguggaggucggguccgagaccagcucccagcacagcgcgauguccagcacgcccacuccccacaccgccacccagguguccaccgagaacaccaaccacagcacgccccgccaguccgagccgagcgcccagcaaaccacccccucccccaugccgagccccgcgcagucgacccugcucaugagcgcggcacccaccgccgugcagaauacccaccccagcccgaccaaccgguccaagcgcaaccuggagauggagaucauccugacgcucagccagggccugaagaaguacuacgggaagauucugaagcuccugcaucugacccucgaggaggauaccgagggccugcuggagugguguaagcggaaccucggcuccaacugcgacgacgacuucuuccagaagcgcaucgaggaguucuucaugaccggggagggcuacuucaacgagguccugcaguucaagacccugaguacccucucccccauggagcccagccacgccgagcugcccaccgccgaaccuuucaaguccuacuucgcgaagggguuucugagcaucgacuccggcuacuucagcgccaaaugcuacccccgguccagcaccuccggccuccagcugaucaacgugacgcagcaccccgcccgcaucgccgagacccccgggccgaagaccaccagccugaaggccaucaacugcaucaaccuccgggcguccguguucaaggagcaccgcgagaucgagaucaacguccugcugccccagaucgccgugaaccucagcaacugucacgugguaaucaacucccacgugugcgacuacagccuggacacggacggccccgugcggcugccccacaucuaccacgaggggaccuucaucccgggcaccuacaagaucgucaucgacaagaagaacaagcucaacgaccgcugcacccuggugacgaacugcguuaucaaggggcgggagguccgcaagggccagagcgugcugcggcaguacaagaccgagaucaagaucggcaaggccuccaccggcagccgcaagcuccuguccgaggaguuaggcgaugacugcaucagccggacucagcuccugcgcacggagaccgccgagauccaugacgacaacuacgggggccccggggauaagaucaccauaugcaacggcuccaccauuguggaccagcggcugggcagugagcucggguguuacacgaucaaccgcggcaaguccuucaagcugugcgagaacagcgccacugggaagaccugcgagaucgacuccacccccguaaagugccggcagggcuucugccugaagaucacgcaggagggucgcggccacgugaaacuaagccgcggcuccgaggugguccuggacgcgugcgacagcuccugcgaggugaugauccccaaggggaccggcgacauccuggucgacugcagcgggggccagcaacacuuccugaaggacaaccucaucgaccugggcugcccgcauaucccccugcucgggaagauggccaucuacaucugccggaugagcaaccacccccgcaccaccauggccuuccuguucugguucagcuucggcuacgugaucacgugcaucuucugcaaggcccuguucuacucccucaucaucaucgggacucucggcaaaaagaucaagcaguaccgggagcugaagccccagaccugcaccaucugcgagaccacgccgguaaacgcuaucgacgcggagaugcacgaccucaacugcagcuacaacaucugucccuacugcgccucccgccugaccagugacgggcuggcccggcacgucacccagugccccaagcgcaaggagaagguggaggagaccgagcucuaccugaaccuggagcggaucccguggaucgugcgcaaguuacugcaggucagcgaauccacggguguggcccugaagcggagcuccugguugaucgugcugcugguccuccugcccgugagccugucccccgugcagagcgcacccgucggccacgggaagaccaucgagaccuaccagacccgcgagggcuucacguccaucugccucuucaugcuggggagcauccuguucaucguguccugccucgugaagggccuugucgacucugugggggacaguuucuucccgggccugagcgugugcaagaccugcuccaucggcagcaucaacggguucgagaucgagucccacaagugcuacugcucucucuucugcugccccuacugccggcacuguuccgcagaccgcgaaauccaccagcugcaccugagcauuugcaagaagcggaagaccggcuccaacguuaugcucgccgugugcaagcgcaugugcuuccgggccaccaucgaggccagccgccgggcgcugcugauccgcagcaucauaaacacgaccuucgccaugugcauccucacccugaccauaugcguggucaguacgagcgccguugaaauggagaaccugccugccgggaccugggagcgggaggaggaccucacuaacuucugccaccaggagugccaggugaccgagacggagugccugugccccuacgaggcccugguccuccgcaagccgcuguuccuggacuccaucgugaagggcaugaagaaccuccugaacagcaccucccuggagaccagccucaguaucgaggcgcccuggggcgccaucaacguucagagcaccuuuaagcccacggucuccaccgccaacaucgcccugagcugguccagcguggaacaccgcgggaacaagauccuggugaccggccgguccgagagcaucaugaagcucgaggagcgcaccggggucuccugggaccugggcguggaggacgcuagcgaguccaagcugcucacggugagcaucauggacuuaucccagauguacagccccgucuucgaguaccugagcggggaccgccagguggaggaguggccgaaggcgaccugcaccggcgacugccccgagcggugcgggugcaccuccagcacgugccuccacaaggaauggccccacucccggaacuggcguugcaaccccaccugguguuggggcgugggcaccgggugcacgugcugcggcguagacgugaaggaccuguucaccgaccacauguucgugaaguggaaagucgaguacaucaagaccgaggccaucgugugcguggagcugaccagccaggagcggcagugcucccucaucgaggccgggacccgcuucaaccugggcccggucaccaucacgcugagcgagccucggaacauccagcagaagcucccgcccgagaucaucacccuacaccccaagaucgaggaaggcuucuucgaccugaugcacgugcagaaggugcucuccgccagcacggucugcaagcugcaguccuguacccacgggauccccggcgaccuccagguguaccacaucgggaaccugcugaagggcgaccgcgugaacgggcaccugauccacaagaucgagccccacuucaacacgagcuggauguccugggacggcugcgaccucgacuacuacugcaacaugggcgacuggcccagcugcaccuacaccggggucacucagcacaaccacgcggccuucgugaaccugcugaacaucgaaacggacuacaccaagaccuuccacuuucacagcaagcgggugaccgcccacggcgacacgccgcagcucgaccugaaggcccgccccaccuacggggccggcgagaucaccguccuuguggaggucgcggacauggagcuccacaccaagaagguggagaucagcgggcugaaguucgccucccugacgugcaccggcugcuacgccugcagcuccggcaucagcuguaaggugcggauccacgucgacgagccggacgagcucaccgugcacgugaaauccagcgaccccgacgucguggccgccgggaccagccugauggcgcgcaagcuggaguucggcacggacuccaccuuuaaggccuucagcgccaugccgaagaccucccucugcuucuacaucguggagcgggaguacugcaaguccugcuccgaggacgacacccagaagugcgucgacacgaagcuggagcagccccagagcauccugaucgagcacaaggggaccaucaucggcaagcagaacgacacgugcaccgcccgcgccuccugcuggcucgagagcgugaaguccuucuucuacgggcugaagaacaugcugggcagcguguucggcaacuuccucaucgggauucugcuguuccucgcgcccuucguccugcuggugcuguucuucauguucggcuggaagauccuauucugcuucaagugcugccggcgcacccgcgggcuguucaaguaccgccaccugaaggacgacgaagagaccggcuaccggcgcaucaucgagcgccucaacuccaagaaaggcaagaaccgguuacuggauggggagcgacucgccgaccggaagaucgccgagcuguucagcaccaagacccacaucggcuga

SEQ ID NO: 15230 - RNA, 5067 nt, Artificial Sequence
  derived and/or modified CDS sequence (opt11) from CCHFV(VLG/TI29414)__AY179961.1__GP
augcccaccaacauaaugcacacccugcucguguguuucauccuguaccugcagcuucugggacucgggggcgcccacauacagagcaaugccacggaacacaacgggaccaacaccaccacggcgccguccaccagccagucacccaagcccuuggucagcaccgcgcccccgcacgcgcuggaauccucgacgaucaagcccacgacccccguauccgagacagagggcucuggaggcaccacgcccccgcccaauaccacccagggccccucgccgcccgaggccacacccgagcgccccgccacgaccgccaccagcacccccuccaccgacaacaccaacucaaccacccaugugacggacaacaaucccaccuccaccaucagcaccucccccaguucaagccccuccacgcccagcaccccgcaggggauccaccaucccgcccggaaccugcucagcgucuccagccccaagaccgccaccacucccaccccgaccucccccggcgacaucagcuccgagaccagcucccugcacagcgcuaugucccgcacgagcacccuguacacugcgacccaggugagcaccgagaaugccaaccacagcgcgccccggcagucugagagcuccgcccagcagaccaccacaucccccaugaccuccccggcccagcccauccucgugaugagcgccgcccccacggccauucagaacauccacccaucccccacaaaccgcagcaagcggaaccuggagauggagaucauccugacccucagccaggggcugaagaaguacuacggcaaaauccugaagcugcugcaccuuacccucgaagaggacacugaggggcugcuggaguggugcaagcguucccucggaaguaacugcgacgacgacuucuuccagaagcggaucgaggaguucuucaugaccggcgagggguacuucaacgagguccugcaguucaagacccuguccacccucagccccacggagcccucccaugcccgcccacccaccguggagccuuucaagucuuacuucgcaaagggcuuucugucuaucgacagcggguacuucuccgcgaagugcuacccccggcugagcaccuccgggcuccagcugaucaauguaacccaacacccggcccgcauugccgagacgcccggccccaagaccaccagccucaagacuaucaacugcaucaaccuccgggccaguguauucaaagaacaucgcgagaucgagauaaacgugcugcuuccccagauugccgugaaccucuccaauugccacgucgugaucaacucccacgugugcgacuauagccuggacacugacgggccgguccggcugccccacaucuaccacgagggcaccuucaucccagggaccuacaagaucgugauagacaagaagaacaagcucaaugaccgcugcaccuuagugacgaacugcgucaucaaggggcgggaggugagaaaggggcagagcgugcugcggcaauacaagaccgagaucaagaucggcaaagcgucuaccggcagccgcaaacuccuuuccgaggagcccggagacgacugcaucucccggacccagcugcuccgcgccgagccggccgagauucaugacgacaacuacggcggaccaggcgacaagaucacgaucugcaacgggaguaccaucgucgaccaacggcugggcagcgaguugggcugcuacaccaucaaccgcgucaagagcuucaaacuuugugagaacagcgccaccgggaagaccugugagauagacuccaccccugugaagugucgccagggcuuuugcuugaagaucacccaggaggggcggggccacgugaagcugagccgcggauccgaggugguacuggacgccugcgacucuuccugcgaggugaugauccccaagggcaccggcgacauccucguggacugcagcggaggccagcagcacuucuuaaaggacaaccuuaucgacuuggggugcccgcacaucccccugcugggcaagauggcgaucuacaucugccggauguccaaccacccccgaacgaccauggccuuccucuucugguucuccuucggcuacgucaucacgugcaucuucuguaaggcccuguuuuacucccugaucaucauagggacucucggcaagaagaucaaacaguacagggaacugaagccccaaaccuguaccaucugcgagaccgccccggugaacgcgaucgacgcagagaugcacgaccuaaacugcagcuacaacaucugccccuacugcgccucucgccucaccagcgacgggcuggcccggcacgugccucagugcccgaagaggaaggagaaggucgaggagaccgagcuguaucuaaaccuugagcggauccccuggaauguacgcaagcugcuccaggugucggagagcacgggggucgcccugaagcguagcuccuggcugaucguucuccugguccuguuaaccguuagccugucccccgugcaaagcgcgcccguagggcauggcaagaccaucgagaccuaccagacgcgcgagggcuucaccuccaucugccuguucaugcucgggagcauccuguuccuggucuccugccuugugaagggacugguggacagcgucucggacagcuucuuccccgggcuguccgucugcaagaccugcagcaucggcuccaucaacggguucgagauugagucgcacaagugcuacugcucccucuucugcugcccguacugccggcacugcagcgccgaccgcgagauccaucagcugcaccuguccaucugcaagaaacggaaaaugggcagcaaugugaugcucgccgucugcaaacgcaugugcuuucgggccaccaucgaggccagucgccgagcgcugcugauccgcagcaucaucaacacaaccuucgugaucugcauccucacccugaccaucugcguggucagcacguccgcgguggagauggagaaccugccgagcggcaccugggagcgugaagaggaccucaccaauuuuugccaccaggaaugccaggugaccgagacugagugucugugucccuacgaggcccugguucuccggaaaccgcuauuccuggacucaaucgugaaggggaugaagaacuuacugaacaguaccaaccuugagaccucccucagcaucgaggcccccuggggcgccaucaaugugcaguccaccuucaaacccaccgucaguaccgcgaacaucgcucuguccugguccuccguggaacaccgcgggaacaagauccuggugaccggccgaagcgagucaauuaugaaacuugaggaacgcaccggggucagcugggaucugggcguggaggacgccucagagagcaagcugcucacgguguccaucauggaccucagccagauguacucccccgucuucgaguaccugagcggcgaccgccagguggaggaguggccgaaggcgaccugcaccggggacugccccgagcgguguggcugcaccagcuccacgugccugcacaaggaguggccccauagucguaacuggcgcugcaaccccaccuggugcugggaaguggggaccggaugcacgugcuguggguggaacgucaaggaccuguucaccgaccacauguuuguaaaguggaagguggaguacaucaagaccgaggccaucgucugcguggaguuaacaucccaggagcggcagugcagccucaucgaggccggcacccgcuucaaccugggcccuguuaccaucacgcuauccgagcccaggaauauccagcagaagcucccgcccgaaaucaucacccugcaucccaaagucgaggagggauuuuucgaccugaugcacgugcagaagguguuaucugccuccaccgucugcaaacugcagucuugcacccacggcauccccggagaccuucaaguguaccacaucggaaaccuccugaagggcgaccgcgugaacgggcacuugauccacaagaucgagccccacuucaacacauccuggaugagcugggacgggugcgaccuagacuacuacugcaacaugggggacuggcccuccugcacguacaccggcaugacacagcauaaucacgccgcauucgucaaucugcuuaacaucgagacggacuacaccaagaccuuccacuuccacagcaaacgggugacugcgcacggggauacgccgcagcuagaccugaaggcccgacccaccuacggcgccggcgagauaaccguccucguggaaguggccgacauggaacuccacaccaagaagguugagauuuccgggcugaaguucgccagccuggcuugcacgggcugcuacgccugcuccagcgggaucuccugcaaagugcggauccacguggacgagcccgaugaacucacugugcacgucaagagcaacgaccccgacgugaucgccgcuuccaccagccugauggcaagaaagcuggaguucggcaccgacagcacguuuaaagcguucuccgccaugccgaaaaccagccucugcuuuuacauugccgaacgggaauacugcaaguccuguagcgaggaggacacccagaagugcguggacaccaaacuugagcagccccagucgauauuaaucgagcacaaggggacgaucaucggcaagcaaaacgacacgugcaccgccaaggcgagcugcuggcucgaguccgucaagagcuuuuucuacggacugaaaaauaugcugggguccguguucggcaauuucuucaucggaauccuccuguuucuggcacccuuugugcugcucgugcuguucuucauguucggcuggaagauccuguucugcuucaagugcugccgccggacgcgcgggcuccugaaguaccggcuguugaaggacgacgaggaaaccggcuaccgccgcauaauagagcggcugaacaacaagaagggcaagaaccgccugcucgauggggagcggcuggccgaccgcaagaucgcagagcuguucagcaccaaaacccacaucggcuag

SEQ ID NO: 15231 - RNA, 5067 nt, Artificial Sequence
  derived and/or modified CDS sequence (opt11) from CCHFV(UCCR4405)__KY484029.1__GP
augcccaucaauaucaugcacgcacuucucgugugcuucauucuuuaccuccaacucagcggccucggcggagcucaccggcaguccaacgcaacagagcacaauggcaccaacaccacuacggccccgggaaccucccaauccccuaaaccgcccgucucaacaacucuaccccacacgcccgaggcaagcacaaucaaacuaaccacccccaccucagaaacugagggaucgggcgaaacaaccccuccgcccaacaccacacaaggguugccacuacccggcaccaccccugaaagaucggcuaccacugcaaccuccacguccuccacugacgacaugaacaguaccacccaaaugaccgacaauacccccaccagcaccgucucaauuggacugucgucgucccccucaaugccguccacaucgcagggcauccacuauccaguccgaagccuacucagcguuagcuccccaaaaaccgcgacaacccccaccccuaugucccccggcgaagucucgcccgagacauccagccagcacucagcaaugucacgaaucccaacgcuuuacaccgcuacacaagugucgaccgaaaacaccaaccguucaaucccccgccagucagagagcuccguccaaccggccacccagagcccgaucaccucucccgcacaaaccauacucuuaaugagcgcagcccccacugcuauccaagauaugcaccccagccccaaaaaccgcucaaaaagaaaccucgaggucgaaauaauccuaacauugucccaaggauugaagaaauacuauggcaaaauucucaagcuccuccaccucaccuuagaggaagauaccgaaggacuccuagaauggugcaaacgcaaccuagggagcaacugcgacgacgacuucuuccaaaaacgcaucgaggaguucuuuauuaccggcgaaggguacuucaacgaagugcugcaguucaaaacacccucuacacugagcccaaccgaaccuucacauguacgccucccaaccgccgaacccuucaaauccuacuucgccaagggguuccuaucuaucgacucuggguauuucuccgcgaaguguuacccgcgcuccuccaccucaggccuccaacucauaaacgucacccaacaccccgcccgcaucgcugaaaccccaggcccaaaaaccaccucccugaaaacuauuaacugcauaaaucuacgcgcauccgucuucaaagaacacagggaaguagaaauuaacguucuccuaccgcaaauagccguaaaccuuagcaacugccacguaguaauaaauucacacgugugcgauuacagucucgacaccgacggacccguccgcuuacccagaauacaccacgagggagcuuucauacccgggaccuacaagaucguuaucgauaagaaaaacaaacucaacgaucgcugcucccucguuacaaauugcgucaucaaaggacgcgagguaagaaagggacaaucagucuuacggcaguauaagaccgagauaaaaauagggaaggccucaacagguagccggaaacuucuauccgaggaaccgggcgacgacuguaucucgagaacccaacuccuaaagacugaaaccgcggaaauccacgacgacaacuauggaggccccggcgacaaaaucacaauuugcaacggaucuaccaucguagaccaacgccucggaagcgagcuaggauguuacacuauaaaccgagucaaguccuuuaaacuuugcgaaaacucagcaacuggcaaaacaugugaaaucgauuccacccccguaaagugccgacaaggauuuugccuaaaaauaacacaagagggacgcggccacgucaaacuaucacguggcuccgaggucguccuagacgccugcgauucauccugcgaagucaugaucccaaaaggcacaggcgacauucuaguugacugcagcggcggucaacaacacuuccuaaaggacaaccucauagaccucggcugcccccacaucccccuccuaggcaaaauggcaauauacauaugccgcaugaguaaccacccaagaaccaccauggcauuucucuucugguucaguuucggcuaugucauuacuugcauauuuugcaaagcucucuucuauagccugauaaucauuggcacacucgggaagaaaauaaaacaauaucgagaauuaaaaccucaaacguguacuauuugcgaaacggcacccguaaacgccauagacgccgaaaugcacgaccugaaaugcucauacaacaucugucccuauugcgcaagccgccucacuucagauggguuagcccgccacguaacccagugcccuaaaaggaaagaaaaaguagaggaaacagaacucuaccucaacuuagaacguaucccguggaucgucaggaaacuccugcaagucagcgagucgaccgguguagcacucaagagaagcagcuggcuuaucguacuucucguacuccuuaccguaagccucucacccguacagucggcaccggucggccacggcaaaacaauugaaacauaccaaacucgugaaggcuucaccucaaucugccucuucaugcucgggagcauccuuuucauaguuucuugcuuggucaaaggccucguggauuccgucuccgauucuuucuuccccggcuuaagcgucugcaaaacuuguucuaucgguucuaucaacggguucgagaucgaaucacacaagugcuacuguucccuuuucugcugucccuacugucgccacuacucggccgacagagaaauccaccagcuccaccucucaaucugcaagaaacgcaaaacgggaagcaacgugaugcuggccgucugcaaacgcauguguuuuaaggccaccauugaggcgucgcgccgcgcacuccucaucagaagcauaauaaacacuacuuucgucaucugcauacucauacucgcaaucugcgucgucuccacguccgcugucgagauggagaaccucccagccgguacaugggaaagagaagaagaccucacgaacuucugccaccaggaaugucaaguuacagaaaccgagugccucugccccuaugaagcccuaguucuacgcaagccccucuucuuagacagcacaguaaagggcaugaagaaccuccuaaacucuacuucccucgagacuucccuaagcauagaggcaccuuggggugccauaaauguccaauccacuuucaaacccacagucucaacggccaacauagcacugucguggucauccguagaacaucgcggcaacaaaauucuagucaccgggagguccgagagcaucaugaagcucgaagaaagaaccggcguuaguugggaccucggcgucgaggacgccucagaaucaaaacuccucacagucucgauaauggaucucucccaaauguacucccccgucuucgaguaucuguccggggaccgacaagucgaagaauggcccaaagccacaugcacuggcgacugucccgaacgcuguggaugcacuagcuccacaugccuccacaaggaguggccccauucacguaacuggcggugcaacccgaccuggugcuggggcguuggcacagguuguaccugcugcggcgucgacguaaaagaccuuuucacugaccacauguucguaaaauggaagguugaauauauuaaaacggaggcaauuguuugcguggaacucacuucacaagaacgucaguguagccugaucgaagccgguacacguuucaacuuaggaccaguaaccauaacccuuagcgagccacguaacauucagcaaaaacuaccucccgaaaucauaacucugcaccccaaaauagaagagggcuuuuucgaccucaugcacguucaaaagguccucucggccucuacagucugcaaguuacaaaguuguacccacgguaucccgggggaccuccaaauauaccacauaggcaaucuucuuaagggcgaccgcgucaacggccaccuaauccacaaaauagaaccccauuucaacaccuccuggaugucaugggauggcugcgaccuagacuacuacugcaacaugggcaacuggccaucgugcaccuacacgggcguaacgcaacacaaccacgcggccuucgucaacuuauuaaauaucgaaacggacuauacuaagaccuuucacuuccacagcaaaagaguaacggcacacggcgacaccccacaacuagacuuaaaagcccggcccaccuacggcgcgggcgagauaaccguucucguugaagucgccgauauggaacuacacaccaagaaaguugagauauccggccugaaauucgcgucccucguuugcacaggcugcuacgccugcagcucgggaaucagcugcaaagucagaauccacgucgaugagccagacgagcuaacugugcacguuaaaagcagcgacccugacguugucgccgccucaaccucccuaauggcacgaaaacuugaauuuggcacugacucgauauucaaagcauucucggccaugccuaaaaccucccucuguuucuacauuguugaacgcgaauacugcaaauccuguuccgaagaugacaccaaaaagugcguugacacaaaacuagaacaaccccagucgauccucaucgagcacaaagggacaauaauaggaaaacaaaacgauaccugcaccgcaaaagcaagcugcuggcuagaaagcgucaaauccuucuuuuacggacucaaaaacauguuaggaagcgucuucggaaacuuuuucgucggcauccuacuguuucuugcaccauucgugcuucuaguccuauucuucauguucggcuggaaaauccucuucugcuuuaagugcugccgucgcacccgcggcuuauucaaauaccgccaucucaaagacgacgaagaaacuggcuaccgacgcauaauagaacgguuaaauagcaagaaagguaaaaaccgucuucuugacggcgaacgccucgccgaccgcaaaauagcagaacucuuuucuacaaaaacucacauaggcuag

SEQ ID NO: 15232 - RNA, 5067 nt, Artificial Sequence
  derived and/or modified CDS sequence (opt11) from CCHFV(Ast133)__KX056060.1__GP
augccgaucaacauaaagcacacccugcucgucugcuucauccuguacuuacaguuaagcggccuugggggcgcccacgggcagaguaacgccaccgagcacaacggcacgaacacaaccaccguuccggggacgagccaaucccccaagccucccgcgagcacaaccccgccccacacgccagaguccucuacggugaagcugaccacccccaccuccgagacggaaggcagcggcgagacaaccccgccgcccaauaccacccaggggcucccccugcccggcacuacccccgagcgcuccgccaccacggccacgagcaccuccagcaccgacaacaugaacuccacaacccaggucacagacaacacccccacgucgaccgucuccaucagcccguccagcucaccguccaugccuagcaccucccaggggauccaccaccccgugcggagccugcucuccguguccucccccaagacugucacgaccccgacccccaugagucccggggagaugucccccgagaccagcucccagcacuucgccaugagucgaaucccgacgcuguacaccgccacccagguguccaccgagaacaccgaucggagcacgccccgccaguccgagagcucagugcaaccggcgacacagagccccaucaccuccccggcccagaccauccugcucauguccgcggcccccaaggcgauccaggauaugcaccccagcccgacgaaucggucaaagcgcaaccuggaggucgagauaauucugacacucagccaggggcugaagaaguacuacgguaagauacugaaauugcugcaucucacccuugaagaagacaccgagggccugcuggaguggugcaagcggaaccuaggcuccaacugcgacgacgacuucuuccagaagcgcaucgaggaguucuucaucacgggcgagggguacuucaaugagguguuacaguucaagacucugagcacgcucucccccaccgagcccagccacguccgccugccaacggccgagcccuucaaauccuauuucgccaaaggcuuccugaguaucgacucuggcuacuucuccgcaaagugcuacccgcggucuagcaccuccggucuccaguuaaucaacgucacccagcaccccgcccggauagcggagacccccggcccgaagacgaccucacugaagaccauuaacuguaucaaucuacgggccuccguguucaaggagcacagggagguagagaucaauguguugcugccccaaauagccgugaaccugagcaacugccacguggucauaaacucccaugugugcgacuacucccucgacaccgacgggcccguacgcuuacccagaauccaucacgagggcacguucauaccggggaccuauaagauugucauagaccgcaaaaacaagcucaacgaucggugcucccuaguuaccaauugcguaaucaaaggacgcgagguacggaaaggccagagcgugcuacggcaguacaagaccgaaaucaagauugggaaggccuccacgggcucccggaaauuacugucggaggagcccgacgacgacugcauuucccgcacccagcuccucaagaccgagaccgccgagauccacgacgacaacuacgggggccccggggacaagaucaccaucuguaacggcagcaccauagucgaccagcggcugggcucggaguuagggugcuacaccaucaaccggguaaagagcuuuaagcucugcgagaacuccgcgaccggcaagacaugcgagaucgacagcacacccgugaaaugcaggcaaggguuuugccugaaaauuacucaggagggcagagggcacgugaagcugucccgcggcagcgaggugguguuggacgccugcgacuccagcugcgagaucaugaucccgaagggcaccggggacauccucgucgacugcuccggcgggcagcaacacuucuugaaagacaaucugaucgaccucggcugcccccacaucccccugcuggggaagauggcaauuuacaucugucggaugucuaaccacccccgaacgaccauggccuuucuauucugguucucuuucggguacgugauuaccugcaucuucugcaaggcccuguucuaccuccucaucaucaucggcaccuuggggaagaagauaaagcaguaccgggaguuaaagccucagaccugcacgauaugugagaccgcgcccgugaacgccaucgacgccgagaugcacgaccuaaacugcucuuacaacauaugcccuuacugcgccucccgccugaccagcgauggccuggcccgccacgucacccagugccccaaaagaaaggaaaagguggaagagacggagcuuuaccugaaccuggaacguaucccguggaucguacgcaaauuguugcaggucagugagucaaccgggguggcccugaagcgguccagcuggcucauugugcugcugguucuacugaccguuagccugucccccguacaaagcgcccccgugggacacggcaagacaaucgagacguaccagacccgcgagggguucaccuccaucugccucuucaugcugggcagcauacuguucaucguguccugccucgugaaggggcugguugacagcguguccgauagcuuuuucccggggcugucggugugcaagaccugcagcaucggguccaucaacggcuucgagaucgagucgcacaagugcuacugcuccuuauucugcugccccuacugucggcacugcagcgcagaucgcgagauccaccagcugcaccuguccaucugcaagaagcggaaaacgggcagcaacguaaugcucgccgugugcaagcgaaugugcuuuaaggcgacuauagaggccucccggcgcgcccugcuuauccggagcaucaucaauacgaccuucgugaugugcauccucacgcuggccaucugcgucgugagcacauccgccguggagauggaagaccugcccgcugggaccugggagcgggaagaagaccuaaccaacuucugccaccaggagugccaggucacggagaccgagugccugugccccuacgaggcccucgugcuccgcaagccgcuguucagcgacuccaucgugaagggcaugaagaaccugcuaaacagcaccucccuggagaccagccuguccauugaggcccccuggggcgccaucaacgugcagagcacauuuaagcccaccguauccaccgcgaacaucgcgcucagcugguccucaguggagcacagagggaacaagauucuuguuaccgggcgcagcgagagcaucaugaagcuggaggaacgaacgggcgugucgugggaccucggcguggaggacgccagcgaguccaagcugcugaccgucagcauaauggaccugucccagauguacagccccguguuugaguacuuaagcggggaccggcaaguggaggaguggccuaaggcuaccugcaccggagacugucccgagcggugcgggugcacuucgagcaccugucugcacaaagaguggccccacucgcgcaacuggcggugcaaccccacuuggugcuggggcgucgggacgggcugcacgugcuguggcguggacgugaaagaccucuucaccgaccauauguuuaucaaguggaaagucgaguacauaaagacagaggccaucgugugcguggaacugacaagccaggagcgccaguguucccugaucgaggccgggacacgguucaaccugggcccugucacgaucacccugagcgagccccggaacauccagcagaaacugccacccgaaaucaucacccuccacccgaagauagaggagggguuuuucgaccugaugcacgugcagaagguuuuauccgccaguaccgucugcaagcuccaguccugcacgcacggcauccccggcgaccugcagaucuaucacauugggaaccugcucaagggggaucgggugaacggucaccugauccacaagaucgagccacauuucaauacaagcuggaugucaugggacggcugcgaccuggacuauuacuguaacaugggggacuggcccagcugcaccuacaccggcgucacccaacacaaccaugcugcuuucgugaaccuccugaacaucgagaccgacuauaccaagaccuuccacuuccacagcaagcgcgugacagcccacggcgacaccccgcaacuggaccucaaagcgcggcccaccuacggggccggcgagauuaccguccucguggagguggccgacauggagcuacacacgaagaagguagagaucagcggguuaaaguucgccucccuuacaugcaccgggugcuacgcuugcagcuccgggaucucaugcaagguaagaauacacguggacgagcccgacgagcugaccguccaugugaaguccagcgaccccgacguagucgcggccagcacgucccucauggcccggaagcuggaguucggcaccgacaguaccuuuaaggccuucuccgccaugccgaagaccagcuuauguuucuacaucguugagcgcgaauacugcaagagcuguagcgaggacgacacgaagaagugcguggauaccaagcucgagcagccccaguccauccugaucgagcacaaaggcaccauuaucgggaagcagaacgauaccugcacggcaaaagccagcugcuggcuggaguccguaaagagcuuuuucuacggcuuaaagaauaugcugggguccguguucggcagcuucuucguggggauacuguuguuccuggccccauucguccugcuuguucucuucuucauguucggguggaagauacuguucugcuucaagugcugccggcgcacccggggccuguuuaaguaccgccaccucaaggacgacgaggagaccggguaccgcaggaucaucgagcggcugaacucgaagaagggcaagaaccggcugcucgacggggagcgccuggcagaccgcaagaucgccgaacuguuuagcuccaagacacacaucggguga

SEQ ID NO: 15233 - RNA, 5067 nt, Artificial Sequence
  derived and/or modified CDS sequence (opt11) from CCHFV(Ast137)__KX056057.1__GP
augcccauuaacaucaugcacacacuucucgugugcuucauccuguaccugcaacucaguggccucgggggcgcccacgggcaguccaacgcuaccgaacauaacggcacgaauaccaccaccgucccgggaacgagccagucccccaagccacccgcgagcaccacccugccccacaccccagaguccagcacagugaagcuaaccacccccacgucggagacggagggcagcggagagaccacgcccccgcccaacaccacccaggggcugcccccgcccggcaccacccccgagcggcccgccaccacggccaccaguacuagcuccaccgacaacaugaacagcacgacccaggugaccgacaauacacccacguccaccgucagcaucucccccagcuccagccccuccaugcccagcaccagccaagggauccacuacccugugcggucgcugcucucaguguccagcccgaagaccgucacgacucccaccccgaugagucccggcgaaaugagcccggagaccuccagccagcacuccgccaugagccgcauccccacguuauacaccgccgcccaggucuccaccgagaacaccaaccggagcacgccccgccaguccgagagcagugcccagcccgccacccaaagcccgaccaccuucccggcccagacaauccuucucauguccgcggcacccaaggccauccaggacaugcacccgagccccacgaaucgguccaagcgcaaccuggagguggagaucauccugacccucagccaggggcugaagaaauacuauggcaagauccuuaaacuccugcaccugacccucgaggaggacaccgaaggccugcuggaguggugcaagcggaaucucgggagcaacugcgacgacgacuucuuccagaagcgcaucgaggaguucuucaucacgggcgagggguacuuuaacgagguccugcaauucaagacccuguccacccucagcccgaccgagcccucgcacgugcggcugccgacggccgaacccuuuaagagcuacuucgccaaaggcuucuuauccauagacagcggcuacuucuccgcaaaguguuacccuagaagcuccaccagcgggcuccagcugaucaacguaacgcagcacccggcccggaucgccgagaccccgggccccaagacgaccucccucaagaccaucaacuguaucaaccuccgcgccagcgucuucaaggagcaccgggaggucgagaucaacgugcugcugccccagaucgccgucaaccucucgaacugucacguggugaucaacagccacgucugcgacuacagucuggacaccgacgggcccgugaggcugccccggauccaccacgaaggcacauucauacccgggaccuacaagaucgugaucgacaagaagaacaagcucaacgaucgcugcagccugguuaccaacugcgugaucaaaggccgggaggugcgcaaaggccagagugucuugcggcaguacaagacagagaucaagaucgggaaggcgagcacgggcagccgcaaacuccugagcgaggaaccuggggacgacugcaucucucggacccaacugcucaagacggagaccgcugagauccacgaugacaacuacggugggccaggggacaagaucacgaucugcaacggguccaccaucguggaccagcgccucgggagcgagcugggcugcuacaccauaaacagagucaaguccuucaagcugugugagaacucagccaccgguaagacgugugagaucgacuccacaccggugaagugccggcagggcuuuugccugaaaaucacccaggaagggcgcggccacgugaagcugagccggggcuccgagguggugcuggacgccugcgacagcuccugcgagauuaugauuccaaaaggcaccggagauauccugguugacugcucugggggucagcaacacuuccugaaggacaaccugaucgaucucggcugcccucacaucccccugcuggggaagauggccauccacaucugccgcauguccaaccacccgcggaccaccauggcguuccucuucugguucagcuucggcuauguuauaaccugcaucuucugcaaggcccuguucuacucccugaucaucaucgguacccucggcaagaagaucaagcaguaccgcgaacugaaaccccagaccugcaccaucugcgagaccgcccccgugaacgccaucgaugccgagaugcacgaucugaacugcagcuacaacaucugcccguauugugcgucccggcucaccagcgacggccuggcccgccacgugacucagugcccgaagcggaaggagaaagucgaggagacugagcuguaccucaaccuggaacgcauccccuggaucguucggaaguuacuccagguguccgagagcacgggcgucgcccugaagcgaagcuccuggcucaucgugcuccuggugcugcucaccgucagucuaucccccgugcagagcgcgccggugggccaugggaagaccaucgagacguaccagacccgggagggauucaccaacauaugccuguucaugcucggguccauccuguuuaucgucucuuacuuaguaaaaggcuuaguggacucaguuagcgacucguucuucccuggccugagcgucugcaagaccugcuccaucggcagcaucaacggcuucgagaucgagucccacaagugcuacugcagccucuucuguugccccuauugccgccacugcuccgcagaccgggagauccaccaauuacaccuggggaucugcaaaaagcgcaaaacgggcagcaacgugaugcuagccgucugcaagcggaugugcuucaaggccacuaucgaggccuccagacgcgcgcuccuaauccgcagcaucaucaacaccaccuucgugaucugcauccugacgcuagcaaucugcgugguguccaccagcgccguggagauggagaaccugcccgccgggaccugggagcgagaggaggaccugaccaacuucugccaucaggagugccaagugacggagaccgagugccucugcccguacgaggcccugguccugcggaagccccuuuuccucgauagcaucgucaagggcaccaagaaccugcucaacuccaccagccuggaaacgucucuuagcauugaggccccauggggagcgaucaacgugcaguccaccuucaagcccacugucagcacagccaacaucgcccucuccuggagcuccguugagcaccgcgggaacaagauccuggugaccggccggagcgagucaaucaugaagcuggaggagcgcacgggggucagcugggaccucggaguggaggacgccagugagagcaagcugcugacaguguccaucauggaucucagccagauguacuccccggucuucgaguaccugagcggggaccgccagguggaggaguggcccaaggcgacgugcaccggcgacugccccgagaggugcgggugcaccuccuccacgugccugcacaaagaguggccacacucgcggaacuggcgcugcaacccgaccuggugcuggggcgucgggaccgggugcacgugcuguggcgucgacgugaaggaccuuuuuaccgaccacauguucaucaaguggaagguggaguacaucaagaccgaagccauugucugcguggagcugaccucccaggagcggcagugcagccuuaucgaggccgggacccgcuucaaccucggucccgugaccaucacccuguccgagccccgcaacauccagcagaagcuacccccggagaucaucacccugcaccccaagaucgaggaaggcuucuuugaccugaugcauguccaaaaggugcuguccgccuccacggucugcaagcuccagagcugcacccacgguauccccggcgaccugcagaucuaccacaucgggaaucugcucaagggcgacaggcugaacgggcaccuaauacacaagaucgagccccacuucaacaccucauggaugagcugggacggcugcgaccuagacuacuacugcaacaugggcgacuggccgucgugcaccuacacuggggugacacaacacaaccacgccgcguucgugaaucugcugaacaucgagacugauuacaccaaaacguuucacuuccacagcaagcgggucaccgcccacggcgacacgccccagcuugaccugaaggccagacccaccuauggggccggcgagaucaccgugcuuguagaagucgccgacauggagcuacacaccaagaagguggaggugucggggcugaaauucgccagccuggccugcaccggcugcuaugccugcuccagcgguaucuccugcaaggugcgaauccacguggacgagcccgaugagcucaccguucaugucaagagcagcgacccggacguuguggccgccagcacgucccugauggcgcgcaagcuggaguucgggacagacagcacuuuuaaggccuucagcgccaugccaaagaccucccucugcuucuacaucgucgagcgggaguacugcaagagcugcuccgaggacgacacgaagaagugcguggacaccaagcuggagcagccccagagcaucuuaauagagcacaagggaaccaucaucgguaagcagaacgauaccugcaccgcgaaggccucgugcuggcucgagucugugaaguccuuuuucuacgguuuaaagaauaugcuggggagcgucuucggcaauuucuucgugggcauccuccuguuccuggcgccauucguguugcucgucuuguucuucaucuucggguggaagauccuguucugcuuuaagugcugccguagaacccgcggccucuucaaauaccggcaccugaaggacgacgaggagaccggguaccgcaagauaaucgagcgccugaacuccaagaagggcaagaaccggcuccuggacggcgagcgccuggccgaccggaaaaucgccgaguuguucagcaccaagacgcauaucggguga

SEQ ID NO: 15234 - RNA, 5067 nt, Artificial Sequence
  derived and/or modified CDS sequence (opt11) from CCHFV(Ast149)__KX056054.1__GP
augccgaucaacauaaugcacacauugcuagucugcuuuauccucuaccugcagcuaucaggccugggcggcgcacacgggcaguccaacgccacugagcacaacgggacgaacaccaccaccgcgccggggacaucccaaagucccaagccgccggcgucaacaaccccgccgcauacccccgaguccucuacggucaagcugacuaccccaacuuccgagacggaggggagcggagagacgacgcccccgcccaacaccacgcaagggcuaccuccgcccggcaccacccccgagaggccugcaaccacggccacauccaccagcaguaccgacaacaugaacagcacgacccaggugaccgacaauaccccgacguccacuguuagcaccucucccucaagcagcccgagcaugccgagcaccagccagggaauccacuacccuguuagaagccuguuguccguuuccucacccaaaacggucaccacccccacccccaugaguccuggggaaaugagccccgaaacgucgagccagcacuccgccaugagccggauccccacccucuacacggcggcccaaguauccacugaaaacgccaaccggucgacaccacggcaauccgagucuucggcccaaccugcgacucagagcccuacgaccuuccccgcgcagaccauccugcugauguccgccgcgccgaaggcaauucaagacaugcaucccucacccacuaaccgaaguaaaagaaaccuagaaguggagauaauucugacccugagccaggggcucaaaaaguauuacggcaagauccugaagcugcugcaccuaacacuggaggaagacaccgagggccuccuagagugguguaagcggaaucucgggaguaauugcgaugaugacuucuuccagaagcgcaucgaggaguucuucauuacgggcgagggcuacuucaacgagguguuacaguucaagacccuaucaacccucucccccacagagccgucccauguccggcucccaacggcugagcccuucaaguccuacuucgcgaaaggcuuucugucuaucgacaguggauacuucucugcuaaaugcuacccccgcagcuccaccucgggguugcagcuaauuaacguuacccaacacccggcaagaauagccgagaccccagggccuaagacaacgucccugaagacgaucaacuguaucaaccuucgcgcgagcguguucaaagaacaccgggaaguagaaauaaacguccucuuaccgcagaucgccgugaaccuguccaacugccacgucgugauuuauagccaugugugcgauuauucccucgacaccgaugggccagugagauuaccacggauccaccacgagggcacguucauuccugggaccuauaagauagugaucgacaagaaaaacaaacuuaacgacagaugcagccucguaaccaacugugucaucaaggggcgcgaaguucgcaaggggcagagcguucuacggcaguacaaaacagaaaucaaaauugggaaggccagcaccggcagucgcaagcugcucagcgaagaacccggugaugauugcaucagucgcacgcagcuccuuaaaaccgagaccgccgagauucacgacgacaauuacggcggaccgggcgauaagaucacaaucugcaacggguccaccaucguggaucagcgccucgguucugaacugggcugcuacacaauaaaccgcgugaaauccuucaaguugugcgagaacagcgccaccgggaagacuugcgagaucgauuccacccccguaaagugccggcaaggauucugucuuaagauaacccaggagggccgcggccacgucaagcugucgagaggcuccgagguaguccucgacgccugugacagcuccugcgaaaucaugauccccaaggggaccggcgacauacugguggacugcagcgggggccagcaacacuuccucaaggacaaccugaucgacuugggaugcccccacaucccucuccuggggaagauggcuaucuacauuugucgaauguccaaccaccccagaacgaccauggccuuccuguucugguuuagcuucggguacgugauuaccuguauuuucugcaaggcccuguuuuacucucuuauaaucaucgggacgcugggcaagaagauuaaacaguaccgcgagcucaaaccccagacgugcacgaucugcgagacugcuccugucaacgcgauugacgccgaaaugcacgaccuaaacugcucauacaacauuugcccguacugugcgucucggcugacuagcgacgggcucgcccgccacgugacucagugucccaaacgcaaagaaaagguggaggagacggagcuguauuuaaaccuagaacgcaucccauggaucguuagaaaacugcuccagguguccgagaguaccggcguggcccucaagcgcaguuccuggcucaucguccugcuuguguugcuaacgguaagccucuccccaguccaaagcgcaccggucggccacgggaagaccauagagacguaucaaacccgggagggcuuuacaaauauaugucuguucaugcugggcuccauacuauucaucgugagcugccuggugaaaggcuuagucgacuccguaagcgacuccuuuuuccccggcuuaucggucugcaagacauguuccaucggcagcauaaaugguuucgagaucgagucacacaaauguuacugcagcuuauucugcugccccuacugccgccacugcagugccgaccgggaaauccaccagcugcaccugggaauaugcaagaagcgcaaaacgggaaguaacgucaugcuagcaguaugcaagagaaugugcuucaaagcaaccaucgaggccucccggcgcgcacugccgaucagauccauaauuaacacgacuuucgucaucugcauccucacguuagcgaucugcguagugagcacgagcgcuguggaaauggagaaccuucccgcggggaccugggaacgcgaggaggaccucacuaacuucugucaccaggaaugccaaguaacugaaaccgagugcuugugcccguacgaggcccuggugcuucguaagccccuuuuccuggacagcauagugaagggcaugaaaaaccuucuaaauucaaccagcuuagagaccagucucagcauagaggcaccguggggcgccaucaaugugcagucaacguucaaaccaaccgugagcaccgccaauaucgcccuguccuggagcuccguagagcaucgcgggaacaagauauuagugacuggaaggagcgagucuaucaugaaacuagaggaaaggacgggagugucuugggaccucggcguagaggaugcgucugagagcaaacugcuuaccguguccaucauggaccugagucagauguacucccccguuuuugaguaccucuccggagaucggcaggucgaagaguggccaaaagcaaccugcaccggggacugcccggaacguugcggguguacgaguucgaccugcuugcacaaggaguggccccacagccgcaacuggcgcugcaaccccacuuggugcuggggcguggggaccgggugcacaugcugcggcguggacgugaaggaucucuucacagaccacauguucauaaaguggaagguggaauacauuaagaccgaagccauaguuugcguggagcugaccucucaggagcgucagugcagccucaucgaggccggaacucgcuucaaccuggggcccgugacgaucacccuguccgagccccgcaacauccaacagaaguuacccccggagaucaucacccuucaucccaaaauagaggagggcuucuucgaucugaugcaugugcagaagguccucagcgcauccacgguguguaaacugcaaagcugcacgcacgggauaccgggagacuuacaaauuuaucacaucgguaacuugcucaagggcgaccgccugaaugggcaccuuauccacaagaucgaaccccacuucaauaccagcuggaugagcugggacggcugcgaccuggacuacuauuguaacaugggcgacuggcccucaugcacguacacgggggugacccaacacaaccacgccgccuucgugaaccugcucaauaucgagaccgacuacaccaagacauuccacuuccacagcaaacgcgugacggcacacggugacacgccccagcuggacuugaaggccaggccgaccuacggggcgggggagaucaccguccucgucgaaguggccgauauggagcuccacacgaagaaagucgagguauccggacucaaguuugcuagccucgccuguacggggugcuacgccugcuccucgggcaucuccugcaagguucgaauacacgucgacgaacccgacgagcugacgguucacguuaagagcuccgaucccgacgugguggcggcaucgaccucccugauggcccgcaagcucgaguucgggacggacucgaccuucaaggccuucagcgcaaugcccaaaacaucacugugcuuuuacauaguugagcgcgaguacugcaagagcugcucugaggaugacacgaagaagugugucgauacgaagcuggagcagccgcagagcauucucauugaacacaagggcaccaucauugguaagcagaacgacacgugcacugcgaaggccuccugcuggcuugagagugugaaauccuucuuuuacggccugaaaaacaugcucggcagcguguucggcaacuucuucguuggcauuuuauuguuucucgcccccuucgugcugcuugcccuguucuuuaucuuugguuggaaaauccucuucugcuucaagugcugccgacguacgcgcggccuguucaaguaucgccaccugaaggacgacgaagagaccggauaccgcaaaaucaucgagaggcucaauucuaaaaagggcaagaaccgguuauuagauggagagcgacucgcugaccguaagaucgccgaacuguuuagcaccaaaacccauauagguuag

SEQ ID NO: 15235 - RNA, 5067 nt, Artificial Sequence
  derived and/or modified CDS sequence (opt11) from CCHFV(Ast199)__KX056051.1__GP
augcccaucaacauaaugcacacccugcucgugugcuucauccuguaccugcagcucagcggacuagggggcgcccacguccaguccaacgccaccgagcauaauggcacgaacacgaccaccgugccgggcacgagccaaucccccaagccgcccgcgagcaccacacugccccacaccccggaguccagcacggugaaacugaccaccccaacguccgagacggaggggucuggggagacaacgcccccgccgaacaccacccagggccugcccccacccgguaccaccccagagaggcccgccaccacggccacuaccaccuccagcacggacaacaugaacuccacgacccagguaaccgacaauacgcccaccagcaccguguccaucagcccuuccagcaaucccuccaugccuagcaccucccaagggauccacuaccccgugcggagccugcucagcgucucaagcccgaagacagugaccacucccacccccaugucccccggggagaugagcccggagacguccagccagcacagcgcgaugagccguauccccacccuguacacggccgcccagguguccacggagaacaccaaccggagcacgccccgccaguccgagagcuccgcccagcccgccacccagagcccgaccaccuuccccgcccagacgaucccuuuaauguccgcggccccgaaagccauccaggacaugcaucccagccccaccaaccgguccaagcgcaacuuagagguagagaucauccugacccugagccagggccucaaaaaguacuacgggaagaucuuaaagcugcuccaccugacucuggaggaagacacagagggucuucucgaguggugcaagcggaacuuaggcuccaauugcgacgacgauuucuuccagaagcgcaucgaggaguucuucaucaccggggaaggcuacuucaacgaggugcuccaguucaagacaccgagcacccugucgccgacggagccaucccacgugcggcugcccaccgccgagccauucaagagcuacuucgccaagggcuuccucuccaucgacagcggcuauuucuccgcgaagugcuacccgcgcucguccaccagcggccugcaacugaucaacgucacacagcaccccgcccggaucgcugagacgcccgggcccaaaaccaccagucucaagaccaucaacugcaucaaccugcgcgccagcguguucaaggagcaccgggagguggagaucaacguccugcuaccgcagaucgcugugaaccugucaaacugccacgucgugaucaacagccacgugugugacuacucccuggacacugacggccccgugcgccucccccggauccaucacgaggggaccuucauccccggcaccuacaagauaguaaucgacaagaagaacaaacugaacgaccgcugcagccuggugaccaacugcgugauaaaaggccgggagguccguaagggccaguccguguugcggcaguacaagacggaaaucaagaucggcaaggccuccaccggguccaggaagcugcugagcgaggagccgggagacgacugcaucagcagaacccagcuccucaagaccgagacggcggagauccacgacgacaacuacgggggcccaggcgacaaaauaaccaucugcaacggcuccaccaucgucgaccagcgccugggcagcgagcuugggugcuacaccaucaaccgcgucaaguccuucaagcugugugagaacagcgcgacgggcaagacuugcgagaucgacucgacccccgugaagugccggcagggauucugccugaagauuacccaggagggccgcggacacgucaaacucagccggggguccgaggugguuuuagacgccugugacucuuccugcgagaucaugauacccaagggcacaggagacauccuggucgacugcagcggcgggcagcagcacuuccugaaggacaacuuaaucgaccugggcugcccgcacaucccuuuacucgggaaaauggccaucuacaucugccgcauguccaaccacccccggaccaccauggcguucuuauuuugguucagcuucggguacgugaucacgugcaucuucugcaaggccuuguucuacucccugauuauuauuggcacacuggggaagaaaaucaaacaguaucgcgaacugaagccccagaccuguacaauuugcgagaccgcuccggugaacgcgaucgacgccgagaugcacgaccucaacugcagcuacaacauaugccccuacugcgcgucccggcugaccagcgacggucuggcccgccaugucacgcagugcccaaagcggaaggagaaaguggaggaaacugagcucuaccugaaucuggagcgcaucccguggaucgugaggaaacuccugcaggucuccgagucuaccgggguggcccugaagcgcugcuccuggcucaucgugcugcugguccuccugaccgugagccugagccccgugcaguccgcccccguaggccacgguaagacgaucgagaccuaucagacccgggagggguucaccaacaucugucucuucaugcugggcagcauccuguucaucguguccugccucgugaaggggcuggucgacucuguguccgacagcuucuuccccggccuguccgugugcaagacgugcagcaucggguccaucaacggcuucgagaucgagagccacaagugcuacugcucccucuucugcugcccguacugccgccacugcagcgcggaccgggagauccaccaacugcaccugggcaucugcaaaaagcgcaaaaccggcuccaacgucauguuggccgugugcaaacggaugugcuuuaaggccacgaucgaggccagccgccgagcgcugcugauccgcuccaucaucaacacaacguucgugaucugcauccucacccuggcaaucugcgucgugagcaccuccgcgguggagauggagaaccugcccgccggcacaugggagcgcgaggaagaccucacgaauuucugccaccaggagugccagguaacugagacggagugccugugucccuacgaggcccuagugcuccgcaaaccccuuuuccuggacagcauagugaagggaaugaagaacuuacucaacuccaccagccuggagacgucacucuccaucgaggccccguggggagcgaucaacguccagagcaccuucaagcccacugugagcaccgccaacauagcccuaucaugguccucuguagagcaccgcgguaacaagaucuuagugacgggccgguccgagagcaucaugaaacucgaggagcgcaccggcguguccugggaccuugguguggaggacgcaagcgaguccaagcugcuuaccgucagcaucauggaucugucccagauguacagcccaguguuugaguaccuguccggggaccgucaaguggaggaguggcccaaggccacgugcaccggagacugcccggagcggugcggcugcaccagcuccacgugccuccacaaggaguggccccacagucggaacuggcgcugcaaccccaccuggugcuggggcgucggcaccggcugcacgugcugcgggguggacgugaaggaccuguuuacggaccacauguucaucaaguggaaggucgaauacaucaagaccgaggcgaucgugugcguggaacugaccucacaggagcggcagugcagccucaucgaggccggcacccgcuucaaccuggggccgguuaccaucacccucagcgagccacggaacauccagcagaaacucccgcccgagaucaucacccugcacccaaagaucgaagagggcuucuucgaccugaugcacguccagaaggugcucuccgccagcacggugugcaagcugcaguccuguacccacggcauucccggugacuuacagaucuaccacauaggcaaccuccugaagggggaccgucugaacggccaccucauacacaagaucgagccccacuucaacaccagcuggauguccugggacgguugugaccuggacuauuacugcaacaugggcgacuggcccagcugcaccuacacgggugucacccagcacaaucacgccgcguucguaaaccugcucaacaucgagaccgacuacaccaagacguuccacuuucacuccaagcgggugaccgcccacggggacacgccccaguuggacuuaaaggcccgccccaccuacggcgcuggugagaucaccgugcucgucgaaguggccgacauggagcugcacaccaagaagguggagguaucgggccugaaguucgcgucacucgccuguaccgggugcuaugccugcucguccggcaucagcugcaaggugcggauccacguggacgagcccgacgagcugaccguccaugugaaauccagcgaccccgacguggucgccgccucgacgagccugauggcucgcaagcucgaguucggcaccgacuccacguucaaggcguucucugccaugccaaagaccagucugugcuucuacaucguggagagagaguacugcaagagcugcagcgaggacgacaccaagaagugcguggacacuaagcuggagcagccgcagagcauacucaucgagcacaagggcaccaucaucggcaagcagaacgacaccuguaccgccaaggccagcugcuggcuggaauccgucaaaucguucuuuuacgggcugaagaacaugcucggcucggucuuugggaacuucuucgugggcauccugcuguuucucgcgccuuucguccugcuggugcuguucuucauauucggcuggaagauccucuucugcuuuaagugcugccgccggacccgagggcuguucaaguaucggcaccugaaagaugacgaggagaccggcuaucgcaagaucaucgagcgccucaacagcaaaaaggggaaaaaucgauugcuggacggcgagcgcuuagccgaucggaagaucgccgagcuguucucuaccaagacgcacaucggcuga

SEQ ID NO: 15236 - RNA, 5067 nt, Artificial Sequence
  derived and/or modified CDS sequence (opt11) from CCHFV(Saf)__KX013487.1__GP
augccuaccaacaucaugcauacccugcuagugugcuucauacuguaucugcagcuucugggccucgggggcgcccacgggcaaagcaacgcuacggagcacaauggcaccaacaccaccacggcuccguccacgagucagucccccaaaccgcuggucucuaccgcgccaccgcaugcccucgaguccagcaccaucaagccuacaacccccgccuccgagaccgaggggagcggcgagaccacgcccccaccgaauaccacccagggacccuccccgcccgagacuacucccgagcgacccgccaccaccgcgaccagcacgcccuccacagacaacacgaacagcaccacgcaugugaccgacaacaacccgacuucgaccaucagcacaucccccucuaguagcccgucaacgcccagcaccccgcaggggauucaucacccugcccggaaccuccuaagcguguccagcccgaagacugccacaaccccgacccccaccucccccggcgagaucagcuccgagacgagcucccugcauagcgccaugucccgcacuagcacccuguacacggcgacccaggucuccacagagaacgcuaaucacagcgcgccccgccaguccgagagcuccgcgcaaccaacaaccacgagcccgaugaccucccccgcccaaaguauccucgugaugagugccgccccuacggcgauacagaacauccacccgagccccaccaacagauccaagcggaaccuagagauggagaucauccugacccuaucacaggggcugaagaaguacuacggcaagauccuuaagcuccugcaccuuacgcucgaggaggacaccgaggggcuguuagaguggugcaaacgcaaccucggcuccaacugcgacgacgacuucuuccaaaagcggauagaggaguucuucaugaccggggagggguacuucaaugaggugcugcaguucaagacacuguccacgcucagccccaccgagcccucccacgcucggccgccuaccgucgaacccuucaaaagcuacuucgccaagggcuuccuguccauugauagcggguacuuuuccgcuaaaugcuaccccaggagcucgacuagcggccuucagcucaucaacgugacgcagcacccggcaagaaucgcugaaacccccggccccaaaaccaccagcuugaagacgauuaacugcaucaaccugagagccagcguguucaaagagcaccgggagaucgagauuaacguucuccugccccaaaucgcaguuaaccucuccaacugucacguggucaucaacucccacgugugcgacuacucccuggacaccgacgguccgguccggcugccccacauccaccacgagggcacguucaucccugggaccuacaagaucguuaucgacaaagaaaacaagcugaacgaccgcugcacgcucgugaccaauugugucaucaaaggcagggaggugaggaagggccagagcgugcuacggcaguacaagaccgagaucaagaucggcaaggcgagcaccgggucccgcaagcugcucagcgaggagcccggggacgauuguaucucccggacccaguuacugaggaccgagaccgccgagauccacgacgacaacuauggcgggccuggcgauaagauuacaaucugcaacggguccacgaucguggaccagcggcucggcucagaacugggcugcuauaccauaaaucgaguuaagagcuucaaacugugugagaacuccgccaccggaaaaaccugcgaaauagacagcacgcccgugaagugccgccagggcuucugccucaagaucacacaggaggggcggggccacgugaaacugucccgcgggagcgaggucgugcuggacgccugcgacuccagcugugaggucaugauccccaaaggcaccggcgacauucugguggacugcuccggcggucagcagcacuaccucaaggacaaucugaucgaccuggggugcccccauaucccgcucuugggcaagauggccaucuacaucugucggaugucgaaccacccccgcaccacaauggcauuccuguucugguucaguuucggcuacgugaucacgugcaucuucugcaaggcccucuucuacagccugaucaucaucggcacgcugggcaagaaaaucaagcaguaccgcgaguuaaagccccagaccugcaccaucugcgaaacggcccccgucaacgccauagacgcagagaugcaugacuugaacugcucuuauaacaucugcccguacugcgccucccgcuuaaccuccgacggucuagcccgucacgugccgcagugccccaagcgcaaggaaaagguggaggagacagagcuauacuuaaaccucgagcgcaucccguggaucguccgcaaauuacuccaggugagcgagucgacagguguggccuuaaagcgguccuccuggcuaaucguccugcucguguugcuaacgguuucgcugucacccguccaguccgcccccguggggcauggcaaaacaauugagacguaccaaacgcgcgagggguucacuagcaucugccuuuucauguugggguccauacucuucuuggugagcugucuggucaagggccuaguggauucggugagcgacuccuuuuuccccggucugagcguaugcaaaacaugcuccaucggcagcauuaacggguuugagaucgaaucucacaagugcuauugcucacucuucugcuguccguacugcaggcacuguuccgcggaccgagagauccaccaacuucaccugucaaucugcaagaagcggaagaccggcucuaacgugaugcuggccgugugcaagcgcaugugcuuccgggccacgauugaggccagccgcagagcccucuugauucgcagcaucaucaacacgaccuucgucaucugcauccuaacccugacuaucugcgugguguccacgagcgcgguagagauggagaaccuucccuccggaaccugggagcgcgaagaggaccugaccaacuucugccaccaagagugccaaguuaccgaaacggagugcuugugccccuacgaggcccugguauuacggaagccccucuuuucagacuccaucgucaaggggaugaagaaccugcugaauagcacaucccucgagaccagcuuguccaucgaggccccguggggcgccaucaacgugcagucaacauucaagcccacggugucgaccgccaacauagcacugagcuggagcucaguugagcaccgcgggaauaagauccucgugaccgggcgguccgaguccauaaugaaacuggaggagcgcacugggguguccugggaccugggcgucgaggacgcuagcgagucuaagcuccugaccgugucgaucauggacuuaagccagauguacucucccguguucgaguaccucagcggcgaccggcagguagaagaauggcccaaggcgaccugcaccggcgacugcccggagcgcuguggcugcaccuccagcaccugucuucauaaggaguggccccacucccggaacuggcgcugcaacccaacauggugcuggggcguggggaccgggugcacguguugcggcguggacgucaaggaccuuuucaccgaccauauguucgugaaauggaaaguggaguacaucaagaccgaggcaaucgucugcguggagcucacuagccaggagcggcagugcagccugaucgaggcaggcacccgcuuuaaccuggggccggucacaaucacgcuaucugaaccacguaauauccagcagaagcugccacccgagaucaucaccuugcaccccaaggucgaggagggguucuucgaucucaugcacgugcagaagguacuguccgccagcacugucugcaagcugcaguccugcacgcacgggauccccggcgacuuacagguguaccauauaggaaaccugcugaagggggaccgggugaacggccaucucauacauaagauugagccccacuucaacacgagcuggauguccugggacggaugugaccuggacuauuacugcaacaugggcgacuggcccagcuguacauauaccggcgucacccaacacaaccacgccgccuucguuaaccugcucaacaucgagacggauuauaugaagaccuuccacuuccauucuaaacgggucaccgcccacggugacacgccccagcuggaccugaaagcgcgcccgaccuacggcgccggggaaaucaccgugcucguggaggucgccgacauggaguugcacaccaagaagguggagaucucaggccuaaaguucgugucccucgcaugcacagggugcuacgccugcagcuccggcauuagcugcaagguccggauacauguggacgaacccgaugagcugacuguacacgucaagagcagugacccagacgugguggcggcgagcaccucccucauggccagaaagcucgaguucgggaccgacagcacguucaaggcuuuuuccgcuaugcccaagacgucacuguguuuuuacaucgucgaaagggaguacuguaaguccugcagcgaagaggacacccagaagugcguggauacuaaacuggaacagccgcaauccauauuaaucgagcacaaggguaccauuaucggcaaacagaacgacacgugcaccgcaaaagccagcugcuggcuggaguccgucaaaaguuucuuuuaugggcugaagaacaugcugggauccguauuugggaacuucuucauuggcauacugcuguuccucgcccccuucgugcugcuggugcuguucuucauguucggcuggaagauucucuucugcuucaagugcugccgccgaacccgcggccugcugaaguaccggcaccucaaggacgacgaggaaaccggcuaccgccgcauaaucgaacggcuaaacaacaaaaagggcaagaaccgcuuacucgacggugagcggcuugccgaccgcaagauugcggagcuguucagcacgaagacccacauuggguga

SEQ ID NO: 15237 - RNA, 5067 nt, Artificial Sequence
  derived and/or modified CDS sequence (opt11) from CCHFV(Min)__KX013481.1__GP
augccgacuaacaucaugcacacgcugcucgugugcuucauccuguaccugcagcuccugggccuugggggcgcccacggacaaagcaacgccacggagcacaacggcaccaacaccaccacggcgccguccaccagccagucccccaagccccucgucagcaccgcgcccccgcacgcccuggaguccagcaccauuaagcccacgacccccgccuccgagaccgaggggagcggcgagaccacgcccccgcccaacaccacccagggccccuccccgcccgagaccacgcccgagcgccccgccaccaccgccaccagcacgcccuccaccgacaacaccaacagcaccacgcacgugaccgacaacaacccgaccuccaccaucucuacgucgcccagcuccagccccuccacccccagcaccccgcaggggauccaccaccccgcccguaaccuguugagcguguccagccugaagacggccacgacccccacccccaccuccccgggcgagaucagcuccgagacgagcucccugcacagcgccaugucccgcaccagcacccucuacaccgcgacccaggucuccacggagaacgcaaaccauagcgcgccccggcaguccgaaagcuccgcccagcccaccaccaccagccccaugacguccccggcccaaagcauccugguaauguccgccgcccccaucgccauccagaacauccaccccagcccgaccaaccgcucaaaacggaaccuggagauggagauaauccucacccugucccaggggcugaagaaguacuacggcaagauccucaagcugcugcaccucacccuggaggaggacacggaggggcugcucgaguggugcaagcgcaaccuuggcagcaacugcgacgacgacuucuuccagaagcggaucgaggaguucuucaugaccggcgagggguacuucaacgaggugcugcaguucaagacccucuccacccugagcccuacggagccaucccacgcccggcccccgaccgucgagcccuucaagagcuacuucgccaagggcuuccuguccaucgacagcggguacuucuccgcgaaguguuacccccgcagcuccaccagcggccugcagcugaucaacgugacccagcaccccgcccgcaucgccgagacgccgggccccaagaccaccagucuuaagaccaucaacugcaucaaccuccgggccagcgucuucaaggagcaccgcgagaucgagaucaacguccugcugccccagaucgccgugaaccucuccaacugccacgugguaauaaacagccacgugugcgacuauucccuggacacggacgggcccgugcggcugccgcacaucuaccacgagggcaccuucauccccgggaccuacaagaucgucaucgacaagaagaacaagcucaacgaccgcugcacccuggugacgaacugcgugauuaagggccgggagguccgcaaggggcagagcgugcugcggcaguacaagaccgagaucaagaucggcaaggcgagcaccggcucucgcaagcucuugagcgaggagcccggggacgacugcaucucccggacccagcugcuccgcacggagaccgccgagauccacgacgacaacuacggcgggcccggcgacaagaucacgaucugcaacgggagcaccauuguggaccagcggcugggcuccgagcugggcugcuacacgaucaaccgcgucaagagcuucaagcucugcgagaacuccgccaccggcaagaccugcgagaucgacagcaccccggucaagugccgccagggcuucugccugaagaucacgcaggaggggcggggccaugugaagcugucccgcgggagcgaggucgugcuggacgccugcgacuccagcugcgaggucaugauccccaagggcaccggcgacauccucguggacugcuccgggggccagcagcacuuccugaaggacaaccugaucgaccucgggugcccccacaucccccugcugggcaagauggccaucuacaucugccggaugagcaaccacccgcgcaccaccauggcguuccucuucugguuuucuuucggcuacgugauaaccugcaucuucugcaaggcccuguucuauagccucaucaucaucggcacgcucggcaagaagaucaagcaguaucgggagcugaaaccccagaccugcaccaucugcgagaccgcccccgucaacgccaucgacgcggagaugcacgaccugaacugcuccuacaacauuugccccuacugcgccagccgccucacguccgacgggcuggcacggcacgugccgcagugccccaagcgcaaggagaaaguggaggagaccgagcuguaccucaaccuggagcggauccccuggaucguccgcaagcugcuccaggugagcgagagcaccggcguggcccugaagcgguccagcuggcugaucguccuccuggugcugcucaccgugucccugagcccgguccaguccgcccccguggggcacggcaagacgauagagaccuaccagacccgcgaggguuucaccagcaucugccuguucaugcucggguccauccuguuucuggugagcugccucgucaagggccugguggacuccgugucugacuccuucuuccccgggcugagcgucugcaagacgugcaccaucggcuccaucaacggguuugagaucgagagccacaagugcuacugcucccucuucugcugucccuacugccggcacugcagcgcggaccgcgagauccaccagcugcaccuguccaucugcaagaagcggaagaccggcagcaacgugaugcucgccgugugcaagcgcaugugcuucagagccaccaucgaggcgucccgccgggcccugcugauccgcagcaucaucaacacgaccuucgucaucuguauccucacccugaccaucugcguggugagcacauccgcggucgagauggagaaccugccgagcggcaccugggaacgcgaggaggaccuaaccaacuucugccaccaggagugccaggugaccgagacggagugccugugccccuacgaggcccugguguugcggaagccccuguuccuggacuccaucgucaaggggaccaaaaaccuccugaacagcaccagccuggagaccagccucuccaucgaggcccccuggggcgccaucaacgugcagagcacguucaagccgaccguguccaccgccaacaucgcgcugagcugguccagcgucgagcaccgugggaacaagauccuggugaccggccgguccgagucgaucaugaagcucgaggagcgcacggggguguccugggaccugggggucgaggaugccagcgaguccaagcugcucaccgugagcaucauggaccugucccagauguacagccccguguucgaguaccugucuggcgaccgucaggucgaggaguggcccaaggcgaccugcaccggggacugccccgagcgcugcgggugcaccuccagcacgugccuccacaaggaguggccgcacucccggaacuggcgcugcaaccccaccuggugcuggggcguggggaccggguguaccugcugcgguguggacgucaaggaucuguucaccgaccacauguucgugaaguggaaggucgaguacaucaagaccgaggccauagucugcguggagcugaccagccaggagcggcagugcucccucaucgaggccggcacccgcuucaaccuggggccagugacgaucacccugagcgagccccggaacauccagcagaagcucccgcccgagauuaucacgcugcaccccaaggucgaggagggcuucuucgaccugaugcacgugcagaaggugcucucagccucuaccgucugcaagcugcaguccugcacgcacgggauccccggcgaccugcagguuuaccacaucggcaaccuccugaagggugacagaaucaacggccaccugauccacaagaucgagccgcacuucaacaccagcuggaugucuugggacgggugcgaccucgacuauuacugcaacaugggcgacuggcccagcugcaccuacaccggggugacgcagcacaaccacgccgccuucgucaaccugcucaacaucgagaccgacuacaccaagaccuuccauuuccacuccaagcgggugacggcacacggcgacacgccccagcucgaccuuaaagcgcgccccaccuacggugccggggagaucaccguccugguggagguggccgacauggagcuccacaccaagaaggucgagaucagcggccugaaguucgccucccuggccugcaccgggugcuacgcgugcagcuccggcaucagcugcaaggugcggauccacguagacgagccggacgagcucaccguccacgugaaguccagcgaccccgacguggucgccgccagcaccucccugauggcccgcaagcuggaguucgggacggacagcaccuucaaggccuucuccgcgaugcccaagaccagccucugcuucuacaucguggaacgggaguacugcaaguccugcagcgaggaggacacccagaaguguguggacacgaagcuggagcaaccccaguccauccugaucgaacacaagggcaccaucaucggcaagcagaacgauaccugcaccgccaaagccagcuguuggcucgaguccgucaagagcuucuucuacgggcugaagaacaugcugggcuccguguucggcaacuuuuucaucggcauccuccuguuccuggccccguucgugcugcucguccuguucuucauguucggguggaagauccuguucugcuucaagugcugccgccggacgcgcggccuccugaaguaccggcaccugaaggacgacgaggagaccggcuaccggcgcaucaucgaacggcucaacaacaagaaggggaagaaccgccugcuggacggcgagcggcucgcggaccgcaagaucgccgaacuguucagcaccaagacccacaucggguga

SEQ ID NO: 15238 - RNA, 5067 nt, Artificial Sequence
  derived and/or modified CDS sequence (opt11) from CCHFV(Mamon)__KX013478.1__GP
augccgacaaacauaaugcacacccugcucgugugcuucauuuuauaccugcaacugcugggccucgggggcgcccacgggcaaagcaacacgaccgagcacaacggcaccaacaccacgaccgcgcccuccacgagccaguccccgaagccucuggucagcaccgcgcccccgcacgcccuagaguccagcacgaucaagcccacaaccccagcuuccgagaccgaggggaguggcgagaccacgcccccacccaacaucacccagggccccuccccgcccgagacuacuccggagcgccccgcaaccaccgccaccagcacgcccuccaccgacaacaccaacuccacgacgcacgucaccgacaacaacccaaccuccaccaucagcacgucccccagcuccagcccuuccacccccaguaccccacaggggauccaccaccccgcgcgcaacuugcucagcguguccucacccaaaaccgcuacgacccccaccccgaccucccccggcgagauuucuucgaagacgagcucccugcacagcgccaugucccgcaccagcacccuguacaccgccacacaagucuccacggagaaugcgaaccacagcgcgccccgccagucggaauccuccgcccaacccaccaccaccagcccaaugacgucgcccgcccagagcauccucgugauguccgccgcgcccaccgccauccagaacauccacccgagcccaaccaaccgcagcaagcggaaccuggagauggagaucauccugacccucucccaaggguugaagaaguacuacggcaagauucugaagcuccugcaccugacgcuugaggaggacaccgagggacugcuggaauggugcaagcgcaaccucggcagcaacugcgacgacgacuucuuccagaagcggaucgaggaguucuucaugaccggcgagggguacuucaacgaggugcugcaguucaagacacuguccacgcucagccccaccgagcccucgcacgcccgcccacccaccgucgagcccuucaagagcuacuucgccaagggcuuccuguccauagacagcggguacuucuccgccaagugcuacccccggagcucaaccagcggccugcagcugaucaacgugacgcagcacccugcucgcaucgccgagacccccgggcccaagaccaccucucugaagacgaucaacuguaucaacuuacgagccagcguguucaaggagcaccgcgagaucgagaucaacguccuccugccccagaucgccgugaaucuguccaacugucacguugucaucaacagccaugugugcgacuacagccucgacaccgacgggccugugcggcugccccacaucuaccacgagggcaccuucauucccgggaccuacaagaucgucaucgacaagaagaacaagcugaacgacaggugcacgcucguuaccaacugcgugauaaagggccgggagguacgcaaggggcaaagcgugcugcggcaguacaagaccgagaucaagaucggcaaggccagcaccggcucucgcaagcugcucagcgaggagccgggagaugacugcauuucccggacgcagcugcuccgcacagagaccgccgagauccacgacgacaauuacggcgggccgggcgacaaaaucaccaucugcaacgggagcacgaucguagaucagcggcucggcuccgagcugggcugcuacaccaucaaccgcgucaagagcuuuaagcuaugcgaaaacagcgcuaccggcaagaccugcgagaucgauagcacgccuguaaagugccgccagggcuuuugccucaagaucacccaggaggggaggggccacgugaagcugucccgcgggagcgaggucgugucagacgccugcgacagcuccugcgaaguuaugaucccuaaaggcaccggcgacauccugguugauugcagcgguggacagcagcacuuccuaaaggauaaccucauagaccugggcugcccccacaucccacugcucggcaagauggccaucuacaucugcagaauguccaaccacccccgcaccaccguggccuuccuuuucugguucagcuucggcuacgugauaacgugcaucuuuugcaaggcgcuguucuacagucuuaucaucaucgggacacugggcaagaagaucaagcaguaccgggagcuaaagccccagaccugcaccaucugcgagacggcccccgugaacgcgauagacgccgaaaugcacgaccucaacugcagcuacaacaucuguccguauugcgcgucccgccugaccagcgacgggcuggcccggcacgugccccagugccccaagcgcaaggagaaggucgaggagacggagcucuaccugaaccuggagcggaucccguggaucgugcgcaaacuucuccagguguccgaguccaccggggucgcucugaagcguucgagcuggcugaucguacugcuggugcuucugacggucucgcugucccccguccagagcgcccccguggggcacggcaagaccaucgagacuuaucagacccgcgaaggcuucacguccauuugccucuucaugcuggggagcauccuguuccucgucagcugccugguaaagggccuaguagacagcguguccgacagcuuuuuccccgggcucuccgugugcaagaccugcagcaucggcucuaucaacggguucgaaaucgagagccacaagugcuacugcucccuguucugcugucccuauugccggcacugcagcgccgaccgcgagauccaccagcugcaccucuccaucugcaagaagcggaagaccggcucaaacgugauguuagccgucugcaagcgcauguguuucagagccaccauagaggccagccgucgggcccuacucauacgcuccaucaucaacacuaccuucgugaucugcauccugacccuaaccaucugcguggugagcacguccgccguggagauggagaaucucccaagcggaaccugggaacgcgaggaggaccugaccaacuucugccaccaggagugccaggugacggagacggagugucugugccccuacgaggcguuggucuugcggaagccccuguuucucgacuccauagugaaggggaugaagaaccugcugaacagcaccuccuuggagaccagccuguccaucgaggccccauggggcgccaucaacgugcaaagcaccuucaagcccacggucuccacugcuaauaucgcccuaagcugguccagcguggagcaccgcgggaacaagauauuaguuaccggccgguccgagucaaucaugaaauuagaggagcgcaccggggucucaugggaccugggcgucgaagacgccagcgaguccaagcuccugacggucagcaucauggaucugagccagauguacaguccagucuucgaguaccucagcggcgacagacagguggaggaauggcccaaagcuaccugcaccggggacugcccggagcggugcggcugcaccuccagcacgugccugcacaaggaguggccccauucccggaauuggcgcugcaaccccaccuggugcuggggcguggggaccgggugcacgugcugcggcgucgacgugaaggaccuguuuaccgaccacauguucgugaaauggaaagucgaguacauaaagaccgaggccaucgugugcguggagcucaccagccaggagcggcagugcucgcugauagaggcagggacacgauucaaccuagggcccguaaccaucacgcucagcgagccgcggaacauccagcagaagcugccgcccgagauuaucacucuucaccccaagguggaggagggcuucuuugaccucaugcacguccagaagguccuguccgccagcacagugugcaaacugcaguccugcacccacgggauacccggggaccuccagguguaucacauaggcaaccugcugaagggggaucgcgucaacggccaccucauccacaagauugaaccccacuucaacacgagcuggauguccugggacgggugugaccucgacuacuacugcaacaugggcgacuggccaaguuguacguacaccggggugacccagcacaaccacgccgccuucgucaaccugcugaauaucgaaacggacuacaccaagaccuuccacuuccacuccaagcgggugaccgcccacggcgacacgccacaguuagaucugaaggcccgcccgacguacggcgcgggggagaucaccgugcucgucgagguggccgauauggagcugcacaccaagaagguggagaucagcggccugaaauucgccucccucgccugcacggggugcuacgccugcagcuccggcaucagcugcaagguccggauccacguggacgagcccgacgagcugacagugcacguuaagucuuccgaccccgacgugguggcggccagcaccucccuaauggcccgcaagcucgaguucgggaccgacagcacguucaaggccuuuuccgccaugcccaagaccagccugugcuucuacaucgucgagcgggaguacugcaaaucauguagcgaggaggauacgcagaagugcguggacaccaagcuggagcagccgcaguccauacucaucgagcacaagggcacgauaaucggaaaacagaacgacacguguaccgcgaaaaccagcugcuggcuggagagugucaagagcuucuucuacgggcugaaaaacaugcucggcucuguguucgggaacuucuuuaucggaauauugcucuuucucgcccccuuugugcugcuagugcuguucuucauguucggguggaagauccucuuuuguuucaagugcugcaggcggacacgcggccugcugaaauacagacaccucaaggacgacgaagagacuggcuaccgccgcaucauugagcggcugaacaacaagaagggaaagaaucgccuuuuagacggcgagcgacuggccgacagaaagauugccgagcuguucagcaccaagacccacauaggguga

SEQ ID NO: 15239 - RNA, 5067 nt, Artificial Sequence
  derived and/or modified CDS sequence (opt11) from CCHFV(K340_6)__KX013475.1__GP
augcccaucaacaucaugcacacccugcucgucugcuucaucuuguaccugcaguuaagcggcuuagggggcgcucacguccaauccaacgcgacugagcauaacgggacgaacaccaccacugcgccgggcacuagccagucccccaagccgcccgccagcaccacucugccacacacccccgaguccagcaccguuaagcccacgacccccaccuccgaaacugaggggagcggcgagaccaccccgccgccuaauaccacccagggccucccgcccaccgguaccacgccugagcgcagcgcaacgaccgccaccagcaccuccuccacggacaauaugaacuccaccacccaggugaccgacagcacgcccacuuccacggucagcaccucccccagcuccucgaguuccaugcccagcacgucccagggcauccaccaucccguacgaagccugcuguccgugagcucccccaagaccgucaccacccccacgccgaugagcccgggggagauguccccugagaccagcucccagcacagcgccaugucccgugugcccacccucuauaccgcgacucaggugagcacggagaacaccgaccgguccaccccucgacagagcgaguccagcguccagccagccacccagucaccuauuacuagcccagcccagacgauccugcugaugagcgccgcgccgaaggccauccaggacaugcaccccucccccaccaaucggagcaaacgcaaucuggagguggagaucauccugacccugagucagggccucaagaaguacuacgggaagauccugaagcugcuccaccugacacuggaggaggacacggagggccuguuagaguggugcaaacggaaccugggcagcaacugcgacgacgacuucuuccagaagcgcaucgaggaguuuuucaucaccggggagggcuacuucaacgagguucuccaguucaaaacccuguccacgcugagcccgacggagcccucccacguucggcuccccaccgccgagcccuucaagagcuacuucgccaagggguuccugucuaucgacagcggcuacuucuccgccaaaugcuacccgcgcucauccaccagcggccuccagcucaucaacgugacacagcaccccgcgcggaucgcagagaccccugggcccaagaccaccucccuaaagaccaucaacugcaucaaccugcgugccucaguguuuaaggagcaccgggaggucgagaucaacgugcuccugccacagauugccgugaaccuguccaacugccacgucgugaucaacagccacgugugcgacuacucacucgauaccgacggccccgucagacugccccggauccaccacgagggaaccuucauucccggcacuuacaagauaguuauagaccgcaagaacaaguugaaugaccggugcucccucgugacaaacugugucaucaaggggcgcgagguacggaagggccagagcguccugcgccaguacaagaccgagauaaagaucggcaaggccuccaccgggagccggaaacugcucuccgaggagccuggcgacgauugcauuagccgcacacagcugcugaagacggaaaccgcggagauccacgacgacaacuacgggggccccggggacaagaucaccauuugcaacggcuccaccaucguggaccagcgccucggcucugagcuggggugcuacacaaucaaccgggugaaguccuucaagcugugcgagaacagcaccacaggcaagaccugcgagaucgacuccacgccagucaagugccgccagggguucugccucaagaucacccaggagggcagggggcacguuaagcucagccgcggcucagaggugguccuggaugccugcgacagcuccugcgagaucaugauccccaaaggcaccggggacauccugguggauugcagcggcgggcagcagcacuuccucaaggacaaucugaucgaccuaggcugcccgcacaucccaccccucgguaagauggccaucuacaucugcaggauguccaaccacccacgcaccaccauggccuuucuguucugguucagcuucggguacgugaucacgugcaucuucugcaaggcucuguucuacuccuuaaucauaaucggcacccuggggaagaagauaaagcaguaccgggagcugaagccccagaccugcacgaucugcgagacggcgccggucaacgcgaucgaugccgagaugcacgaccucaacugcagcuacaauaucugucccuauugcgccagccgcuuaaccuccgacggccuggcccggcacguuacccagugcccaaagcgcaaagagaaaguggaggagaccgaacucuaccugaaccuggagcggaucccguggaucguccgcaagcuccuccaggugagcgaguccacggggguggcccugaagcggagcuccuggcugauagucuugcuggugcuccuaaccgugagccugucccccguccagagcgcccccgugggccacggcaagacaaucgaaacuuaccagacgcgcgaaggauucaccuccaucugccucuucauguuaggcucuauccuuuucaucgugaguugccuagucaaggggcuuguggacagcguguccgauagcuuuuucccaggccugucggucugcaaaacaugcagcaucggguccaucaacggcuucgagaucgagagccacaagugcuacugcucucucuucugcugccccuacugccggcauuguagcgccgaccgcgagauccaccagcugcaccugagcauuugcaagaagcggaaaaccggcuccaacgucaugcucgccguaugcaagcgcaugugcuucaaggcgacgaucgaggccagccggcgugcccuucugauccgauccaucaucaacacuaccuucgucaugugcauccucacccuggccaucugcguagucagcacuucggccgucgagauggaggaccuacccgcugguaccugggagcgggaggaggaccucaccaacuucugccaccaagagugccaggugaccgagacggagugccuuugcccguaugaggcccugguacuccgcaagccgcugucucuggacagcaucgucaagggcaugaagaaccuccugaacucaaccucccuggagacgucucuuuccaucgaggccccauggggcgccaucaacgugcagagcaccuucaagcccacgguguccaccgccaacaucgcgcugagcuggucuagcgucgaacacagggggaacaagauccuggugaccggucgcuccgagagcaucaugaagcucgaggagcggaccggcguguccugggauuuaggcgucgaggacgccucggaaagcaagcugcucacgguguccaucauggaccugagccagauguacucccccguguucgaguaccuuagcggggaccgucagguagaggaguggccgaaggcgaccugcaccggcgacugccccgagcgcugcgggugcaccuccagcacgugccuccacaaggaguggccccacucccgcaacuggcgguguaaccccaccuggugcuggggcguggggacuggcugcacgugcugcggcguggacgucaaggaccuguucaccgaccacauguucaucaaguggaagguugaguauaucaagacggaggccauugugugcgucgagcucacuagccaagagcgccagugcucccucaucgaagccgggacccgguucaaccucggcccggugaccaucacccugagcgagccccguaacauccagcagaaacuuccucccgagaucaucaccuuacacccaaagaucgaggagggcuucuucgaccugaugcacgugcagaagguccucuccgccagcaccgugugcaagcugcagucgugcacccacggcauccccggcgaccugcagaucuaccacaucgggaaccuccugaagggcgaccgugucaacgggcaccugauccacaagaucgagccccacuucaacacgagcuggauguccugggacggcugcgaccucgacuacuacugcaacaugggugacuggccgagcugcaccuacaccggugucacccagcacaaccacgcggccuuugugaaccugcugaacauagagacggacuacaccaagaccuuccacuuccacuccaagcgcguaaccgcacacggcgacacgccgcagcuagaccugaaggcgaggcccacuuacggggccggcgagauaaccgugcugguugaggucaccgacauggagcuccacacgaagaagguggagaucuccggccugaaguucgccucccugaccugcacgggauguuaugccugcagcagcgggauauccugcaaagugcgcauccacgucgacgagcccgacgagcuaaccgugcacgucaagagcuccgaucccgacgugguggccgcgagcacgucccugauggcccggaagcuggaguuuggcaccgacagcacguucaaggccuucuccgccaugccuaaaaccucacucugcuucuauaucguggagcgcgaguacugcaagagcugcagcgaggacgacacgaagaagugcgucgacaccaagcuggaacagccccaguccauccucauagagcacaagggcaccaucauagggaagcagaacgacacgugcaccgccaaggcuucaugcuggcucgaguccgucaagagcuucuucuacggccucaagaacaugcugggguccguguucggcucuuucuucguggggauccuccuguuccuggcccccuucgugcuccuuguucuuuucuucauguucggcuggaagauccuguucugcuucaagugcugccggcgcacaagaggccucuucaaguaccgccacuucaaggacgacgaggaaaccggcuaccgccggaucaucgagcgccuuaacuccaaaaagggaaagaaccgguuacucgacggggagcgccuggccgaucggaagaucgccgagcuguucagcaccaagacacacaucgguuga

SEQ ID NO: 15240 - RNA, 5067 nt, Artificial Sequence
  derived and/or modified CDS sequence (opt11) from CCHFV(K323_27)__KX013472.1__GP
augcccauaaacaucaugcacacgcugcucgugugcuucaucuuauaccugcagcucagcggccucgggggcgcccacgggcaguccaacgccaccgagcacaacggcacgaacaccaccaccgucccggggacuucccagucucccaagccacccgcgagcaccacccugccccacacccccgaauccagcacggugaagcucaccacccccacuuccgagacggaaggcagcggcgagaccacgcccccgcccaacaccacacagggacugccccugcccggcaccaccccggagcgcuccgccaccacggccaccagcaccuccagcaccgacaacaugaacuccacuacccaggugacagacaacacccccacgagcacugucuccauuagccccuccagcucccccagcaugcccagcaccucccaggggauccaccaccccgugcggagccuccuguccgugagcucccccaagaccgucacgacccccaccccgaugagccccggcgagaugucgcccgagaccagcucccagcacagcgccaugagccgcauccccacgcuguacaccgccacccaggugagcaccgagaacaccgaccgguccacgccacgccagagcgaguccuccgugcagcccgcgacacagucccccaucacgagccccgcccagaccauccuccugauguccgcggccccgaaggcgauccaggacaugcauccgagcccuacgaaccgguccaagcgcaacuuggaggucgaaaucauccugacccugucacaggggcugaagaaguacuauggaaagauucucaagcugcugcaccucacccuggaggaggauaccgagggcuugcucgaauggugcaagcggaaccuggggagcaacugcgacgacgacuucuuccagaagcgcaucgaggaguucuucaucacgggcgagggguauuucaacgaggugcugcaguucaagacccucuccacccugagcccgaccgagagcucgcacgugcggcugcccacggcagagcccuucaaguccuacuucgccaagggcuuccuaagcaucgacuccgguuacuucagcgccaagugcuacccccgcuccagcaccuccggccugcagcugauuaacgucacgcagcacccggcccggaucgcggagacucccggccccaagacgaccagccucaagaccaucaacugcaucaaccugcgcgcguccguguucaaggagcaccgggagguggaaaucaacgugcugcucccccaaaucgcggugaaccugagcaacugccacguggucaucuccagccacgugugcgacuacucucucgacaccgacggaccggugcgccucccccggauccaccacgagggcaccuucauccccgggaccuacaagaucgucaucgaccgcaaggacaagcugaaugaccggugcucgcuggugaccaacugcguaaucaagggacgcgagguccggaaggggcaguccgugcuccgccaguacaagaccgagaucaagauagggaaggccucuacgggcagccggaaacuucuguccgaggagccaggggacgacugcaucagccgcacccagcuccugaagaccgaaaccgccgagauccacgacgacaauuauggcgguccgggcgacaagaucacgaucugcaacggcuccaccaucguggaccagcgccucgggagcgagcucggcugcuacaccaucaaccgggugaaguccuucaagcugugcgagaauagcgcgacugggaagacgugcgagauagacuccacccccgugaagugccgccagggcuucugccugaagaucacgcaggaggggcggggacacgucaaacuuagcaggggcucggaggugguccuugacgccugcgacagcuccugcgagaucaugauccccaagggcaccggcgacauccuggucgacugcuccgggggccagcagcacuuccugaaggacaaccucaucgaccugggguguccccacaucccgcugcucgggaagauggccauuuauaucugccggauguccaaccacccccgcacgaccauggccuuccuguucugguucagcuucggcuacgugaucacgugcauauucugcaaggcacuguucuaccuccugauuauaaucgggacccuggggaagaagaucaagcaguaccgggagcucaagccccaaaccugcaccaucugcgagaccgcgcccgugaacgccaucgacgccgaaaugcacgaccugaacugcuccuacaacaucugcccguacugcgccucccgccugaccagcgaugggcuggcccggcacgucacucagugucccaagcgcaaggagaagguggaggagacggagcuguaccugaaccucgaacggauccccuggaucgugcgcaagcugcugcaggucuccgagagcaccggcguggcgcucaagcgguccagcuggcugacugugcucuugguccugcugaccgugucccucagcccugugcaguccgccccggucggccacgggaacacgaucgagacuuaccagaccagagagggcuuuaccagcaucugccuguucauguuggggucaauccucuucaucgugagcugcuuggugaagggccuggucgacuccgugagcgacuccuucuuccccgggcucagcgugugcaagacgugcuccaucggcucuaucaacggcuuugagaucgagucccacaagugcuacugcagccuguucugcuguccccacugccggcaccgcuccgcagaccgggagauacaccagcugcaccucagcaucugcaagaagcgcaagacggggagcaacgucaugcuggcaguaugcaagcgaaugugcccgaaagcgaccaucgaggccucccgucgugcccuucccauccggagcaucauaaacacaacgcuugucauguguaucuugacccuggccaucugcgucguguccaccagcgccguugagauggaagaccuccccgcgggcaccugggagcgcgaggaggaccugacgaacuucugccaccaggagugccaggucaccgagaccgagugccuguguccauacgaggcccugguguuacggaagccgcuguuccucgacuccaucgccaaggggaugaagaaucugcugaacagcaccagucucgagacgagccuguccaucgaggcgcccuggggugccaucaacgugcagagcaccuucaagccaacagucuccaccgcgaacaucgcgcugucuugguccagcguggagcaccgcgggaacaagaucuuaguaacgggccgguccgaguccaucaugaagcucgaggaacgcaccggcgucuccugggaccuggggguggaggacgcaucugagaguaagcuccuaaccgugagcaucauggaccugagccagauguacucccccgucuucgaguaccucagcggcgaccgccagguugaggaguggccgaaggcgaccugcacgggggacugcccagagcggugcggcugcaccuccagcacgugccugcacaaggaguggccccacucccggaacuggcgcugcaacccaaccuggugcuggggcguagggaccggcugcacgugcugcggggucgacgugaaggaccuguucaccgaccacauguucaucaaguggaagguggaguacaucaagacugaggcaaucgucugcguggagcucaccggccaggagagacagugcagccucaucgaggccgggacccgcuuuaacuuaggcccggugaccaucacacucuccgagccccguaacauccagcaaaagcugccgccggagaucauaacccugcaccccaagaucgaggaaggcuucuucgaccugaugcacguccagaaggugcugagcgcguccaccgugugcaagcugcagagcugcacccacggaauccccggcgaccuccagaucuaccacauugggaaccugcugaagggagaccgcgucaacgggcaccucauccacaagaucgagccccacuucaacacauccuggaugagcugggacgguugcgaccuggacuacuacuguaacaugggcgacuggcccuccugcaccuacacgggugugacccagcacaaccacgccgccuuugucaaccugcucaacaucgagaccgacuauaccaagacguuccacuuccacagcaagcgggugaccgcgcacggcgauaccccgcagcuggaccugaaggcccgcccuaccuacggggccggcgagaucacggugcucgucgagguggccgacauggagcugcacaccaagaagguggagaucuccgggcugaaguuugccagccugaccugcaccggcuguuaugcgugcuccagcggcaucuccugcaagguccggauccacguggacgagccugacgagcugacggugcacguaaagagcagcgaccccgacgugguggccgccuccaccagccugauggcccgcaagcucgaguucgggaccgacuccacuuucaaagccuucagcgcgaugccgaagacgucccugugcuucuacaucgucgaacgggaguacugcaagagcugcuccgaggacgacacuaagaaguguguggacacaaagcuggagcagccacagagcauucucaucgagcacaagggcaccaucaucgggaagcagaacgacacgugcaccgccaaggcguccugcuggcuggaguccgugaaguccuucuucuacggccugaaaaacaugcucgggagcgucuuuggcuccuucuucguggguauccugcuguucuuagcccccuucgugcuccugguacuguucuucauguucggguggaagauccucuucugcuucaagugcugccgccgaacgagaggccuguucaaguaccgccaccugaacgacgacgaggagaccgguuacaggcgcaucaucgagcggcucaacagcaagaagggcaagaaccgccuccuggacggcgagcggcucgcagaucgcaagaucgcggagcuguucaguacgaagacccacaucggguga

SEQ ID NO: 15241 - RNA, 5067 nt, Artificial Sequence
  derived and/or modified CDS sequence (opt11) from CCHFV(K315_14)__KX013469.1__GP
augcccuucaacauaaugcacacccugcucgugugcuucauccuguaccugcagcugucaggccugggcggcgcccacggucaauccaacgagaccgagcacaacggcacgaacacuacgacgguuccggggacuagccaaucccccaaaccacccgccagcaccacccugcagcacacuccggaguccagcacggucaagcugaccacccccaccuccgagacggagggcagcggcgaaaccaccccgccgcccaauacgacgcaggggcugcccccucccggcaccacccccgagcgcucagcgaccacggccaccuccaccuccagcaccgacaacaugaacuccacgacacaggugaccgacaauacccccacaagcaccgucuccauaagccccuccagcucccccagcaugcccaguaccucccaggggauccacuaccccauccggucucugcucagcgugagcucgcccaagaccgugacgacccccacuccgaucagccccggugaaaugucccccgagaccagcucccagcacagcgccaugucccgcaucccuacgcuguacaccgccacccaggucagcaccgagaacaccaaccgguccacgccgcgccagagcgaguccagcgugcaacccgccacccagucccccaucaccagccccgcacagaccauccuccugauguccgccgccccgaaggccauccaggauaugcaccccucgcccacgaaccggagcaagcgcaaccuggagguggagaucauccuaacccuaucccaggggcugaagaaguacuacggcaagauacugaagcuccugcaccugacccucgaggaggacacugagggacugcuggaguggugcaagcggaacuuagggagcaacugcgacgacgacuucuuccagaagcgcaucgaggaguucuucaucacgggcgaaggguauuucaacgagguuuugcaguucaaaacauugucgacccucagcccgaccgagcccagccacguccggcuacccacggcggagcccuucaagucauacuucgccaagggcuuccuaucaaucgacagcggcuacuucuccgccaagugcuacccccgcagcuccacuagcgggcuccagcucaucaacgugacccagcaccccgccagaaucgcagagacccccggccccaagacaaccucccugaagaccaucaacugcaucaauuuacgcgcgagcguguucaaggagcaccgggagguggagaucaacgugcugcugccgcagaucgccgucaaccucuccaacugccacguggugaucaacagccacgucugcgacuacucacuggauaccgacgggccugugcgccugccccggauccaucacgagggcaccuucauuccugggaccuacaaaaucgucaucgacaaaaagaacaagcucaacgaccguugcagccugguuacgaacugcgugaucaagggccgagaggugcgcaagggccagagcguccuaaggcaguacaaaaccgagauccgcaucggcaaggccuccacggggagccggaagcuccuguccgaggagccgggggacgacugcaucagccgcacccagcugcugaagaccgagaccgccgagauccacgacgacaacuauggcgggcccggcgacaagaucaccaucugcaacggcuccacgguggucgaccagcgccuggggagcgagcugggcugcuacacaaucaaccgggugaagaguuucaagcucuguaagaacagcgccaccgggaagacaugcgagaucgacuccaccccuguuaagugccggcagggcuucugccugaagaucacccaagaggggaggggccacgucaagcugagccguggcuccgagguagugcuggacgucugcgacagcuccugcgagaucaugaucccgaaagggaccggcgacaucuuaguggacugcagcgggggccagcagcacuuccucaaggacaaccugaucgaccucggcugcccgcauaucccccuguuagggaagauggcgaucuacaucugccggauguccaaccacccacgcacgaccauggccuuccucuucugguucagcuucggcuacgugauaaccugcaucuucugcaaagcucuguucuauucccuaaucaucaucgggacacucgggaagaagaucaagcaauaccgggaguuaaagccccagaccugcacgaucugcgagacagccccgguaaaugccaucgacgcugagaugcacgaccugaacugcucguacaacaucugucccuacugcgccagccgcuugaccagcgaggggcuggcgcggcacgugacccagugcccgaagcgcaaggaaaagguggaggagacggaguuguaccucaaccuggaacggauccccuggaucgugcgcaaguugcuccaggugagcgaguccaccggcguggcccugaagcggagcuccuggcugaucguccuccuggugcuguuaaccgucagccugucccccguccagagcgccccagugggccacgguaagaccaucgagacguaccaaacccgcgaaggcuucacguccaucugccuguucaugcugggaagcauucuguucaucguguccugccugguaaagggccucguguacagcguauccgacagcuucuucccagggcuuuccguuuguaagaccugcucaauaggcuccaucaacggcuucgagaucgaaagccauaagugcuacuguucccuguucugcugcccguacugccggcacugcagcgcggaccgagaaauccaccagcuccaccuguccaucugcaagaagcggaagacggguagcaacgugaugcuggccgugugcaagaggaugugcuucaaagccaccaucgaggccagccggagagcucuccugauccgcaguaucaucaacaccaccuucgugaucugcauccugacgcucgccaucugcguagugaguaccuccgcggucgagauggaggaccugccagccgggaccugggagcgggaggaggaccugaccaacuucugccaccaggagugccaggugacggagaccgaaugccuaugccccuacgaggcacuggugcugcgcaagccccucuuccuggacagcaucgucaaggggaugaagaaacugcugaacagcaccagccuggagacaucccugagcauugaggcaccguggggagccaucaaugugcaguccaccuuuaagcccacuguaagcaccgccaacaucgcucucuccuggagcuccgucgagcaccgggggaauaagauccugguaacgggccguagcgagagcaucaugaagcuggaggaacggacgggcgugagcugggaccucggggucgaggacgccuccgagucgaagcugcugaccgugucaaucauggaccuaagccagauguauagcccuguguuugaauacuuguccggcgaccgccaggucgaggaguggcccaaggcgacuuguaccggggacugcccggagcgguguggcuguacgagcaguaccugucugcacaaggaguggccccacucccgcaauuggagaugcaaucccacuuggugcuggggugugggcaccggcugcacguguugcgggguggacgucaaggaccucuucaccgaccacauguuuaucaaguggaagguggaguacaucaagaccgaggccaucguuugcgucgagcucaccucccaggagcgccagugcucgcugaucgaggccggcacccgguuuaaccucgggcccgugacgaucacccuguccgagccgcgcaacauccagcagaagcugccgcccgagaucaucacccuccacccuaagaucgaggaaggguucuucgaccugaugcacgugcagaagguuuugagcgccagcaccgugugcaagcuccagagcuguacacacggcauuccgggggaccugcagaucuaccacaucggcaaccugcucaagggggaucgggugaacggccaccugauccauaagaucgagccccacuucaacaccagcuggaugagcugggacgggugugaccuagacuacuacuguaacaugggcgacuggcccagcugcacuuauaccggcgugacgcagcacaaccacgccgcauucgugaaccuccugaacaucgagacagacuacaccaagaccuuccacuuucacucuaagcgcgucacggcucacggugauaccccgcagcuggaccucaaggccaggccgacauacggcgcaggggagaucaccgugcugguugaggucgcagacauggagcugcacacgaagaaaguggagauuaguggcuugaaguucgccagcuuaaccugcacuggaugcuacgccuguaguagcggcaucuccugcaaggugcgcauccaugucgacgagcccgaugagcuuacggugcacgugaaguccagcgaucccgacgucgucgcugccaguacgagccucauggcgcggaaacuggaguucggcacugauuccaccuucaaggccuucagcgccaugccaaagaccucccugugcuucuacaucguggagcgcgaguacugcaagagcugcagcgaggacgacacgaagaagugcgucgacacaaagcucgagcagccgcagaguauucugaucgagcacaaggggaccaucaucgguaaacaaaacgauaccuguacggccaaggccuccugcuggcucgagagcgugaaguccuuuuucuacgggcucaaaaauaugcugggcaguguguuuggguccuuuuucguuggcauccuucucuuccuggcuccuuucgugcugcugguccucuucuucauguucggcuggaagauccuauucugcuucaaaugcugcaggcgcacccgggggcuguucaaguaucgccaccuuaaggacgacgaggaaacaggcuaucgccgaauuauugagcgacugaacagcaagaaggggaaaaaccgccuucucgacggcgagcgccuugcugaccgaaagaucgccgagcuguucuccaccaagacgcacaucggcuga

SEQ ID NO: 15242 - RNA, 5067 nt, Artificial Sequence
  derived and/or modified CDS sequence (opt11) from CCHFV(K229_243)__KX013466.1__GP
augcccacaaacaucaugcacacccugcucguuugcuucauccuguaccugcagcuccugggccucggcggggcccaggggcagagcaacgccaccgagcacaacgagaccaacaccaccaccgcccccuccaccagccagucccccaagccgccggugagcaccaccccgccgcacgcacucgaguccagcacgaucaagcccaccacccccgcccgcgagaccgagggguccggggagaccacgccgccgcccaacaccacccagggccccagcccgcccgaggccacccccgagcggcccgccaccaccgcgaccuccacgcccagcaccgacaacaccaacuccaccacgcacgugaccgacaacaaccccacaagcaccaucuccacgagccccuccagcucccccagcacccccuucacgccccagggcauccaccaccccgcccgcaaucugcuguccguaagcagccccaagaccgcgacgacaccgacccccaccagccccagagagcucagcuccgagacgagcuccuuacacagcgccaucucccgcaccagcacccuguacaccgcgacccagguguccacggagaacgccaaccacucagcgccccggcaguccgaaagcucugcccagccgaccaccaccagccccaugacuucccccgcccagagcauccucgugauguccgccgccccgaccgccauccagaacauccaccccagccccaccaaccgcuccaagcggaaccuggagauggagaucauccugacccucagccaggggcugaagaaguacuacggcaagauccugaagcuccugcaccugacgcucgaggaggacaccgaagggcugcuggaguggugcaagcgcaaccucggcagcaacugcgacgacgacuucuuccagaagcggaucgaggaguucuucaugacaggugagggcuacuucaacgaagugcuucaguucaagacccuguccacgcucagccccaccgagccgucccacgcccggccgcccgccgucgagcccuucaagagcuacuucgcgaagggcuuccugagcaucgacucggguuacuucuccgccaagugcuacccgcggagcuccacaagcggccugcagcucaucaaugugacccagcaccccgcccggaucgcagagacgcccgggcccaagaccaccucccugaagaccaucaacuguaucaaccugcgggccagcguguuuaaggagcaccgcgagaucgagaucaacguccuccugccucagaucgcggugaaccugucaaacugccacguggucaucaacagccacgugugcgacuacucccuugacacggacggccccgugcggcuaccccacaucuaccacgagggcaccuucauccccgggaccuacaagaucguuaucgacaagaagaacaagcugaacgaccgcugcacccucgugacgaacugcguuaucaagggccgggagguccgcaaggggcagagcgugcugcggcaguacaagaccgagaucaagaucggcaaggccucaaccgggagccgcaagcugcucagcgaggagccgggcgacgacugcaucucccggacccagcugcugcgcacggagaccgccgagauccacgacgacaacuacggcgggcccggcgacaaaaucaccauuugcaaugggagcaccaucguggaccagcgccucggcuccgagcugggaugcuacacgaucaaccgggucaagagcuucaagcugugcgagaacuccgcaaccggcaagaccugcgagaucgacagcacccccgugaagugccgccagggcuucugccucaagaucacgcaggaggggcggggccacgugaagcugucccgcgggagcgaggucgugcuggacgccugcgacuccagcugugaggucaugauccccaagggcaccggggacauccugguggacugcuccggcggccagcagcacuuccucaaggacaaccugaucgaccuggggugcccgcacaucccccuccugggcaagauggcgaucuacaucugcaggaugaguaaccacccccgcacgaccauggccuuccuguucugguucuccuucggguaugugauuaccugcaucuucuguaaggcccucuucuacagccugaucaucaucggcacgcuggguaagaagaucaagcaguaccgggagcucaagccccagaccugcacaaucugcgagaccgccccggucaacgcgaucgacgccgagaugcacgaccugaacugcuccuacaacaucugccccuacugcgccagccgccugacguccgacgggcucgcccggcacgugccccagugcccgaagcgcaaggagaagguggaggagaccgagcuguaccugaaucucgagcggauccccuggaucgugcgcaagcugcuccaggugagcgaguccaccggcguggcccucaagcggagcagcuggcugaucgucuugcucgugcugcucaccgucucccucucgcccguccaguccgcgcccguggggcacggcaagacgaucgagaccuaccagacccgcgagggguucaccagcaucuguuuguucaugcugggcuccauccucuuccuggugagcugccuggucaagggccucguggacuccguuagcgacuccuucuucccggggcugagcgucugcaagacgugcuccaucgguagcaucaacggguucgagaucgagucccacaagugcuacugcagccuguucugcugccccuacugccggcacugcuccgccgaucgcgagauccaccagcuccaccugagcaucugcaagaagcggaagaccggcuccaacgugaugcuggccgugugcaagcgcaugugcuuccgggcgaccaucgaggccagccgccgcgcgcuccugauccgguccaucaucaacaccaccuucgucaucugcauccugacccucaccaucugcguggugagcaccagcgccgucgagauggagaaccugcccgccgggacgugggagcgcgaggaggaccugaccaacuucugccaccaggagugccaggugaccgagaccgagugccucugccccuacgaggcccuggugcugcggaagccccuguuccuggacuccaucgucaagggcaugaagaaccugcucaacagcacgucccuggagaccagccuguccaucgaggcccccuggggcgcgaucaacgugcagucuaccuucaagcccaccguguccacggccaacaucgcccucagcugguccagcgucgagcaccgcgggaacaagauccuggugaccggccgguccgagagcaucaugaagcuggaggagcgcaccgggguguccugggaccucggcgucgaggacgccagcgaguccaaguugcugaccgugagcaucauggaccucucccagauguacagccccguguucgaguaccuguccggggaccggcaggucgaggaguggccgaaggcgacgugcaccggcgacugccccgagcgcugcggcugcacgagcuccacgugccugcacaaggaguggccccacucccggaacuggcgcugcaaccccacauggugcuggggcgugggcaccgggugcacgugcugcggcguggacgucaaagaccucuucaccgaccacauguucguaaaguggaagguggaguacaucaagaccgaggccaucgucugcguggagcugacgagccaggagcggcagugcucccugaucgaggccgggacccgcuucaaccucggcccggugaccaucacccugagcgagccccggaacauccagcagaagcugccgcccgagauaauuacgcuccacccgaagguagaggagggcuucuucgaccugaugcacgugcaaaaggugcuguccgccagcaccgucugcaagcuccaguccugcacccacgggauccccggugaccuccaagucuaccauauagggaaccugcucaagggcgaccgcgugaacggccaucugauccacaagaucgagccccacuucaacaccagcuggaugucgugggacgggugcgaccuggacuacuacuguaacaugggcgacuggcccagcugcacguacaccggggucacccagcacaaccacgccgcguucgugaaccuccugaacauagaaaccgacuacacgaagaccuuccacuuccacuccaagcgggucaccgcccacggcgacaccccgcagcuggaccucaaggcccgccccacguacggggccggcgagaucaccgugcugguggaggucgccgacauggagcugcacaccaagaagguggagaucagcggccucaaguucgcgucacuggccugcaccgggugcuacgccugcagcuccggcaucagcugcaaggugcggauccacgucgacgagcccgacgagcugacggugcacgugaaguccucugacccugacgucguggccgccuccaccagccucauggcgcgcaagcuggaguucggcaccgauagcaccuucaaggccuucuccgccaugccgaagacgagccugugcuucuauauaguggagaaggaguacugcaaguccugcagcgaggaggacacucagaagugcgucgacaccaagcucgagcagccccaguccauccugauugagcacaagggcaccaucaucgggaagcagaacgauacgugcaccgccaaggcgagcugcuggcuggaguccgucaagagcuuuuucuacggccucaagaacaugcuaggcuccguguucgggaacuucuucaucggcauccuccuuuuccuaacccccuucguccugcugguccuguucuucauguucggguggaagauccuguucugcuucaagugcugccggcgcacccggggccugcucaaguaccgccaccugaaggacgacgaggagacgggguaccgccggaucaucgagcgccugaacaacaagaagggcaagaaccggcuccuggacggcgagcgccuugccgaccggaagaucgccgagcuguucagcaccaagacccacaucggguga

SEQ ID NO: 15243 - RNA, 5067 nt, Artificial Sequence
  derived and/or modified CDS sequence (opt11) from CCHFV(K229_194)__KX013463.1__GP
augcccaucaacaucaugcacacccugcucgugugcuucauccuguaccuacagcucagcggccucggcggggcccacgggcaguccaacgccaccgagcacaacgggacgaacaccaccaccgucccgggcacgagccagucccccaagccgcccgcgagcaccacccugccccacacccccgaguccagcacugugaagcugaccacccccacuuccgagacggagggcucaggcgagaccacgcccccgcccaacacgacccagggccugcccccgcccgguaccacccccgagcgccccgccaccacggccaccuccaccagcuccaccgauaauaugaacucaacgacccaggugaccgacaauacccccauuaguacggucagcaucuccccgagcuccagcccuuccaugcccagcaccagccaagggauccacuaccccgugcggucccuacucagcguguccagcccgaagaccgucaccacccccacccccaugucccccggcgagaugagcccggagaccuccagccagcacuccgccaugagccgcauccccacccuguacacggccacccagguguccaccgagaacaccaaccggagcacgccccgccaguccgagucguccgcgcagcccgccacccaaucaccgaccaccuccccgacccaaacgauccugcucaugagcgccgcccccaaggcgauccaagacaugcacccgucccccaccaaccggagcaagcgcaaccuggaaguggagaucauucugacccucagucaggggcugaagaaguacuacggcaagauccugaagcuccugcaccugacccucgaggaggacacggagggccugcuggaguggugcaagcggaaccuaggcuccaacugcgacgacgacuucuuccagaagcgcauagaggaguucuucaucaccggcgagggguacuucaacgagguccugcaguucaagacacugaacacccucagccccacggagcccucacaugugcggcugccgaccgccgagcccuucaagucguacuucgccaagggguuccuguccguggacagcggcuacuucuccgccaagugcuacccccgcagcuccaccagcgggcuccaguugauaaacgucacucagcacccugcccggaucgcggagaccccgggucccaaaaccaccucccugaagaccaucaauugcaucaaccuccgcgccagcguauucaaggagcaccgggaggucgagaucaacguccugcugccccagaucgccgugaaccucuccaacugccacguggucauuaacagccacgugugcgacuacucccuggacacggacgggcccgugcgccugccgcggauccaccacgagggcaccuucauccccgguaccuacaagaucgucaucgacaagaaaaacaagcucaacgaccgcugcagccuggugaccaacugcgugauaaagggucgggagguccgcaagggccaguccgugcugcggcaguacaagacggaaauuaagaucgggaaagccagcaccggcucacgcaagcuccuguccgaggagcccggagacgacugcaucagccggacccagcuucucaagaccgaaacggccgaaauccacgaugacaacuacggcgggcccggcgauaagaucaccaucugcaacgguuccaccauugucgaccagcgccuggggagcgagcugggcugcuacaccaucaaccgcgugaaguccuucaagcucugcgagaacagcgcgacggggaagacaugcgagaucgacuccacccccguaaagugcaggcagggcuucugccugaagaucacccaagaggggcgcgggcacguaaagcugagccggggcuccgagguggugcuggacgccugcgacagcuccugcgagaucaugauccccaaggggacgggcgauauccucgucgacugcucugggggccagcagcacuuccugaagggcaaccugaucgaccucgggugcccccacaucccccugcugggcaaaauggccaucuacaucugccgcaugaguaaccacccgcggaccaccauggcauucuuauuuugguucagcuucggguacguuaucacgugcaucuucugcaaggcccuguucuacucccugaucaucaucggcacccucgggaagaagaucaagcaguaccgcgagcugaagccccaaaccugcaccaucugcgagacagcgccagugaacgccaucgacgccgagaugcacgaccuaaacugcagcuacaacaucugccccuacugugcuucccggcucaccagcgacggccuggcccgccacgucacgcagugcccgaaacggaaggagaagguggaagagaccgagcuguaucucaaccuggagcgcauccccuggaucgugcggaagcugcuccaggucuccgagucaacaggcguggcgcugaagcggucuuccugguuaaucgugcuccugguccugcucaccgugucgcugucccccgugcagagcgccccgguggggcacggcaagacgaucgaaaccuaccagacgcgcgagggguucaccaacaucugccuguucaugcucggcuccauccuguucauuguguccugccuggugaaggggcucgucgacuccguuagcgacucuuucuuccccggucugagcgugugcaagacgugcuccaucggcagcaucaacggguucgagaucgagucccacaagugcuacugcagccuguucugcugccccuacugccgccacugcuccgccgaccgggagauccaccagcuccaccugggcaucugcaagaagcgcaagaccgggucgaacgucaugcuggccguaugcaagcggauguguuucaaggcgaccaucgaggccucccgucgggcccuccugauccgaaguaucauaaacaccacguucguaaucugcauccugacccucgccaucugcgucguguccaccagcgccguggagauggagaaccugcccgcgggcaccugggagcgcgaggaggaucugacgagcuucugccaccaggagugccaggucaccgagaccgagugccucugcccguacgaggcccugguccugcggaagccccucuuccuggacuccauagugaaggggaagaagaaccuguuaaacagcaccucccuggagacgagccuguccaucgaggcccccuggggcgccauuaacguccagagcaccuucaagcccaccguguccaccgcuaacaucgcgcucagcugguccagcguggagcaucgcggcaacaagauccuggucacggggcggagcgagagcaucaugaagcuggaggagcgaaccggcguguccugggaccucgggguggaggacgccagcgaguccaagcugcugaccgucagcaucauggaccucucccagauguacagcccgguguucgaguaccuguccggcgaccgccagguggaggaguggcccaaggcaaccugcacgggggauugucccgagcggugcggaugcaccagcuccacgugucugcacaaggaguggccccauagccggaacuggcgcugcaacccgaccuggugcuggggcgucgggaccggcugcacgugcugcggagucgacgugaaggacuuauucaccgaccacauguucaucaaguggaaggucgaguacaucaagaccgaggccaucgugugcguggagcuuaccagccaagagcggcagugcucccugaucgaggccggcacccgcuucaaccugggccccguaaccaucacccugagcgagccccggaacauccagcagaaacugcccccggagaucaucacccuccaccccaagaucgaggagggguucuucgaccugaugcacgugcagaaggugcugucugccaguacggucugcaagcuccaguccugcacccacggcauacccggggaucugcagaucuaccacaucggcaaccugcucaaaggagaccgccugaacggccaccugauccacaagaucgaaccccacuuuaacaccuccuggauguccugggacggcugcgaccucgacuacuacugcaacaugggggacuggccgucgugcacauacacgggcgugacccagcacaaccacgcagccuucgucaaccuccugaacauagagaccgacuacaccaagaccuuccauuuccacuccaagcgggugaccgcccauggugacacgccccagcucgaccugaaggcccgccccaccuacggcgccggcgagaucaccgugcuggucgaaguggccgacauggagcuccacacaaagaagguggagaucagcggccuaaaguucgccucccuggccugcaccggcugcuacucaugcuccagcgggaucuccugcaaaguccggauccacguggacgagcccgacgagcucaccgugcacgucaagagcuccgacccggacgugguggcggccagcacgagccugauggcccgcaaacuggaguucggcacggacuccaccuucaaggccuucagcgccaugccuaaaaccuccuuauguuucuacaucgucgagcgggaguauugcaagagcugcuccgaggacgacacuaagaagugcguggauaccaagcuggagcagccccagagcauucuaaucgagcacaaggguaccaucaucggcaagcagaacgacacgugcaccgcgaaggcauccugcuggcucgagagcgugaaauccuucuucuacgguuugaagaacauguuaggcagcgucuucggcaacuucuucguagggauccuccuguuccuggccccuuucgugcugcucgucuuguucuucauguuuggcuggaaaauccuguuuugcuucaaguguugccgccggacccgcggccucuucaaauaccggcaucugaaggacgacgaggagaccggguaucgcaagaucaucgagcgcuuaaauuccaagaagggcaagaaccggcuccuggacggagagcggcuggccgaccggaagaucgccgaacuguucagcacgaagacgcauaucggcuaa

SEQ ID NO: 15244 - RNA, 5067 nt, Artificial Sequence; identical to SEQ ID NO: 11958
  derived and/or modified CDS sequence (opt11) from CCHFV(Gaib)__KX013445.1__GP

SEQ ID NO: 15245 - RNA, 5067 nt, Artificial Sequence
  derived and/or modified CDS sequence (opt11) from CCHFV(Kosova Hoti)__EU037902.1__GP
augcccaucaacaucaugcauacccugcucgugugcuucauccuguaccugcagcuccugggccucgggggcgcccacggacagagcaacgccaccgagcacaauggcacgaacaccaccaccgccccggggacgucucagagccccaagccgcccgcuuccaccacacccagccacgcccccgagcccuccaccaucaagcugacgacccccaccagcgagacggagggauccggcgagacgacgcccccuaccaauaccacccaggacucuccgccccuggagaccacccccgagcgcuccgccaccacggcaaccagcaccucggggacagacaacaugaacaguacgacccagaugaccgacaacacccccacguccacugucagcaccucccugagcuccagccccuccacccccagcacuucacaggggaugcaccacccggugcggagccuccuuagcguguccagccccaagaccgcuacgacccccacgccaauguccccgggagagaugagcuccgagacgucgucucaacacuccgccaugucccgcacccccacgccccauaccgccacccagguuucuaccgagaacgcgaaccgguccaccagccgccaguccgagagcuccgcucagccagccacucagagcccggucacgucccccgcccagagcauccuacuaaugagcgccacccccacuaccauccagaacauccaccccucccccacgaaccggaguaagaggaaccuggaaauggagaucauccuaacccucucccagggccugaagaaguauuacgguaagauccugaagcuccuccaccugacccucgaggaggacaccgagggccugcucgaguggugcaagcggaaccucggcagcaacugcgacgacgacuucuuccagaagcgcaucgaggaguuuuucauaacgggggagggcuacuucaacgaaguacugcaguucaagacccugucaacccccagcuccaccgagcccagccaugcccgguuacccacggcggagcccuucaaguccuauuucgccaagggguuccugagcaucgacucgggcuacuuuagcgccaaauguuacccccgcuccagcaccuccggccugcagcuuaucaacgucacccagcaccccgcccggaucgccgagaccccggggcccaaaacgacaagccugaaaaccaucaacugcaucaaccugcgcgcguccguguucaaagagcaccgggagguggagaucaacguauuacugccccagaucgccgugaaccugagcaacugccacguggucaucaacagccacgugugcgacuauucccucgacacagacggccccgugcgacugccgagaaucuaccacgaggggacguucaugcccggcaccuacaagaucguaauugaccgcaaaaacaagcugaacgaccgguguacccuggugaccaacugcguaaucaaagggagagagguccggaagggccagagcguccugagacaguacaagacugagaucaagaucggcaaggccccgaccggcucccggaaacugcucagugaggagcccggcgaugacugcaucagucgcacccaacugcugcgcaccgagacggccgagauccacgacgacaacuacgggggcccgggggacaaaaucacuauaugcaacggcagcacgaucguggaccagcggcucggcagcgaacuggggugcuacacgaucaaccgcgucaagagcuucaagcuaugcgagaacuccgccacgggcaagaccugugagaucgacagcacccccgugaagugccggcagggguucugccucaagaucacccagaagggccgcggacacgugaagcugucccggggcucagaagucguacuggacgcgugcgacuccaauugugaagucaugauccccaagggcacgggggacauccugguggacugcagcggcgggcagcagcauuuccucaaggacaaccugauugaucugggcugcccccacaucccgcuccugggcaagauggccaucuacaucugccgcaugucgaaccaccccaagacgacgauggccuuccuguucugguucagcuucggguacgugauuaccugcaucuucugcaaagcacucuucuacucccugaucaucaucggcacucuggguaagaagaucaagcaguaccgggagcucaagccccagacaugcaccaucugcgagaccgcccccguuaacgcgaucgacgccgagaugcacgaccugaacugcagcuacaacauaugcccguauugcgccucccgccugacgagcgacggccucgcacggcacgugaagcagugccccaagcgcaaagagaagguggaggaaacggagcuguaccugaaucucgagcgcauacccugggucgugcgcaagcuacugcagguaagcgagaguaccggggucgcauuaaagcggagcuccuggcugaucgugcugcuagugcugcugaccgucucucucucccccgugcagagcgcgcccgugggccacggcaaaaccaucgagacguaccagacccgcgagggauucaccuccaucugccuauucaugcuggguagcauccucuucaucgucuccugccuggugaaggggcugguggacagcgucuccgacagcuucuuccccggccucuccgugugcaagaccugcuccaucggguccaucaauggcuucgagaucgagucccacaaguguuacugcucccuguucugcugccccuacugccgacacuguagcgccgaccgcgagauccaucagcugcaccugaacaucugcaagaagcggaagacgggguccaacgugaugcuggccgucugcaagcgcaugugcuucagagcuaccaucgaagcuagucgccgcgcccugcucauccggucgaucaucaacaccaccuuugugaucugcauccugacccuaaccaucugcgugguuuccaccagcgccguggagauggagaaccucccggccgggaccugggagcgcgaggaagaccugacuaacuucugccaccaggagugccagguaaccgagaccgagugucugugucccuacgaggcccuuguccugcgcaagccccuguucuuagacaguaucgugaaaggcaugaagaaccugcugaauagcacuucccucgaaaccagucuguccaucgaagcgccguggggugccauaaacgugcagagcaccuucaagccgaccguuuccacagccaacaucgcccugagcuggucaagcguggagcaccgcggcaacaagaucuuggugacggggagauccgaaagcaucaugaagcuggaggagcgcaccggcauaucaugggaccugggcgucgaagacgccagcgaguccaagcucuugaccguauccaucauggacuuaucacagauguacagccccguguucgaguaccucagcggggaccgacaggucgaggaguggcccaaagcgaccugcacgggcgacuguccccagaggugcgguugcaccuccagcaccugucugcauaaggaguggccgcacucacggaauuggagaugcaaccccaccuggugcuggggcguggggaccggcugcacgugcugcggcguggacgucaaggaccuguucaccgaccauauguucgugaaauggaaaguggaguacaucaagaccgaggccaucgucuguguggagcucaccagccaagagcggcagugcucccugauagaggccgggacgcgcuucaaccucggccccgugaccaucacccucagcgagccucggaacauucagcagaagcugccgcccgagaucaucacucugcaccccaagaucgaggagggguucuucgaccucaugcacguccagaaggugcuguccgccagcacagugugcaagcugcaguccugcacccacggcauccccggagaccuccaggucuaucacauugggaaccuguuaaagggcgaccgcgugaacgggcaccucauccacaagaucgagccgcacuucaacaccagcuggauguccugggacggcugcgaccuggacuacuacugcaacaugggugauuggcccagcugcaccuacacgggcgugacccagcacaaccacgcggccuucgucaacuugcuaaacauugagacggacuauaccaagacguuccacuuucacuccaagcgggugaccgcacacggcgacacaccccagcuggaccugaaggccagacccaccuacggagccggggagauuacggucuuaguggaaguggcagacauggagcugcacaccaagaagguggagaucagcggguuaaaguucgccucccucgcuugcaccggcugcuacgccugcagcuccgggaucagcuguaagguucggauccacguggacgagcccgacgaacugaccguccacguuaagagcagcgaccccgauguggucgccgcgggcaccucacugauggcccggaagcucgaguuuggcacugauuccaccuucaaggcuuuuuccgcaaugcccaagaccucccuguguuucuacauuguggagaaagaguacugcaagagcugcuccgaggacgacacgaagaagugcguggacaccaagcuggagcagccccagagcauccucaucgagcaccgggggaccaucaucgguaagcaaaacgauaccugcacggccaaggcguccugcuggcuggaaagcgucaagucguucuucuacggguuaaagaacaugcuaggcagcguguucgggaacuucuucaucggcauccuacuguuccucgcccccuucgugcugcugguccuguucuucauguucggcuggaagauccucuucugcuucaaguguugccgccggacccgcggccuguucaaguaccgccaccugaaggacgacgaggagaccggcuaccggcgcaucaucgagcggcuaaauaacaagaaggggaagaaccgucuacuggacggcgagcggcucgccgaccgcaagaucgccgagcuguucaguaccaagacgcacaucggcuga

SEQ ID NO: 15246 - RNA, 5067 nt, Artificial Sequence
  derived and/or modified CDS sequence (opt11) from CCHFV(Turkey200310849)__DQ211636.1__GP
augcccaccaacaucaugcauacccugcucgugugcuucauccuguaccugcagcuccugugccugggcggggcgcacggccagcucaacacgaccgagcacaacgguaccaacaacaccacggcaccgggcgcgagccagucccccaagccgcccaugagcaccaccccgccccacgcccccgaguccagcaccaucaagcccacgacccccaucuccgaggcggaggggagcggcgagaccaccuccacgcccaacaccacccagggccugagcucccccgagaccacgagcgagcgccccgccaccaccgccaucuccacgagcuccacggacagcaccaacccgaccacccagaugacagacaacacccccacccugaccgucuccacgagccccuccagcucccccagcacgccgagcacgccccaggggaucuaccaccccgcgcggucccuccugucaguguccagccccaagaccgugaccaccccgacccccacuucccccggggagaugagcuccgagacgagcucccagcacagcgccauguccagaauccccaccccacauaccgccacccgggucagcaccgagaacacgaaccacuccacgccccgccaguccgaguccagcgcccagcagaccacccccucccccaugacaagcccggcgcaguccauccugcucaugagcgccgcccccaccgccgugcaggacauccaccccagcccgaccaaccgguccaagcgcaaucuggagaccgagaucauccugacgcucagccaggggcugaagaaguacuacggcaaaauccugaaguugcugcaccugacccucgaggaggacaccgaggggcugcuggaguggugcaagcggaaccucggcuccaacugcgacgacgacuucuuccaaaagcgcaucgaggaguucuucaugaccggcgagggguacuucaacgaggugcugcaguucaagacgcugagcacccucucccccaccgagcccucgcacgcacggcugccgaccgcggagccguucaaguccuacuucgccaagggcuuccugagcaucgacuccggguacuucagcgcuaaaugcuacccccgcuccagcgccuccggccuccagcugaucaacgucacgcagcaccccgcccggaucgcggagacccccggcccgaagaccaccagccugaagacgaucaacugcaucaaccugcgcgccuccguguucaaggagcaccgggagaucgagaucaacgugcugcugccccagaucgccgucaaccucaguaacugccacguggugaucaacucccacgucugcgacuacagccuggacaccgacgggcccgugcgccugccucggaucuaccaugagggcaccuucaucccggggaccuacaagaucgugaucgauaagaagaacaagcucaacgaccguugcacgcuggucaccaacugcgugaucaagggccgggaggugcgcaaggggcagucuguccugcggcaguacaagaccgagaucaagaucggcaaggccuccaccggcuuccgcaagcuccugagcgaggagcccggggacgacugcaucucccggacgcagcugcuccgcaccgagaccgccgagauccacgacgacaacuacggcgggcccggcgacaagaucacaaucugcaacgggagcacgaucguggaccagcgccugggcuccgagcugggcugcuacacgaucaaccgcguaaagagcuucaagcucugcgaaaauuccgcgaccgggaagaccugcgagguggacagcacgcccgucaagugccgccagggcuucugccugaagaucacccaggaggggcggggccacgugaagcugucccgcgggagcgaggucgugcuggacgccugcgacuccagcugcgagguaaugaucccgaagggcaccggcgacauccucguggacugcuccgggggacagcagcacuuccugaaggacaaccugaucgaccucggguguccccacaucccccugcugggcaagauggccaucuacaucugccggauguccaaccacccccgcaccaccauggcguuccucuucugguucucguucggguacgugaucacgugcaucagcuguaaggcccuguucuacucccugaucaucaucgggacccucggcaagaagaucaagcaguaccgggagcugaagccgcagaccugcaccaucugcgagacggcgcccgucaacgccaucgacgccgagaugcacgaccugaacuguagcuacaacaucugccccuacugcgccucccgccugaccagcgacgggcuggcgcggcacgugacccagugccccaagcgcaaggagaagguggaggagaccgagcuguaccucaaccuggagcggaucccguggaucguccgaaagcugcuccaggugagcgaguccacgggaguggcccugaagcggagcuccuggcugaucguccuccuggugcugcucaccgugagccuuucccccguacagagcgcccccguggggcacgguaagaccaucgagaucuaccagacccgcgagggcuucgcuuccaucugccuguucaugcucgggagcauccuguucaucguguccugccuggucaagggccucguggacagcguguccgacagcuucuucccggggcuguccgucuguaagacgugcagcaucggcuccgugaacggguucgagaucgagagccacaagugcuacugcucccuguucugcugccccuacugccggcacugcagcgccgaccgcgagauccaccagcuccaccuguccaucugcaagaagcggaagaccggcagcaacgugaugcuggcugucugcaagcgcaugugcuuccgagccaccaucgaggccagucgccgcgcccucuugauccgguccaucaucaacaccacguucgugaucugcauccugacccucaccaucugcguggucagcaccuccgccguggagauggagaaccugcccgcgggcacgugggagcgcgaggaggaccugaccaacuucugccaccaggaaugccaggugaccgagaccgagugccucugccccuacgaggcccugguccugcggaagccccucuuccuggauagcaucgugaaggguaugaagaacuuacugaacuccacgagccuggagacuucccugagcaucgaggccccguggggcgccaucaacgugcaguccaccuucaagcccgccgucagcaccgcgaauaucgcccucuccuggagcuccguggagcaccgcgggaacaagauccuggugacgggacggagcgaguccaucaugaagcuggaggagcgcaccggugucagcugggaccucggcguggaggacgccuccgagagcaagcugcugacaguguccaucauggaccucagccagauguacagccccgucuucgaguaccuguccggcgaccgccagguggaggaguggccgaaggcgaccugcacgggggacugccccgagcggugcggcugcaccagcucgacgugucugcacaaggaguggccccacucccggaacuggcgcugcaacccaaccuggugcuggggcguggggaccggguguaccugcugcggggucgacgugaaggaccucuucaccgaccacauguucgugaaguggaaggucgaguacaucaagaccgaggccaucgugugcguggagcuaaccucccaggagcggcagugcagccugaucgaggccggcacccgcuucaaccucgggccggucaccaucacccuauccgagccccggaacauccagcagaagcugccgcccgagaucaucacccuccaucccaagaucgaggagggcuucuucgaccugaugcacguccagaaggugcugucugccuccacagucugcaagcuccagagcugcacccacgggauccccggcgaccuccagguguaccacaucggcaaccugcucaagggggaccgcgugaacggccaccugauccacaagaucgagucccacuucaacaccagcuggauguccugggacggaugcgaccuggacuacuacugcaacaugggcgacuggcccagcugcaccuacacggggguaacccagcauaaccacgccgccuucgugaaccuccugaacaucgagaccgacuacaccaagacguuccacuuccacuccaagcgggucaccgcgcacggcgacacgccccagcuggaccucaaggcccgcccgaccuacggcgcuggggagaucaccgugcugguggaggucgccgacauggagcugcacaccaagaagguggagauaagcggucucaaguucgccucccuugcgugcaccgggugcuacgccugcagcuccggcaucagcugcaaggugcggauccacgucgacgagcccgacgagcugaccgugcacgucaagagcuccgaccccgacguuguggcugccagcacgucccucauggccaggaagcucgaguucgggaccgacagcaccuucaaggcguucuccgccaugcccaagaccagccugugcuucuacauaguggagcgggaguacugcaaguccugcagcgaggacgacacgcagaagugcgucgacacccgccucgagcagccgcagucaauccuaaucgagcacaagggcaccaucaucggcaagcagaacgauaccugcaccgccaaggccagcugcuggcuggaguccgucaagagcuucuucuacgggcucaagaacaugcugggcuccguuuucgggaaccuauucaucggcauccuccuguuccuggcgcccuucgugcugcucgugcuguucuucauguucggauggaagauccuguucugcuucaagugcugccggcgcacccgcggccucuucaaguaccggcaccugaaggacgacgaggagaccggcuaccgccggaucaucgaaagguuaaacagcaagaaggggaagaaccggcuccuggacggcgaccgccuggccgaccggaagaucgcggagcuguucuccaccaagacucacaucggguga

SEQ ID NO: 15247 - RNA, 5067 nt, Artificial Sequence
  derived and/or modified CDS sequence (opt11) from CCHFV(Kashmanov)__DQ211631.1__GP
augcccaccaacaucaugcacacccuucucguaugcuucauccuguaccugcagcuccugggccucggcggggcccacgggcagagcaacgccacggagcacaacgggaccaauaccaccacggccccgaguaccucucagucucccaagccccuggucagcaccgcgccuccgcacgcccuggaguccagcaccaucaagcccacgacccccgccuccgagaccgaggggagcggcgagaccacgcccccgcccaacaccacccagggccccuccccgcccgagaccacgcccgagagacccgccaccaccgccacuagcacgcccuccaccgacaacaccaacagcaccacgcacgugaccgacaacaacccgaccuccaccaucagcacgucccccagcuccagccccuccacccccuccaccccgcaggggauccaccacccugcccggaaccuccugagcguguccagccccaagaccgccacgacccccaccccgaccucccccggcgagaucagcuccgaggccaguucucugcacagcgcgaugucacgcacgagcacccuguacaccgccacccagguuuccaccgagaacgccaaccacagugcgccccggcaguccgagagcuccgcccagcccacgaccaccagcccgaugaccucccccgcccagagcauccucgugauguccgcagcccccaucgccauccagaacauccacccgagccccacgaaccgcagcaagcggaaccuggagauggagaucauccugacccucucccaggggcugaaaaaguacuacgggaagauccugaagcuccugcaccugacccucgaggaggacaccgaggggcugcuggaguggugcaagcgcaaccucggcagcaacugcgacgacgacuucuuccagaagcggaucgaggaguucuucaugacgggcgagggguacuucaacgaggugcugcaguucaagacccuguccacccucucgcccaccgagcccagccacgccggcccgcccacggucgagcccuucaagagcuauuucgcgaagggguuccuguccaucgacucgggcuacuucuccgccaaguguuacccccguagcuccaccagcgggcugcagcucauuaacgugacucagcaccccgcccggaucgccgagaccccugggcccaagacgaccuccuuaaagaccaucaacugcaucaaccugcgcgccagcguguucaaggagcaccgggagauugagaucaacgugcuccugccccagaucgcgguuaaccugucaaacugccauguggucauaaacagccacguaugcgauuacagucucgacaccgacggcccggugcgccugccccacaucuaccacgaggguacguuuauccccgguaccuauaagaucgucaucgacaaaaagaacaagcugaacgaccggugcacccucgugaccaacugcgugaucaaagggcgcgagguccgaaagggccagagcgugcugcgccaguacaagacggagaucaagaucggcaaggccagcaccgggucccggaagcuguugagcgaggagcccggcgacgacugcaucucccgcacccagcugcugcggacggagacggccgagauccacgacgacaacuacgggggcccgggggacaagaucaccauaugcaacggcagcaccaucguggaccagcgcuuagguuccgagcugggcugcuacaccaucaaccgagucaagagcuuuaagcucugcgagaacagugccacugggaagaccugcgagaucgacagcacccccgugaagugucgccagggcuucugccucaagauuacccaggagggucgcgggcacgugaagcugucccggggcucugaggucgugcuggacgccugcgacucuuccugcgaagucaugauccccaagggcacgggggacauccugguagacugcuccggcgggcagcagcacuuccucaaggacaaccugaucgaccugggcugcccccacaucccgcuccuggggaagauggcgaucuacaucugccgcaugagcaaucacccccggaccaccauggccuuccuguucugguucuccuucggguacguaaucacgugcaucuucugcaaggcccucuuuuacagccugaucaucaucggcacccucgggaaaaagaucaaacaguaccgcgagcucaagccccagaccuguacaaucugugagaccgcccccgucaacgcgaucgacgccgagaugcacgaucugaacugcuccuacaacaucugcccguacugcgccagccggcugaccucggacggccucgcccgccacgugccccagugccccaagcggaaggagaagguggaggagacggaacuguaccugaaucucgagcgcauuccguggaucguccggaagcuguugcaagugagcgagagcacagggguggcccugaagcgcuccucauggcugaucguccugcuagugcugcucaccgugucccucagccccguccaguccgcgcccgugggccacggcaagaccaucgagacguaccagacccgggagggguucaccagcaucugccuguuuaugcuggguuccauccuauuccuggugagcugccuuguaaaggggcucguggauuccgugagcgacaguuucuuccccggccugagcgucugcaagaccugcacgaucggguccaucaacggcuucgagaucgagagucacaagugcuacugcucccuguucugcugcccuuacugccgccacugcagcgccgaccgggagauccaccagcuccaccuguccauuugcaaaaagcgcaagaccggcagcaacgucaugcuggccgugugcaagcggaugugcuuccgcgcaacuaucgaggccucccggcgcgcgcuccugauccggagcaucaucaacaccacguucgucaucugcauccugacccucaccaucugcguggugagcaccuccgccgucgagauggagaaccugcccagcgggacgugggagcgcgaggaggaccugacuaacuucugccaccaggagugucaggugaccgagaccgagugccucugccccuacgaggcccuggugcugcgcaagccccucuuccuggauucaaucgucaaggguaugaagaacagccugaacuccacgagccucgagacaucccugagcauagaggccccguggggcgccaucaacgugcaguccaccuuuaagccaaccgugagcacggcgaacaucgcccuguccuggagcucgguugagcaucgggggaacaagauccucgugaccgggcgcagcgaauccaucaugaagcuggaggagcggaccggcgugagcugggaccugggcguggaggacgccuccgagagcaagcuccugacuguauccauuauggaccugagccagauguacagccccguguucgaguaccucuccggggaccgccaggucgaggaauggcccaaagccacgugcaccggcgacugcccggagcgcugcgggugcaccagcuccacgugccugcacaaagaguggccccacagccgcaacuggcggugcaacccgacguggugcuggggcguggggacuggcugcacgugcugcggcguggacgucaaggaccuguucaccgaccacauguucgugaaguggaagguggaguacaucaagaccgaggcgaucguaugcguggagcucaccucccaggagcgccagugcagccugaucgaggccgggacccgguucaaccugggccccgucaccaucacccucuccgagccgcgcaacauccagcagaagcugccgccugagaucaucacgcugcaccccaaggucgaggagggguucuucgaucucaugcacgugcagaaggugcugagcgccuccaccgucugcaagcuacagucaugcacccacggcauccccggcgaccuccagguguaccacaucgggaaccugcugaagggcgaccggaucaacgggcaccucauccacaaaaucgagccccacuucaacaccuccuggaugagcugggacgggugcgaccuggacuauuacugcaacaugggagacuggcccuccugcacguacaccggcgugacccagcacaaccacgccgccuucgucaaccugcucaacaucgagaccgacuacacgaaaaccuuccacuuccauagcaaacgggugaccgcgcacggcgacacgccccagcuggaccuuaaggcccggccgaccuacggggcaggcgagaucaccguccucguagagguggccgacauggagcugcacacuaagaaggucgagaucuccgggcuaaaauucgcgagccucgcgugcaccggcugcuacgccugcuccagcgggaucuccugcaagguacgcauacacguggacgagcccgacgagcugacgguccacgucaagagcagcgaccccgacguuguggccgcauccaccagccugauggccagaaagcucgaguucggcaccgacaguaccuucaaggcguucagcgccaugcccaagacgucccugugcuucuacaucguggagcgcgaguacugcaaaagcugcuccgaggaggacacccagaagugcguggacaccaagcuggagcagccgcagagcauccucauagagcacaagggcacuaucaucgggaagcagaacgacacgugcaccgccaaggccaguugcuggcuagagagcgucaaguccuucuucuacggccugaagaacaugcucggcagcguguucgguaacuucuucauagggauccuacuguuucucgcgcccuuugugcugcucguccuguucuucauguucggcuggaagauccucuucuguuucaagugcugccggcgcacccggggccugcugaaguaccgccaccucaaggacgacgaggagaccggguaccggagaaucauugagcgccugaacaacaaaaagggcaagaaccggcugcucgacggggagcgccuggccgaccggaagaucgccgagcuguucuccacgaagacccacauaggcuga

SEQ ID NO: 15248 - RNA, 5067 nt, Artificial Sequence
  derived and/or modified CDS sequence (opt11) from CCHFV(Drosdov)__DQ211630.1__GP
augcccaucaacaucaugcacgcgcugcucgugugcuucauccuguaccugcagcucagcggccucgggggcgcccaccgccaguccaacgcuaccgagcacaacgggaccaacacgaccaccgccccgggcaccagccaguccccuaagccaccugucagcacuacccugccacacaccccggaggccuccaccauuaagcugacgacccccaccagcgagaccgagggguccggcgagacaacgcccccgcccaauaccacccagggccugccccugcccgggaccaccccggaacggagcgccaccaccgcuacguccaccagcucuaccgacgauaugaacagcaccacgcagaugaccgacaacacccccaccuccacggugagcaucggacucuccagcucccccagcaugcccuccaccagccaggggauccacuacccggugcgcagcuugcuguccgucagcucccccaagaccgcgaccacgcccacccccaugagcccgggcgaggugucccccgagaccagcucccagcacagcgccaugagucggauccccacucucuacacagccacccaggugagcacagagaacaccaaccgcuccaucccccggcagagcgaguccagcguccagccggccacccagucccccaucacgagccccgcacagaccauccugcugauguccgccgcucccaccgccauacaagacaugcacccgagccccaagaaccgcuccaagcggaaccucgagguggagaucauccugacccugucgcagggguugaagaaguacuacggcaagauccugaagcugcuccaucugacgcuggaggaggacaccgagggccuccuggaguggugcaagcgcaaccuggggagcaacugcgacgacgacuucuuccagaagcggauugaggaguucuucaucaccggcgagggguacuucaacgagguguuacaauucaaaacccccuccacgcugagcccgaccgagcccucccacguccgccugcccaccgccgagcccuuuaagagcuacuucgcgaagggcuuccucuccaucgacucaggcuacuucucugccaagugcuacccgagaagcuccaccagcgggcugcagcugaucaacgugacacagcaccccgcccgcaucgccgagacccccggcccuaaaaccaccucccucaagacgaucaacugcaucaaccugcgggccagcguuuucaaggagcaccgcgaggucgagaucaacguacugcucccgcagauagcggugaaccugucgaacugccacgucgugaucaacagccacgugugcgacuacucccuggacaccgacggacccguacggcucccccgcauccaccacgagggcgccuucauccccgggaccuacaagauagugaucgacaagaagaacaagcugaacgaccggugcagccuggucacgaacugcguuaucaagggccgcgaggugcggaagggccaguccguccuccgccaguacaagacagagaucaagaucgggaaggccagcaccggcagccggaagcugcuguccgaggagccgggggacgacugcaucagccgcacccagcuccuaaagaccgagacugccgagauccacgacgacaacuacggcgggcccggcgacaagaucaccaucuguaacggcuccaccauagucgaccagcgccuggggagcgagcucggcugcuacaccaucaaccgcgugaaguccuucaaacugugcgagaacagcgccacggggaagaccugcgagaucgacaguacccccgucaagugccgccagggcuucugccuuaaaaucacccaggagggucggggccacguaaaguuaagccgcggcuccgaggugguccucgacgcgugugauagcucuugcgaggugaugauccccaaggggacgggcgacauccucguggacugcagcgggggucagcagcacuuccugaaggauaaccuaaucgaccugggcugcccgcacaucccccuccucggcaagauggccaucuauaucugccggauguccaaccacccccgcaccaccauggccuucuuauuuugguucagcuucgguuacgucaucacgugcaucuucugcaaggcccuguucuacucccucaucaucaucgguacccuggggaagaagaucaagcaauaucgggagcuuaagccccagacuugcaccauuugcgagaccgccccggugaacgcgaucgacgccgagaugcacgaccucaagugcagcuacaacaucugccccuacugcgccucccgcuuaacaagcgacggguuggcccggcacgugacccagugccccaagcgcaaggagaaggucgaggagaccgagcucuaucugaaccuggagcggauccccuggaucgugcgcaaacuccuccaggugucugaaucgaccggcgucgcgcugaagcggagcuccuggcucaucgugcugcugguguuacugaccgucagccucuccccgguccagagcgcccccguggggcacgggaagacgaucgagaccuaccagacccgcgagggcuucaccuccauuugccuauucaugcuggggucgauccuguucaucgucucaugccucgucaagggccugguggacagcgucuccgauagcuucuuccccgggcuguccgugugcaagacguguagcaucggguccaucaacggcuucgagauagagagucacaagugcuacugcucccucuucugcugcccguauuguaggcacuacagcgccgacagggagauccaccagcugcaccuuuccaucugcaagaagcggaagaccgggagcaaugugaugcucgccguaugcaagcgcaugugcuucaaggccaccaucgaggcgucccggcgcgcccugcugauccgcagcaucauuaacaccacguucgugaucugcauccucauccuggccaucugcguggugagcaccuccgccguugaaauggagaaccugcccgccggcacgugggagcgggaggaggaccucaccaacuucugccaccaagagugccaggucacggagaccgagugccugugucccuacgaggcgcugguccuccgcaagccccuguuccuggacagcacggugaaggggaugaagaaccuccugaacuccacaagccuggagacaucgcucagcaucgaggccccguggggcgccaucaacgugcaguccacguucaagcccaccgucaguaccgccaacaucgcacuguccuggagcuccguggagcaccgggggaacaagauccuggugacgggacgcagcgaguccauuaugaagcucgaagagaggaccggcgucagcugggaccucgggguggaggacgcguccgaaagcaagcugcucaccguauccaucauggaccugagccagauguacucccccgucuucgaguaccugagcggcgaccgccagguggaagaguggcccaaggcgacgugcacgggagacugcccggagcggugcggcuguaccagcagcacgugccuccauaaggaguggccccacucccggaacuggcggugcaaccccacguggugcuggggcguggggaccggcugcacuugcugcggggucgacgugaaggaucuguucaccgaccauauguucgucaaguggaaagucgaguacaugaagaccgaggccaucgugugcguggaguuaaccucccaggaacggcagugcagccuuauugaggccgggacccgguucaaccuggggccugucaccaucacccuguccgagccacgcaacauccagcagaagcucccgccugagaucauuacccugcaccccaagaucgaggagggcuucuucgaccugaugcacgugcagaaggugcucagcgccuccacggucugcaaguugcagaguugcacccacggcauccccggggaccugcagaucuaccacaucgguaaccuccugaagggggaccgggucaacggccaccugauccacaagaucgagccccacuucaacaccuccuggaugagcugggacgggugcgaccuggacuacuacugcaacaugggcaacuggcccuccugcaccuacacgggcgucacccagcacaaccacgccgccuucgugaaccugcugaacaucgagaccgacuacaccaagacguuccacuuccacagcaaacgcgugaccgcccacggggacacgccccagcucgaccugaaggcccggccgaccuauggcgcgggugaaaucaccguccugguggagguggccgacauggagcuccacaccaagaagguugagaucuccggccugaaguucgccagccuggugugcaccgggugcuacgccugcuccagcggcaucuccugcaaggugcgcauccacgucgacgagcccgaugaguugaccgugcacguuaagagcuccgaccccgacgugguggccgcgucaacgagccugauggcccggaaacuggaguucggcaccgacuccaucuucaaggccuucagcgccaugcccaagaccucccucugcuuuuacaucguggagcgcgaguacugcaagucuugcuccgaggacgacaccaagaagugcgucgacacgaagcuggagcagccgcagagcauccugaucgagcacaaggggaccaucaucggcaagcagaacgacaccuguaccgccaaggcgagcuguuggcucgagagcgugaaguccuucuuuuacggacugaagaacaugcugggcagcguguucgggaacuuuuucguaggcauccuccuguuccuggcccccuucgugcugcucgugcuguucuuuauguucggcuggaagauccuguucugcuucaagugcugcagacgcacccggggccucuucaaguaccgccaccugaaggacgacgaggagacuggguaccgccggaucaucgagcgccuuaauuccaaaaaggggaagaaccggcuccuggauggagaacgccuggccgaccguaaaaucgccgagcuguucagcaccaagacccacaucggcuga

SEQ ID NO: 15249 - RNA, 5067 nt, Artificial Sequence
  derived and/or modified CDS sequence (opt11) from CCHFV(1231-CR/TI-2015)__KU161585.1__GP
augcccaucaauaucaugcacacccugcuugugugcuucauccuguacuugcagcuccugggccucgggggcgcucacgagcagagcaacgcaaccgaccacaaccgcacgaacaccauaaccgcgccgucgaccagccagaaccccaaaccucccgccuccacgaccccgccccacacccccgagagcuccaccaucaagcucaucacgagcaccggggaggccgagggcuccggagagaccacgcccccgcugaacaccacucagggccccuucccgcccgagaccaccagcgagcaccccgccuccacggccaccaacaccagcuccaccaacagcaugaacuccacgacccagaugaccgacaagacccuaacgagcaccgucuccaccagccucuccaucucuccaucaacccccagcacuagccagggcauccacuaccccauccggucccugcugagcguguccagcccgcgcacugcggccacccccacccccauguccacgcgggagaugagcucggaaaccaacagccagcacuccgccgugucucggacaccuaccuuccacacugccacccaggucucaacugaaaacgacaaccggagcaccccgaggcagucggagagcuccgcgcagcccgccacccagagucccaugacgucccccgcccagagcauccuccugguauccgccgccccgaccacuauccagaacauucaucccagccccaccaaccgguccaagcgcaaccuggagauggagauaauccucacgcugccccaggggcuaaagaaguacuacggcaagauccucaagcuguuacaccugacccuggaggaggacaccgaggggcugcucgaguggugcaagcggaaccugggcaguaacugcgacgacgaguucuuccagaagcgcaucgaagaguucuucaucaccggggagggcuacuucaacgaagugcuacaguuuaagacgcucucgacccuguccccgauggagcccagccacgcgcggcccccgacagccgagcccuucaaguccuacuucgccaagggcuuccugagcaucgauuccggcuacuucagcgcuaaguguuacccacgcuccagcuccagcggccuccagcugaucaacaucacccagcaucccgcccggaucgcggagacgccggggcccaagaccaccucccugaagaccaucaacugcaucaacuuacgcgccucagucuucaaggagcacagggagguggagaucaacgugcugcugccgcagaucgcggucaaccucucgaacugccacgugguaaucaacagccacgucugcgacuacucccuggacacggacggccccgugcgccuuccgcggaucuaccacgagggcaccuucaucccugggaccuacaagaucgugaucgacaagaagaacaagcucaacgaccgcugcacccuggucacgaacugcgugaccaagggucgggaggugaggaaggggcaaagcguccugcggcaguacaagaccgagaucaagaucggaaaggccagcaccggcucccgcaagcuccugagcgaggagcccggcgacgacugcaucucccgcacgcagcugcuccggaccgagaccgccgagauccacgacgacaacuacggcgggcccggcgacaagaucaccauaugcaacgggagcacgaucguggaccaacgcuugggcuccgagcuggggugcuacaccaucaaccggguaaagagcuucaagcucugcgagaacuccgcgacgggcaagacuugcgagaucgacagcacgccugugaagugccgccagggcuucugccugaagaucacccaggaggggcggggccacgucaagcugucccgcgggagcgaagugguccuggacgccugcgacuccucgugugaggugaugauucccaagggaaccggggacauccucgucgauugcuccggcggccagcagcacuuccugaaggacaaccugauagaucucgggugcccgcacauuccccugcugggaaagauggccauauacaucugccggaugagcaaccacccccgcaccacgauggcguuccucuucugguucuccuucgguuacgugauaaccugcaucuucuguaaggcccuguucuauagccugaucaucaucggcacccucggcaagaagaucaagcaguaucgggagcugaagccccagaccugcaccaucugcgagacggcgcccguaaacgccaucgacgccgagaugcacgaccugaacugcuccuacaacaucugccccuacugcgccagccgccugacuuccgacgggcuggcacggcacguaacccagugcccgaagcgcaaagagaagguggaggagaccgagcuguaccucaacuuggagcggauccccuggaucguccgcaagcuacuccaggucuccgagagcacgggcguggcccugaagcgguccagcuggcugaucguguuacugguccugcucaccgugucccuaagccccgugcaguccgcccccgucgggcauggcaagaccaucgagaccuaccagacgcgcgagggguucacgagcauaugccuguucaugcucggcuccauccuauucaucgugagcugccuggucaagggccucgucgaguccgugagcgacuccuucuucccggggcugagugugugccggaccugcuccaucggaagcaucaacggguucgaaaucgagucccauaagugcuacugcagccuguucugcugccccuacugccgucacugcuccgccgaccgggagauccaccaacuccaccugagcaucuguaagaagcgcaaaaccggcuccaacgucaugcuggccguguguaagcgcaugugcuuccgggcgacgauggaggccagccgccgggcgcuccugauccgcagcaucaucaacaccaccuucgugaucugcauccugacccucacgaucugcgucguauccaccagcgccguggagauggagaaccugcccgccgggaccugggagcgggaggaggaccugaccaacuucugccaccaggagugccaggucacggagaccgagugccucugcccguacgaggcgcuagugcugcguaagcccuuauuccuggacuccaucgugaagggcaugaagaaccuguuaaacagcaccucccuggagacgagccuguccaucgaggccccuuggggcgcaaucaacguccagucaaccuucaagcccaccguguccacggccaacaucgcccucagcugguccagcguggaacacagagggaacaagauccuggucaccggccgcuccgagagcaucaugaagcuggaggagaggacggggguguccugggaccucggcguggaggacgcgagcgaguccaagcugcugacagucagcaucauggaccucucccagauguacagcccgguguucgaguaccugagcggggaccgccagguggaagaguggcccaaggcgaccugcaccggugacugcccggagcggugcggcugcacguccagcacuugccugcauaaggaguggccccacucccgcaacuggcggugcaacccgaccuggugcuggggcgucgggaccgggugcacgugcugcggcguggacgugaaggaccucuucaccgaccacauguuugucaaguggaagguggaguauaucaagaccgaggccaucgucugcgucgagcugaccagccaggagcgccaaugcucccugaucgaagccgggacccgguucaaccucggccccgugacgaucacccugagcgaaccccgcaacauccagcagaagcuacccccggagaucaucacgcuccaccccaagaucgaggagggcuucuucgaccugaugcacgugcagaagguccuguccgccaguaccgugugcaagcuccaguccugcacgcaugggaucccuggcgaccuccagguguaccacaucgggaaccuguugaagggcgaccgggucaacggccaccugauccacaagauugagccccacuucaacaccagcuggauguccugggacgggugcgaccuggacuacuacugcaacaugggcgacuggccgagcuguacauacacagggguuacgcaacacaaccacgccgccuucgugaacuuacugaacaucgagaccgacuacaccaagaccuuccacuuccacuccaagcgcguaacggcccacggcgacaccccgcagcuggaccucaaggcccggcccaccuacggggcaggcgagaucacaguguuggucgagguggccgacauggagcugcacacaaagaagguggaaaucucuggccucaaguucgccucacuggccugcaccggaugcuacgccuguuccuccggcaucagcugcaagguccgcauccacguggacgagcccgacgagcugaccgugcacgucaagucgagcgacccggacgugguggcggcuagcaccucgcucauggcccggaagcuggaguucgggacggacucaacguucaaggccuucuccgccaugcccaaaaccagccugugcuucuacauagucgagcgcgaguacugcaaguccugcagcgaggacgacaccaagaagugcguggacacgaagcucgagcagccccaguccauccugaucgagcacaagggaaccaucaucgggaagcagaacgacacaugcaccgccaaagccagcugcuggcuggaguccgucaagagcuucuucuacggccucaagaacaugcugggcuccguguucgggaacuuuuucaucggcauccugcuguuccuggcccccuuugugcugcuggugcuguucuucauguucggguggaagauccuguucugcuuuaaguguugccgccggacgcgcggccuguucaaguaccggcauuugaaggacgacgaagagaccggguaccgccggaucauagagaggcugaacaacaagaagggcaagaaccggcuccucgacggcgagcgccuggccgaccggaagaucgcggagcuguucagcaccaagacccacaucggguga

SEQ ID NO: 15250 - RNA, 5067 nt, Artificial Sequence
  derived and/or modified CDS sequence (opt11) from CCHFV(1-CR/HU-2015)__KU161584.1__GP
augcccaucaacaucaugcacacccugcucgugugcuucauccuguaccugcagcuccugggccucgguggcgcccacgagcagagcaacgccaccgaccacaaccgcacgaacaccaucaccgcgccguccaccagccagaaccccaagccacccgccuccacgaccccgccccacacucccgagagcuccaccaucaagcugaucacgagcaccggggaggcggagggcuccggugagacaaccccgccccugaacacgacccagggccccuucccgcccgagaccaccagcgagcaccccgccuccacggccaccaacaccagcuccaccaacagcaugaacuccacgacccagaugaccgacaacacguuaacgagcaccgucuccaccagccucuccaucagccccuccacccccagcaccagccagggcauccacuaccccgugcggucccugcugagcguguccagccccaagaccgcggccacccccacccccauguccacgcgcgagaugagcuccgagaccagcucgcagcacagcgcaaugucccggacccccaccuuccacacggccacccaggucaguaccgaaaacgcgaaccgcuccaccccgcggcagagcgaguccagcgcccagcccgccacccagucccccaugacgagccccgcccaguccaucuuccucgugagcgccgcgccgaccaccauccagaacauccaccccagccccaccaaccguuccaagcggaaccuggagauggagaucauccugacgcucccccaggggcugaagaaguacuacggcaagaucuuaaagcuccugcaccugacccucgaggaggacaccgaggggcugcuggaguggugcaagcgcaaccucggcagcaacugcgacgacgaguucuuccagaagcggaucgaggaguucuucaucaccggggagggcuacuucaacgaggugcugcaguucaagacgcuguccacccucagcccgaccgagcccucccacgcccggcccccgaccgccgagcccuucaagagcuacuucgcgaaaggcuuccuguccaucgacagcggguacuucuccgccaaaugcuacccccgcagcuccacgagcggccugcaacucaucaacaucacccagcaccccgcucgcauugcagagacuccggggcccaagaccacgucgcugaagaccaucaacugcaucaaccugcgggcuagcgucuucaaggagcaccgcgagguggagaucaacguguuacugccccagaucgccgucaaccuguccaacugccacguggugaucaacagccacgucugcgacuacucccucgacaccgacggccccgugcggcugccgcgcaucuaccacgagggcaccuucauccccgggacguacaagaucgugauugacaagaagaacaagcugaacgaccggugcacccucgucaccaacugugugaucaagggccgcgaggugcggaaggggcagagcgucuuacgccaguacaagaccgagaucaagaucggcaaggccagcacggggucccggaagcugcucagcgaggagccuggcgacgacugcaucucccgcacccagcugcugcgcaccgagaccgcggagauccacgacgacaacuacggcgggcccggcgacaagaucacgaucugcaacgggagcaccaucguggaccagcggcucggcuccgagcuggggugcuacaccaucaaccgcgucaagagcuucaagcugugcgagaacuccgccaccgguaagacgugcgagaucgacagcaccccggugaagugccggcaaggcuucugccucaagaucacccaggaggggcgcggccacgugaaguuaucccgggggagcgaggugguccuggacgccugcgacuccagcugcgaggugaugaucccaaagggcaccggggacauccuggucgacugcuccggaggccagcagcacuuccucaaggacaaccugaucgaccuugggugcccccacaucccccuccugggcaagauggccaucuacaucugccgcaugagcaaccacccgcggacgaccauggccuuccuguucugguucuccuucggguacgugaucacgugcaucuucugcaaagcccucuucuacagccugaucaucaucggcacccugggcaagaagaucaagcaguaccgcgagcucaagccccagaccugcaccaucugcgagaccgcccccgugaacgccaucgacgccgagaugcacgaccugaacuguuccuacaauaucugccccuauugcgcgagccggcugaccuccgacgggcucgcccgccacgucacccagugcccgaagcggaaggagaaggucgaggaaacggagcuguaccuuaaccucgagcguauccccuggaucgugcggaagcugcugcaggucagcgagucaaccggcguggcccucaagcgcuccagcuggcugaucgugcugcucguccugcugaccgugucccucagccccgugcaguccgcacccgucgggcacggcaagaccaucgagacguaccagacgcgcgagggauucaccagcaucugccuguucaugcugggguccauacucuucaucgugagcugccuugugaagggccuggucgacuccgugagcgacucguucuucccggggcucagcgugugccggaccugcuccaucggcagcauaaacggguucgagaucgagucccacaagugcuacugcagccuguucugcugucccuacugccggcacugcuccgccgaccgcgagauccaccagcugcaccucucgaucugcaagaagcggaagacgggcuccaacgucaugcuggcggugugcaagcgcaugugcuuccgcgccaccauggaggccucucggcgcgcccugcucauccgcagcaucaucaauaccaccuucgugaucugcauccugacgcugaccaucugcguuguguccaccagcgccguggagauggagaaccuccccgcggggaccugggagcgcgaggaggaccugacgaacuucugccaccaggagugccaggucaccgagaccgagugccugugccccuacgaggcccucgugcugcggaagccccuguuccucgacuccaucgugaagggcaugaagaaccugcugaacucaaccucccucgagacgagccuguccaucgaggcccccuggggcgccaucaacguccagagcaccuucaagcccaccguguccaccgccaacaucgcguuaagcugguccagcguggagcaccgcgggaacaagauccucgucacgggccgguccgagagcaucaugaagcuggaggagcgcaccgguguguccugggaccugggcguggaagacgccagcgaguccaagcuccugaccgucagcaucauggaccuuucccagauguacagcccgguguucgaguaccucagcggggaccgccagguggaggaguggcccaaggcgaccugcacgggcgacugccccgagcgcugcggcugcaccuccuccacgugccugcacaaagaguggccccacagccggaacuggcgcugcaauccgaccuggugcuggggcguagggaccgggugcacgugcugcggcguggacgugaaggaucuguucaccgaccauauguucgucaaguggaagguggaauacaucaagaccgaggccaucgugugcgucgagcucaccagccaggagcggcagugcucccugaucgaggccgggacccgcuucaaccugggccccgugaccaucacccucagcgagccccggaacauccagcagaagcugcccccggagaucaucacccugcacccaaagaucgaggagggcuucuucgaccucaugcacgugcagaagguccuguccgccagcacggugugcaagcugcaguccugcacccacgggauccccggugaccuccagguguaccacaucgggaaccugcugaagggcgaccgcgucaacggccaccucauccacaaaaucgagccccacuucaacaccagcuggauguccugggaugggugcgaccuggacuacuacuguaacaugggcgacuggccgagcugcacauacacgggggugacccagcacaaccacgccgcuuucgugaaccugcucaacaucgagaccgacuauaccaagacguuccacuuccauucgaagcgggucaccgcccacggcgacacgccccagcuggaccugaaggcgcgccccaccuacggggccggcgagaucaccgugcucgucgagguggccgacauggagcugcacaccaagaagguggagauuagcggccugaaguucgccucccucgccugcaccgggugcuacgcgugcagcuccggcaucuccugcaagguccguauccacguggacgagcccgacgagcugaccgugcacgugaaguccagcgacccggacgugguggccgccagcacgucccuaauggcccgcaagcucgaguucgggaccgauagcaccuucaaggccuucuccgcgaugcccaagaccucgcugugcuucuacaucgucgaacgggaguacugcaaauccugcagcgaggacgacacgaagaaaugcguggacacgaagcuggagcagccccaguccauccucaucgagcacaagggcaccaucaucgggaagcagaacgacacaugcaccgccaaggccagcugcuggcuagagagugucaagagcuucuucuacggccugaagaacaugcucggcuccguguucgggaacuucuucaucggcauccugcuguuccucgcccccuucgugcugcuggugcuguucuucauguucggguggaagauccucuucugcuucaagugcugccgccgcacccggggccuuuucaaguaccgccaccugaaggacgacgaggagaccggguaccggcgaaucaucgagcggcucaacaacaagaagggcaagaaccgccugcuggacggcgagcggcucgcggaccgcaagaucgccgagcuguucagcaccaagacucacaucggguaa

SEQ ID NO: 15251 - RNA, 5067 nt, Artificial Sequence
  derived and/or modified CDS sequence (opt11) from CCHFV(V42/81)__GU477490.1__GP
augcccaccaauaccaugcacacgcugcucgugugcuucauccuguacuuacagcuccugggccucgggggcgcccauguccaaccgaacgccaccgaacacaaccgcaccaacaccacgaccgcgcccgggaccagccacucccucaagccccuggugagcaccacgcccccucaggcccccgaguccagcaccaucaaacccaccacccccacguccgagaccgagggcagcggggaggccaccccguuauccaacaccauccaggccccuagcucccccgagacuaccagcgagcggcccgccaccgcggugaucuccaccagcggcacggacuccaccaacagcaccacccagacgaccgacaacaacccgaccaccacggucgggaccucccccagcuccagccccuccacccccagcaccccgcaggggauccaccaccacgcccgcagccuccuguccguaacgagccccgagaccgugacuacccccaagcccacgucgccccgggagaugagcuccgaaaccagcaaccagcacuccgccaugagccgcacccccacccaccacacugucacccaggugucuaccgagaacaccagccacuccacgccccggcagcccgagagcuccgcccaaccgacgagcuccagccccaugaccucccccgcgcagagcacccugcucauguccgccgcccccaccgccgugcagagcauccacccgagccccacgaaccgcuccaagcggaaccuggagaccgagaucauccugacccucagccagggccugaagaaguauuacgggaagauccugaagcugcugcaccugacccucgaggaggacacggagggccugcuggaguggugcaagcgcaaccucgggucuaacugcgacgacgacuucuuccagaagcggaucgaggaguucuucaugacgggcgagggcuacuucaacgagguccugcaguucaaaacccccagcaccguguccccgacggagcccagccacgcccgccugcccaccgcggagccauucaaguccuacuucgccaagggguuccucagcaucgauuccggcuacuucagcgccaagugcuacucccggagcuccaccagcgggcugcagcugaucaacgugacccagcauccggcccgcaucgccgagacgcccggccccaagaccaccucccucaagaccaucaacuguaucaaccugcgggcgagcgucuucaaggagaaccgcgagaucgagauuuccgugcugcucccccagauugccgugaaccugagcaacugccacgucguaaucaacagccaugugugcgacuacucccuggacacggacggcccgguccggcucccccgcaucaaucacgaggggaccuucauccccggcaccuacaagauagugaucgacaagaagaacaagcugaacgaccggugcacccuggugacgaacugcgucaucaaggggcgcgaggugcggaagggccagagcgugcuccgccaguacaagaccgagaucaagaucgggaaggccagcaccggcagccggaagcugcuguccaaggagcccggcgacgacugcaucagccgcacccagcucaugcgcacggagaccgccgagauacacgacgacaacuacggcggccccggggacaagaucaccauaugcaacggcuccaccaucgucgaccagcggcuggggagcgagcugggcuguuacacgaucaaccgcgugaaguccuucaagcucugcgagaacagcgccaccggcaaggcgugcgaggucgacuccacucccgugaagugccggcagggguucugccugaagaucacccaggagggccgugggcacgugaagcugagccggggcuccgaggucgugcucgacgccugugacagcuccugcgaggugaugauccccaaggggaccggcgacauucuggucgacugcagcggcggucagcagcacuuccugaaggacaaccugaucgaccucgagugcccccauaucccgcugcugggcaagcucgccaucuacaucugccgcauguccaaccacccccggacgaccauggccuucuuguucugguucggguucgguuacgugaucacgugcauccuguguaaggccuuguucuacagccuaaucaucaucggcacccugggcaagaagaucaagcaguaccgcgagcucaagccccagaccugcaccauaugcgagaccgcgcccgugaacgccaucgacgccgagaugcacgaccugaacugcuccuacaacaucugcccguacugcgccagccggcugacgagcgacggccucgcgcgccacgucacgcagugccccaagcggaaggaaaagguggaggagaccgagcuguaccugaaccucgagcgcauccccuggaucgugcggaagcugcugcaggucuccgagagcaccgggguggugcucaagcgcuccagcuggcugaucguccugcucgugcugcugaccgugucccucagccccguccaguccgccccggugggccacgggaagacgaucgagaccuaccagacccgggagggcuucaccagcaucugccuguucaugcugggcuccauccucuucaucgugagcugcaucguuaaggggcugguggacuccgugagcgacuccuucuuccccggccugagcgucugcaagacgugcuccaucagcuccaucaacggguucgagaucgagucgcacaagugcuacugcucccucuucugcugccccuauugccgccacugcucugcagaccgggagauccaccagcuccaccugagcaucugucgcaagcggcgcaccggcuccaacgugaugcucgccgugugcaagcgcaugugcuuccgggccaccauugaggucagccgccgggcgcugcugauccgcuccaucaucaacaccacguucgugaucugcauacucacccugaccaucugcguggugagcaccuccgccguggagauggagaaccugccggccgggacgugggagcgggaggaggaccucaccaacuucugccaccaagagugccaggugacggagaccgagugccugugccccuacgaggcccugguccuccgcaagccccuguuucuggauagcaucgugaagggcaagaagaaccuccugaacuccacgagccuggaaaccucccucagcaucgaggcccccuggggcgcgaucaacauccaguccacguucaagccaaccgucagcgccgccaacaucgcccuguccuggagcuccgucgagcacagggggaacaagauccuggugagcggccgcuccgagagcaucaugaagcucgaggagcggacggggguguccuggaaccugggcgucgaggacgccagcgagagcaagcuacucaccguguccaucauggaccugagccagauguacucccccguguucgaguaccugagcggggaccgccaggucgaggaguggcccaaggcgaccugcaccggcgacugccccgagcggugcggcugcacguccagcacgugccuccacaaggaguggccgcacucccgcaacuggcggugcaaccccaccuggugcuggggcguggggaccgggugcacgugcugcggcguggacgucaaggaccuuuuuaucgaccacauguucgucaaguggaagguggaguacaucaagacggaggccaucgucugcguggaacugaccagccaggagcgccagugcucccugaucgaggccgggacccgguucaaccugggccccgugaccaucacccugucugagccucgcaacauccagcagaagcucccgcccgagaucaucacccugcaccccaagaucgaggagggcuucuucgaccugaugcacguccagaaggugcucagcgccagcaccguaugcaagcugcaguccugcacccaugggauccccggcgaccuccaggucuaccacaucgggaaccugcugaagggcgaccgggugaacggccaccugauccauaagaucgagccgcacuucaacacgagcuggauguccugggacggcugcgaccucgacuacuacugcaacaugggcgacuggcccagcugcaccuacaccggggucacccaacacaaccacgcggccuucgugaaccugcuuaacaucgagacggacuacaccaagaccuuccacuuccacuccaagcgcgugaccgcccacggcgagacgccccaacucgaccugaaggcccggcccgccuacggggcgggcgagaucaccgugcugguggagguggccgacauggagcuccacaccaagaaggucgagaucagcggccugaaguucgccucccuggccugcacagggugcuacgccugcagcagcggcaucuccugcaaggugcgcauccacguggacgagccggacgaguuaacaguccacgucaagagcaacgaccccgacgugguagcggccuccaccagucugauggcccggaagcuggaguccgggaccgacagcaccuucaaggccuucuccgccaugcccaaaacgagccucugcuucuacaucguggagcgcgaguacugcaaguccugcagcgaggacgacacccagaaaugcguggagaccaagcuggagcagccccaguccauccugaucgagcacaagggcacaaucaucgggaagcagaacgacacgugcaccgcgaaggccagcugcuggcucgaguccgucaagagcuucuucuacggccugaagaacaugcugggcuccguguucgggaacuucuucaucgggauccuccuguuccuggccccguucgugcuccugguccuguucuuuauguucggguggaagauccuguucugcuucaagugcugccgccggacccgcggacucuucaaguaccggcaccugaaggaggacgaagagaccgguuaccgccggaucaucgagcgccugaacagcaagaagggcaagaaccggcuccuggacggcgagcgccuggccgaccggaagaucgcggagcuguucuccacgaagacccacaucggguga

SEQ ID NO: 15252 - RNA, 5067 nt, Artificial Sequence
  derived and/or modified CDS sequence (opt11) from CCHFV(ROS/HUVLV-100)__DQ206448.1__GP
augcccaccaauauaaugcacacccugcuuguguguuuuauccuguaccugcagcuccugggccucgggggagcccaccgacagagcaacgcuacggagcacaacgggacuaauaccaccacggcgccguccaccagccaguccccgaagccccuggucagcaccgcgcccccgcacgcccuggaguccagcaccaucaagcccacuacgccugugucagagacugagggcagcggagagaccacgcccccgcccaacaccacccagggccccuccccgcccgaggccacccccgaaaggcccacgaccaccgccacgagcacgcccuccaccgauaacaccaacagcaccacgcacgugaccgacaacaauccgaccucaaccaucagcacgucccccagcucuagccccuccacccccagcaccccgcaggguauccaccaccccgcccgcaaccugcucagcgucagcagcccaaagacggccacgacgcccaccccgaccucccccggggagaucagcuccgagacgagcuccuuacauagcgcuaugucccggaccagcacccuguacacggccacccaaguuuccacggagaacgcgaaucacucugcgccucgucagagugagagcuccgcccaacagaccaccaccagccccaugacguccccggcccagagcauacucgucauguccgccgcaccuaccgccauccagaacauccacccaagcccgacgaaccggagcaaacgcaacuuggagauggagaucauucucacccugucccagggccugaagaaauacuacgggaagauccugaagcuccuucaccucacgcucgaggaggacaccgagggccuccuggaguggugcaaacggaaccuuggguccaacugcgaugacgacuucuuccagaagcgcauugaggaguucuucaugacuggcgaaggcuacuuuaacgagguccugcaauucaagacccuuuccacgcucagccccaccgagccaucccacgcccguccgccgaccguggagccguucaagagcuacuucgccaagggauuccuuuccaucgacucaggcuacuucucugcgaaaugcuacccccgccugagcacguccgggcuacagcugauuaacgugacgcaacacccggcgcguaucgcugaaaccccuggccccaagaccaccagccugaagacgaucaacugcauaaaccuccgagccuccgucuucaaggagcaccgggagaucgagaucaacgugcugcugccgcagaucgccgugaaccucagcaauugccacgucgugaucaacucucacgugugugacuacagccuagacaccgacggcccuguccgccuaccgcacaucuaccacgaggggaccuucauccccggcaccuacaagaucguaaucgacaaaaagaacaagcucaacgaccggugcacgcuagugaccaacugcgucaucaaggggagagaggugcggaagggccaguccgugcugcgccaguauaagaccgagaucaagaucgggaaagcuagcaccggcagccggaagcuccuguccgaggaacccggcgacgauugcaucagccgcacgcagcugcuccggaccgagaccgcggagauccacgacgauaacuaugguggcccaggggauaagauuaccaucugcaacggguccacgaucgucgaccagcgccuggggagcgagcugggcuguuacaccaucaaccgcgugaaguccuucaaguugugugagaacagcgccacgggcaagaccugcgaaaucgacuccacgccggugaagugccggcagggguucugccugaagaucacccaagagggccgagggcacgucaaguugagccggggcuccgaggugguccuggacgccugcgacagcuccugcgaggugaugauccccaaggggaccggcgacauacucguggacugcagcggcgggcagcagcacuuuuugaaggacaaccugaucgaccucgguugcccccacaucccccugcuggggaaaauggcuaucuacaucugccguauguccaaucacccgcggaccacgauggccuuccucuucugguucagcuucggcuacgucaucacgugcaucuucugcaaggcgcuguucuacucgcugaucaucaucgguacccucggaaagaagaucaagcaguaccgcgagcugaagccacagaccugcaccaucugcgagaccgcgcccgugaacgccauagacgccgagaugcacgaccugaacugcagcuacaacaucugccccuacugcgcgagucgauugaccagcgacgggcuggccaggcacgucccgcagugcccgaagcggaaggagaaggucgaggaaaccgagcuguaccucaaccuggagcgcauccccuggaucgugcggaagcugcuccagguguccgagagcaccggggucgcccugaagcgaaguuccuggcugaucguccuauuaguccugcuuacugucagccugucuccggugcagagcgcccccgugggccacgggaagaccaucgagaccuaccagacccgggagggcuucacguccaucugccucuucaugcucggcagcauccuguuccuagucagcugccucgugaaggggcugguggacagcguuuccgacaguuucuuccccggcuuaucugugugcaagaccugcuccauaggguccaucaacggcuucgagaucgagagccacaagugcuacuguucccucuucugcugccccuacugcaggcauugcagcgccgaccgggagauccaucaacugcaccuuuccaucugcaaaaagcgcaaaaccggaagcaacgugaugcucgcgguaugcaagcggaugugcuuccgugccaccaucgaggccucccggcgcgcccugcugauccgcagcauuaucaacacuaccuucgugaucugcauccucaccuuaaccaucugcgucguuucgacguccgccguggaaauggagaaccucccgagcggcaccugggaacgggaggaggaccucaccaacuucugccaccaagagugccaggugaccgagacugaaugccugugccccuacgaggcgcugguccuccgcaagccccuguuccuggacuccaucgugaagggcaugaaaaaccuccuaaacucuacgucccuggagaccagccucucgaucgaggcccccuggggcgcgaucaacgugcagucuaccuucaagccgacggucuccaccgccaacaucgcccugagcugguccagcguggagcaccggggcaacaagauccuggucaccgggcgcagcgaaagcaucaugaaguuggaggagcggaccggcgucuccugggaccugggaguggaggacgccagugaguccaaacuucucaccgugagcaucauggaccucagccagauguacagccccgucuucgaauaccucagcggcgaucgccagguggaggaauggcccaaggcgaccugcaccggcgacugccccgaaaggugcgggugcaccuccagcacgugccuccacaaggaguggccgcacuccaggaacuggcguugcaaccccaccuggugcuggggaguggggacagggugcacaugcuguggaguagacgugaaggaccuguucaccgaccacauguucgugaaguggaaggucgaguacaucaagaccgaggccaucgugugcguggaguuaaccagccaggagcgccaaugcucccucaucgaggccggaacacguuucaaccugggccccgucaccaucacgcugagcgagccccgcaacauucagcagaagcucccgcccgagaucaucacccugcaccccaagguugaggaaggguucuucgaccugaugcaugugcagaagguccucuccgcaagcaccgugugcaagcugcaguccugcacacacggcauccccggggacuugcagguauaccacaucggcaaccugcugaagggcgaccgggucaacgggcaccugauccacaagaucgagccgcacuucaacacuagcuggauguccugggacgguugcgaccucgauuacuacugcaacaugggggacuggcccagcugcaccuacacgggggugacccagcacaaccacgccgccuuugugaacuuacugaacaucgaaacggacuauaccaagaccuuccacuuccacuccaagcgcgugaccgcccacggggacacuccccaacuugaccugaaggcccgucccaccuacggcgcaggcgagaucaccguguuggucgagguggccgauauggagcugcacaccaagaagguagagaucagcggguuaaaguuugccagucuggccugcacggguugcuaugcaugcagcuccgggauuagcugcaagguccgcauccacgucgacgagcccgacgaacucaccgugcacgucaaguccucggaucccgacgugguugcggcgagcaccucucucauggcccggaagcuggaguucggcaccgacagcacguucaaggccuucucggcuaugcccaaaaccagccuuugcuuuuacauugucgaaagagaguacugcaaguccugcagcgaggaggacacgcagaagugcguggacaccaagcuggagcaaccccagucaauccugaucgaacacaaggggacgaucaucggcaagcagaacgacacgugcaccgcgaaggcaagcugcuggcucgaguccguuaagagcuucuuuuacgggcugaagaauaugcugggguccguguuuggcaacuucuucauugggauucuccuguuucuggccccguucguacugcucguguuguucuucauguucggcuggaagauccuguucugcuucaagugcugccggaggacccggggacuccugaaguaccggcugcucaaggacgacgaggagaccgguuaccgccggaucaucgagcgccugaacaacaagaagggcaagaaucggcugcucgacggagagcgccuggccgaucggaagaucgcggagcuguucagcaccaagacucacaucggcuga

SEQ ID NO: 15253 - RNA, 5067 nt, Artificial Sequence
  derived and/or modified CDS sequence (opt11) from CCHFV(5180-R-2011)__KR814874.1__GP
augcccaccaacaucaugcacacucugcucgugugcuucauccuguaucuucagcuccugggccucgggggagcucacagacagagcaacgccacggagcacaacgggaccaacaccacuacggcgccguccaccagccagucccccaagccgccuguaagcacagccccgcccuacgccccagagucuagcaccaucaaaccaacgacucccgccucggagaccgagggcaguggggagaccacacccccacccaacaccacccaaggccccucuccuccugaggccacccccgagcggcccgcaacgaccgccaccagcacccccuccacggacaacaccaacagcaccacccacgcgacggacaacaaccccaccuccacuaucagcaccuccccaucgagcagcccguccacgccgagcacgccccagggcauccaccauccugcccgcaaccuuuuaucaguguccucuccgaagaccgcgaccacccccacccccaccucccccggggacaucagcuccgagaccagcucccugcacagcgcuaugucacggacaccgacccuccacaccgccacccaggccagcacagagaacgccaaccacuccgcgcccaggcagagcgaauccagcgcgcaacaaacaaccaccucccccaugaccagcccggcccagcccauccuugugauguccgcagcucccacggcaauccagaacauccaccccagcccgacgaaccgcucaaagcgcaaccuggagauggagaucauccucacacugagccagggccugaagaaauacuacgggaagauccucaagcugcugcaucucacccuggaggaggacacggagggccugcucgaguggugcaagaggaacuuggggagcaacugcgacgacgacuucuuccagaagcgcaucgaggaguucuucaugaccggcgagggcuacuucaacgaagugcugcaauucaagacccucagcacccuuagccccacggagcccucccacgcccggcccccgaccguggagcccuucaagagcuacuucgccaagggauucuuauccaucgacagcggcuacuuuuccgcaaagugcuacccgcgccucagcaccuccgggcugcagcugaucaacgucacccagcaccccgcccggaucgcggagacccccggccccaagaccaccucacucaaaaccauuaacugcaucaaccugcgcgccuccgucuucaaggagcaccgggagaucgagaucaacgugcugcucccccagaucgccgugaaccugagcaacugccaugucgugaucaacucccacgugugcgacuacagccuggacacggacggcccgguccgcuugccgcacaucuaccacgaggggaccuucauccccggcacguacaagaucgugaucgacaagaagaacaagcugaaugaccggugcacccuggugacgaacugcgucauuaaggggcgcgagauccggaagggucaguccgugcuccgccaguacaagaccgagaucaagauaggcaaggccagcaccggcuccagaaagcugcugucagaggaacccggcgacgacugcaucagccgcacccagcuucugcggacggagaccgcagagauccacgacgacaacuacgggggccccggcgacaagaucacgaucuguaacggcaguaccaucguagaccaacgacuggggagcgagcucggcugcuacacuaucaaccgcgucaaguccuucaagcuaugcgagaacagcgcgacuggcaagaccugcgagaucgacuccaccccggugaagugccggcagggguucugccugaagaucacgcaggaaggcagagggcacguaaaauuaagccggggcagugagguggugcuggacgccugcgauaccagcugcgaagugaugauacccaaggggacuggagacaucuuagucgacugcuccggcgggcaacagcacuuucugaaggacaaucucaucgaccugggcugcccacacaucccccuauuggggaaaauggccaucuacauuugcagaaugagcaaccaccccagaaccaccauggccuuccuauuuugguuuuccuucggcuacgugaucacgugcaucuuuugcaaggcgcuguucuacagccucaucaucaucgggacccuggggaagaagaucaagcaguaucgugaguuaaagccccagaccugcaccaucugcgagacggcccccgucaacgcuaucgacgccgagaugcacgaccucaacugcuccuacaacaucugcccauacugcgcaagccggcugacuagcgacggccuggcgcgccacgugccccagugccccaagcggaaggagaagguugaggagaccgagcucuaccugaaccuggagcgcauuccauggaucguccggaagcuccuucaggugagugaguccaccgggguggcuuuaaagagguccuccuggcucaucguccugcuggugcuucugacggugagccuuagcccuguccagucagcccccgugggccacggaaagaccaucgaaaccuaucagacccgggagggcuucacaagcguuugucucuucaugcugggcucgauccuguuucucgucagcugccuggugaaagggcugguggacucuguaagcgacuccuucuuccccggccucagcgugugcaagaccugcucgaucgguagcaucaacggcuucgagaucgagucccacaagugcuacugcagccuguucugcugccccuacugccgccacugcucggccgaccgggagauucaccagcugcaccucagcaucugcaagaagcgcaagaugggguccaauguaauguuggccgucuguaagcggaugugcuuccgcgcgaccaucgaggccagccgucgcgcccugcuuauacgcuccauuauaaacaccacguucgugauuugcauccugacccugaccaucugcgugguaagcaccuccgccguggagauggagaaccucccaucaggcacgugggaacgggaggaggaccugaccaacuucugccaccaggagugccagguuaccgagaccgagugccugugccccuacgaggcccucguccugcgcaaaccccuguuccucgacucaaucgugaagggcaugaagaaccuguuaaacucgacgagcuuagaaaccucccugagcauagaggcgcccuggggcgccaucaaugugcaguccaccuucaagccgaccgucagcacggccaacaucgccuuaucauggucauccguggagcaccgggggaauaagauccuugugaccgggcgcagugagaguaucaugaaguuggaggaacggacaggcgucagcugggaucugggggucgaggacgcguccgagagcaagcuccuaaccguguccaucauggaccucagccagauguacucccccgucuucgaguaccucagcggcgaccgccagguagaggaguggcccaaggccacgugcaccggcgacugccccgagcggugcgggugcaccuccuccacgugucuccacaaggaguggccgcauagcaggaacuggcggugcaacccuaccugguguuggggcguggguacuggcugcacgugcugcggggucgacgugaaggaccuguucaccgaccacauguucgugaaguggaaggucgaguacauuaagaccgaggcgauugugugcguggagcucaccagucaggagcgccagugcagccugaucgaggccggcacccgguucaaccugggccccgucaccaucacgcucuccgagccccgcaacauccaacagaagcuaccgcccgagaucaucacgcuccacccuaagguggaagagggguucuucgaucucaugcacgugcagaagguccugagcgccuccacgguguguaagcugcaaagcuguacgcacggcauccccggggaccuccagguguaccacaucggcaaccugcugaagggcgaccgggugaacggucaccucauccacaagauugaaccgcacuucaacacguccuggaugagcugggacggcugcgacuuggacuacuacugcaacaugggggacuggcccagcugcacguacaccggugugacccagcacaaccaugcggccuuuguuaaccugcucaacauugagaccgacuacacgaagaccuuccacuuucacagcaagcgagucaccgcccacggcgacacgccucagcuggaucugaaggcccgacccaccuacggugccggcgagaucaccgugcucgucgaaguggcggauauggagcugcacaccaagaagguugagaucuccgggcugaaguucgccagccucgccugcaccggcugcuacgccugcuccagugggauuuccugcaagguccgcauccauguggaugagccggacgagcugacggugcacgucaagagcaacgacccugacgugguggccgcguccaccagucugauggcucggaagcucgaguucggcaccgacuccaccuucaaggccuucagcgccaugcccaagacgagcuuaugcuucuacauuguggagcgcgaauacugcaaguccugcucagaggaggacacacagaagugcguagacaccaagcuggagcagccgcagaguauccucaucgagcacaaggggacuauaaucggcaagcaaaacgauaccugcacagcgaaggcaagcugcuggcuggaguccguuaagagcuucuucuacggcuuaaagaacaugcucggguccguguucggcaacuucuucaucgggauccugcuguuccuugcccccuucgugcuguuagugcuguuuuucauguucggguggaagauccucuucugcuuuaaguguugccggcgcacccgggggcugcugaaguaccgcuugcugaaggacgacgaggagaccggcuaucgccggaucaucgagcgccugaacaacaagaagggcaaaaaccgucucuuggacggggagaggcuggccgaccggaagaucgcagaauuguuuucaacgaaaacccacaucggcuga

SEQ ID NO: 15254 - RNA, 5067 nt, Artificial Sequence
  derived and/or modified CDS sequence (opt11) from CCHFV(5170-R-2011)__KR814873.1__GP
augcccuuuaacaucaugcacacccugcucgugugcuucauacuauaccugcagcuuucgggccucgggggcgcccacgggcaguccaacgagacugagcauaacggcacgaacaccaccacaguaccggggacgagccagucccccaagcccccugccucgacgacccugcagcacacgccggaguccucgacggugaagcucaccacccccaccagugagacggagggaaguggcgagaccaccccgcccccgaacaccacgcagggccugcccccgcccggcaccacaccagagcgcuccgcgacgacggccaccagcaccuccagcaccgacaacaugaacaguacgacccaggugaccgacaacaccccuacgagcaccgucuccaucagccccuccucuucccccagcaugccgagcacuucccaggggauccacuacccaauccggucacugcucuccgugagcucccccaaaacagugacaacgcccacuccgaucagccccggcgagaugucccccgagaccagcucccagcacagcgccaugucccgcaucccaacgcuguacaccgccacccaggucagcaccgagaauaccaaccgguccacuccgcgccagagcgaguccucggugcagcccgccacccagucccccaucaccucgccugcgcagaccauccugcucauguccgcugccccaaaggccauacaggacaugcaucccucacccacgaaccggagcaagcgcaaccuggaggucgagaucauccugacccucucccaggggcuuaagaaguacuacggcaagauccugaaguugcugcaccugacucucgaggaggacaccgaggggcugcucgaguggugcaagcggaaucucgggagcaacugcgacgacgacuucuuccagaagcgcaucgaagaguucuucaucacgggcgagggguacuucaaugagguccugcaguucaagacccuguccaccuugagcccgaccgagcugucccacgugcggcugcccacggcggagcccuucaaauccuacuucgccaagggcuuccucuccaucgauaguggcuauuucuccgccaagugcuacccccgcagcuccaccagcgggcugcagcuuaucaacgugacccaacacccggcucggaucgccgagaccccuggucccaagacgaccuccuuaaaaacaaucaacugcaucaaccugcgugccagugucuucaaggagcaccgggaaguggagaucaacgugcugcucccacaaaucgcggucaaccuguccaacugccacguggugaucaacagccacgucugcgacuacucccuggauaccgacggccccgugcgccucccccggauccaccacgagggcacguucauucccgggaccuacaagaucguuaucgauaagaagaacaagcugaacgaccgcuguagccuggugaccaacugcgucauaaagggcagggaggugcgcaagggccaaaguguccuccggcaguacaaaaccgagaucaagaucgggaaggcuuccacaggcagccgcaagcugcugagcgaggagcccggugacgacugcaucagccggacccagcucuuaaagaccgagaccgcugagauccacgacgacaacuacggcgggccgggcgacaagauaacgaucugcaacggcuccaccaucguggaccagcgccugggaagcgagcuaggcugcuacaccaucaaucgcgucaaguccuuuaagcugugcgagaacagcgccaccgggaagacgugcgagaucgacuccacccccgugaagugccggcagggcuucugccugaagaucacccaggaggggagaggccacgugaagcugagccggggcuccgaggucgugcucgacgugugcgacagcuccugcgagaucaugauccccaaggggaccggcgacauccuggucgacugcagcgggggccagcagcacuuccugaaggacaaccucaucgaccugggcugcccccacaucccgcugcucgggaagauggcuaucuacaucugcagaauguccaaccacccacggacgacgauggccuucuuauucugguucagcuuuggcuacgugauaaccugcaucuucugcaaggcccuguucuacucccucaucaucaucgggacuuuagggaagaagaucaagcaguacagagagcuaaagccccagaccugcacgaucugcgagacagcacccgugaaugccaucgacgcggagaugcacgaccucaacugcagcuacaacaucugcccguauugcgcaucccggcugaccagcgaggggcuagcccgccacgucacccaaugccccaagcggaaggagaagguggaagagacggagcucuaccugaaccuggagcgcaucccauggauuguucguaagcuccuccaggugagcgagucgaccgguguggcccugaagcgcucaaguuggcugaucgugcucuuaguccuccucaccgugagcuuaucccccgugcagagcgcuccggucggccaugggaagaccaucgagacguaccagacccgggagggcuucaccuccaucugccucuucauguuagggagcauccuguucauaguguccugucucgugaagggccuggucgacagcguguccgacagcuucuuucccgggcuguccgugugcaagaccugcagcaucggcucaaucaacgguuucgagauagagagccacaaguguuacugcucccucuucugcugccccuacugccgccacugcagcgcggaccgggaaauucaccagcugcaccuguccaucugcaagaaacgcaagacuggaagcaacgucaugcucgccgugugcaaacggaugugcuucaaggccacgaucgaggccagccgccgggcgcugcugauccgcucuaucaucaacaccaccuucgugaucugcauccucacgcucgccaucugcgucgugaguaccuccgcaguggaaauggaggaccugccggcaggcaccugggagagagaggaggaccucaccaacuucugccaccaggagugccaggucacggagaccgaaugccugugccccuacgaggcucugguguuacggaagccccuguuccuggacagcaucgugaaggggaugaagaaccugcugaacuccaccagccucgagaccucccucucaaucgaggcgcccuggggagccauaaacguccagagcacguucaagccgaccgugagcaccgcgaacaucgcccuguccuggagcuccguagaacaccgcgggaacaagauccuggucacgggucggagcgaguccaucaugaaacuugaggagcgcacgggcgugucaugggacuuagggguggaggacgccuccgagagcaagcugcucaccguauccaucauggaccugagccagauguauucccccguguuugaguaucuguccggcgaccgccagguggaggaguggcccaaggcuaccugcaccggggacugccccgagcggugcggcuguacgagcuccaccugucuccacaaggaguggccgcacagccggaauuggcgcugcaaccccaccuggugcuggggugucggcaccggcugcacgugcugcgggguagacgugaaggaccuguucacugaucacauguucaucaaguggaaggucgaguacaucaagaccgaagcaaucgugugcguagagcugaccucccaggagcggcagugcucucucaucgaggccggcacccgcuucaaccuggggcccgucacgaucacccuguccgagccccggaacauccagcagaagcugccacccgagaucaucacucugcaccccaagaucgaggaaggcuucuucgaucugaugcacgugcagaagguucucucagccuccaccgucugcaagcugcaguccugcacgcauggcauccccggagaccugcagaucuaccacaucggcaaccuccugaagggggaccgcgucaauggccaccugauccacaagaucgagccgcacuucaacaccuccuggaugagcugggacgggugcgaccuagacuacuacugcaacaugggcgacuggcccuccugcaccuauaccggcgucacgcaacacaaucaugccgccuucgugaaccuguuaaacauugagaccgacuauaccaagaccuuucauuuccacagcaagcggguuacggcccacggggacacgccccagcuggaccucaaggcacgccccaccuacggcgccggggagauuaccguccugguggaagucgcggacauggaacuccacaccaagaaggucgagaucuccggccugaaguucgccagccugaccugcaccggaugcuacgccugcuccagcgguauuuccugcaagguucgcauccacguggacgaaccggacgagcucaccguccacguaaagagcuccgaccccgacguggucgccgccuccacgagccugauggcgcgaaaguuggaguucggcaccgacuccaccuucaaggccuuuagcgcaaugcccaagaccucguuaugcuucuacauuguggagcgggaguacugcaagucgugcuccgaggacgacacgaaaaagugcguggauaccaagcuggagcagccccaaagcauccugaucgaacauaaggggaccaucaucggcaagcagaacgauaccugcacagccaaagcgagcugcuggcucgaaucggucaagucuuucuucuacgggcugaagaacauguugggcagcguguuuggguccuucuucguaggaauccuccuguuucuggcgccguuuguccugcucgugcuguucuuuauguucggcuggaagauccuguucugcuucaaaugcugccgccggacccgcgggcuguucaaguaccggcaccugaaggacgacgaggagacgggcuaccgccgcauaauugagaggcugaacucuaagaaagggaagaaccgcuuacuggacggcgagcggcuggccgaccgcaagaucgccgaguuauucuccaccaaaacgcauauaggauga

SEQ ID NO: 15255 - RNA, 5067 nt, Artificial Sequence
  derived and/or modified CDS sequence (opt11) from CCHFV(4701-ST-2009)__KR814872.1__GP
augccgauaaacaucaugcacacccugcucgugugcuucauccuguaccugcagcucagcggacucgggggagcccacgggcaguccaacgccaccgagcacaacggcacgaacaccaccaccgcgccagggacuagccaaucccccaagccgcccgcaagcaccacccucccgcacacccccgaguccagcacggucaagcucacgacccccacgagugaaacggaggguucuggcgagaccacucccccgcccaacaccacccagggccugccucugaccggcaccacccccgagcgcuccgccacgaccgccacgagcaccuccagcacggacaacaugaacuccaccacccaggugacugacaacacgccgaccagcaccgucuccauaucacccuccagcuccagcagcaugcccuccacuccgcaggggacucaccacccgguccggagccuccuguccguaagcucccccaagacggugaccaccccgacgcccaugagcccgggggagaugucaccugagacgagcucccagcacagcgccaugucccgcguccccacccuguauaccgcgacccaggugagcacggagaauaccgaucgguccacgccccgccagagcgaguccagcgugcagccggcaacccagucccccaucaccagccccgcccagacuauccuccugauguccgccgcgccuaaggcaauccaggacaugcauccgagcccgaccaaccgguccaagcgcaaccuagaagucgagaucauacuaacccugucccagggucugaagaaauacuacggcaaaauccucaaguugcugcaccucacucuagaggaggacacggagggccugcucgaguggugcaagcggaaccugggaagcaacugcgacgacgacuucuuucagaagcgaaucgaggaguuuuucaucacaggcgagggguacuuuaacgaggugcuacaguuuaagacccucuccacgcuuagcccaacugaaccgagccacgugcggcugccuaccgccgagccguucaagagcuacuucgccaaaggcuuccuauccaucgacagcggcuacuucuccgccaagugcuacccucgcagcucaaccagcgggcugcaacugaucaacguaacgcaacacccggcgcggaucgccgagacccccggccccaagaccaccucccucaagaccaucaacuguaucaacuugcgcgccagugucuuuaaagagcacagagagguggaaaucaacguccugcucccccagaucgccguaaaccugucgaacugccacguggucaucaauucgcacgugugcgacuacucccuggacaccgacgggccggugcgccucccccggauccaccacgagggaaccuucauccccgggaccuacaagaucgucaucgaccgaaagaacaaacugaaugaccggugcagucuggugacuaacugcgugaucaagggccgagagguucggaagggccagagcgugcuccgccaguacaagaccgagaucaagaucgguaaagccuccaccggcagccggaagcugcuguccgaggagcccggggacgacugcaucagccguacccagcuauugaagaccgagaccgcggagauccacgacgacaacuacggcgguccgggcgauaagauuacaaucugcaacggguccaccgucguggaccagcgccuggggagcgaauuaggcugcuacacgaucaaccgggugaaguccuucaagcugugcgagaacagcgccacagggaagaccugcgaaaucgacuccacccccgucaagugccgccagggauucugccugaaaaucacgcaggaagggcggggccacgugaaacugagccggggcuccgaggucguccucgacgccugugacagcuccugcgagaucaugaucccgaaggggaccggcgacauccugguggauugcagcgggggccagcagcacuuccugaaagacaaccucaucgacuugggcugcccccacaucccgcugcuugggaagauggccauauacaucugccggauguccaaucacccccgcaccaccauggccuuucucuucugguucagcuucggcuacgugaucacgugcaucuucuguaaggcuuuguucuacagccuuauuauaaucgggacccugggcaagaagaucaagcaguaccgggaauugaaaccccagaccugcaccauuugcgagaccgcccccgucaacgccauugacgccgagaugcacgaccucaacugcucauacaauauaugcccguacugcgcaucacgucugacgagcgacgggcuggcgcgucacgugacccagugccccaagcgcaaagagaagguggaggagaccgagcucuaccugaaccuugagcggauccccuggaucguccgcaaacuccuccaggugagcgaguccaccggcgucgcccugaagcggagcucguggcugaucguccuucuggugcuccugacugugucccugucccccguccagagcgccccugugggccacgguaaaaccaucgagaccuaccagacccgcgagggguucacguccaucugucucuucaugcuagggagcauccuguucaucgugucauguuuagucaagggccugguggacagcgugucugacagcuucuuccccgggcuauccguuugcaagacguguagcaucggcuccauuaacggcuucgagaucgaaucacauaagugcuacugcucccucuucugcugccccuacugccggcacugcagcgccgaccgcgagauccaccagcugcaccuguccauuuguaagaagcggaagaccgggagcaacgugaugcucgcggugugcaagcgaaugugcuucaaagccaccaucgaagccagccgucgcgccuugcugauccgcucuaucaucaacacgaccuucgucaugugcaucuuaacccuggccaucugcguggugagcaccuccgcggucgagauggaggaccugccggccggcacgugggagcgggaggaggaucucaccaacuucugccaccaggaaugccaggugaccgaaacggaaugccugugccccuacgaggcccucgugcuucgcaagccccuguuuuuagauaguaucgucaaggggaugaagaaccuccugaacuccacgagccuggagaccucccucagcaucgaggcccccuggggcgccaucaacgugcaguccaccuucaagccgaccguuuccacggcgaacauugcccuguccuggagcagugucgagcacagagggaacaagauccuggugaccggccgcagcgaauccaucaugaagcucgaggaacggaccggcgugagcugggaccugggggucgaagacgccucugagagcaagcugcuuaccguguccaucauggaccugucgcagauguacucacccguguucgaguaccuguccggcgaccgccaagucgaggaguggcccaaggccacgugcaccggggauugcccugagcggugcggcugcacaagcuccacaugccuccacaaggaguggccgcacagccgcaacuggcgguguaaccccaccuggugcuggggcguagggaccgggugcacgugcugcgggguugacgucaaggaucuguucaccgaccacauguucauaaaguggaagguggaguacauaaagaccgaggcuaucgucugcgucgagcugaccucccaggagcgccagugcagccucaucgaggcgggcacccgauucaaucucgggcccgugaccaucacgcuguccgagccccguaacauucagcagaagcucccgcccgagaucaucacucugcaccccaagaucgaggagggcuucuucgaccugaugcacgugcagaagguccucucggccuccaccguguguaagcugcagagcuguacccacggcauccccggggaccugcagaucuaccacaucggcaaccuccugaagggagaccgggucaacggccaccugauacacaagaucgagccacacuuuaacaccuccuggaugagcugggaugggugugaccucgacuacuacugcaauaugggcgacuggcccuccugcacguacaccggcgugacccagcacaaucacgccgccuucguaaaccugcucaacaucgagaccgacuacacgaaaaccuuccacuuucacagcaagcgcguaaccgcgcauggggacacgccccagcuugacuuaaaggcccggcccacguacggcgccggggagauaaccgugcugguggaggucgccgacauggagcugcacacuaagaagguggagaucuccggccugaaguucgccucccugaccugcacgggguguuacgcuugcuccagcgggaucagcugcaagguccgcauccacguugacgagccggaugagcuaaccgugcaugucaagagcagcgaccccgacgugguggccgccuccacuagccugauggcccggaagcuggaguucggcaccgacuccacguucaaagcauuuagcgcgaugccuaagaccucccucugcuucuacauuguggaacgcgaguauugcaaguccugcuccgaagaugacaccaagaagugcgucgacaccaagcuggagcagccccagagcauccugaucgagcacaaggggacuaucaucggcaagcagaacgacacaugcaccgcaaaagccuccugcuggcucgagagcguaaaguccuucuucuacggguugaaaaacaugcugggcagcguguucgguggauucuucgucggaauccuucuguuccuggccccguucguacugcucgugcuguucuucauguucgguuggaagauccuguucuguuucaagugcugccggcgcacccggggccucuucaaguaccgccaccugaaggacgacgaagagaccggguaccgccgcaucaucgaacgccuaaauagcaagaagggcaagaaccggcuccuggacggcgagcgccucgccgaccgcaagaucgcggaguuauucagcaccaaaacccacaucggguga

SEQ ID NO: 15256 - RNA, 5067 nt, Artificial Sequence
  derived and/or modified CDS sequence (opt11) from CCHFV(4574-ST-2008)__KR814870.1__GP
augcccaccaacaucaugcacacccugcucgugugcuucauccuguaccugcagcuccugggacccgggggcgcccacggccagcccaaugccacggagcacaaccgcaccaacaccaccacggcgccuagcaccucccagagcccaaagccgcccgucuccaccgccccaccccacgcccuggagagcccgaccaucaaguccacgacccccaccucggagaccgaggguuccggcgagacuacaagcccucccaacaccacccagggcccgucccucccagaaacuacccccaaacgccccgccacgacugccacgagcaccccguccaccgacaacaccaacagcacgacccacgugaccgacaacaacccaaccuccacuaucagcaccucccccagcuccagccccuccacgccgagcacgccccgcggcauccaccaccccgcgcggaaccugcugagcguauccagccccaagaccgccaccaccccgacccccaccucccccggggagauaagcuccgagacauccucccuccacagcgccaugucccgcaccuccacccuguauaccgccacacaagcgucaaccgaaaaugcaaaccacagcgcgccccggcaauccgagucgcccgcccagcccacgaccacgucccugaugaccagccccgcccaguccauccucgucaugagcgccgccccgaccgccauucagaauauccaccccucccccaccaaccgcucaaagcggaaccuggagauggagaucauccuaacgcucagccagggccuuaagaaauacuacgggaagauccugaaacuccugcaccugacccucgaggaggacaccgagggccugcuggaguggugcaagcgcaaccucggguccaacugcgaggacgacuucuuccagaagcggaucgaggaguucuucaugaccggcgagggcuauuucaacgaggugcugcaguucaaaacucuuagcacccucuccccgacugagccgagccaugccaggccgcccaccguggaacccuucaaguccuacuucgccaagggguuccugaguaucgacucgggcuacuucagcgcuaagugcuacccgcgguccagcacguccggucuccagcucaucaacgucacccagcacccagcccgcaucgccgagacccccggccccaagaccacgagccugaagaccaucaacugcaucaaccugcgggccuccguguucaaggagcaccgcgaaaucgaaauaaauguccuccugccgcagaucgccguaaauuuaagcaacugccacguggugauuaacucacacgucugcgacuacagccucgacacugacggcccagugcggcugccccacaucuaccacgaggggaccuucaucccaggcaccuacaagauagugaucgacaagaaaaauaaacuaaacgaccgcugcacccucgugaccaacugcgugaucaagggacgggaggugaggaagggccaguccguccugcggcaguauaagacugagaucaagaucgggaaggucagcacgggcagccguaagcuacucagcgaggaguccggugacgacugcaucucccggacccagcuguuacgcacagagaccgcggagauccacgacgacaacuacgguggcccgggugacaaaaucacgaucugcaacggcagcaccaucguggaccagcgccucggguccgaacugggcugcuacaccaucaaucgggucaagaguuucaaacuuugcgagaacuccgcuaccggcaaaacgugugagaucgacucuacccccgugaagugucgccagggguucugccucaagaucacccaggaaggccgagggcacgugaagcugucccgcggcagcgaggucgugcuugaugccugcgacucuagcugcgaagucaugaucccuaaggggaccggcgacauacugguggacugcuccggcgggcagcaacacuuucucaaggacaacuuaaucgaccugggaugcccccacaucccccuccuggggaagauggccaucuacauuugccggaugagcaaccaccccaggaccacgauggccuuccuguuuugguucuccuucggcuacgugauuaccugccuguucugcaaggcucuguucuacagccugaucaucauaggcacccucgggaagaagaucaaacaguaccgggagcugcgcccccagaccugcacgauaugcgagaccgcccccguaaacgcgaucgacgccgagaugcacgaccugaacugcuccuacaacaucugcccguacugcgcgagccggcucaccucugacggccuggcccgccacguaccccagugccccaagcggaaggagaagguggaagagaccgaguuguaccucaauuuggagcgcaucccguggaucguccggaagcugcuccaagugagcgaaagcacgggaguagcccugaagcgcuccagcuggcugaucguccuccuggugcugcucaccgugucccugagccccguccaguccgcccccgugggccacgggaagaccaucgagaccuaccagacccgggagggcuucaccagcauuugucuguucaugcucggcuccauccuauuccucgugagcugccucgucaagggguugguggacuccgugagcgacucguucuuccccggacugagcgucugcaagaccuguuccaucgggagcaucaacggcuucgagaucgagucccacaaguguuacugcagccuccugugcugcccguacugucgccacugcucggccgaccgggagauccaccagcugcaucucagcaucugcaagaagcggaagaccggguccaaugugaugcuggcggugugcaagcggaugugcuuucgugccacgaucgaggccagccgccgggcccugcucauccgcuccauuaucaacaccaccuucgucaucugcauccugacgcugacgaucugcguggugucuaccucagcagucgagauggagaacuugccgucaggcacaugggagaaggaggaagaccugaccaacuuuugccaccaggagugucaggugacggagaccgagugucugugucccuaugaagcgcucgugcugcggaagccccuguucuuggacucaauagucaaggggaugaaaaaccugcugaauaguaccagccuagagaccucccuuagcauugaggccccauggggagccaucaacgugcaguccacuuucaagcccaccgugagcaccgccaacaucgcccuguccuggagcuccgucgagcaccgcggcaacaagauccucgugaccgggcggucagaaucgaucaugaagcuggaggagcgcacgggcgugagcugggaccugggggucgaggacgcguccgagagcaagcuccugacuguguccaucauggaccugucacagauguacagccccguguucgaguaccucuccggcgaucggcaggucgaggaguggcccaaggccaccuguaccggcgacugcccugagcgcugcgggugcacaagcuccaccugucuucacaaggaguggccccacagcagaaacuggcgcugcaaccccaccuggugcugggguguggggacuggcuguaccugcugcgggguggacgucaaggaccuguucacggaccacauguuugugaaguggaaggucgaguacaucaagaccgaggccaucgucuguguggagcucaccucccaggagcggcagugcucccuuaucgaggcgggaacccgcuucaaccugggccccgugacgauaacccucuccgaaccgcggaacauccagcagaagcugccaccugagaucaucacccugcacccaaaggucgaggaaggguuuuucgaccucaugcacgugcagaagguacugagcgcgucaaccgucugcaagcugcagagcugcacccacggcaucccgggggaccuccaaguauaccauauaggcaaucugcugaaaggcgaucgcgugaacgggcacuuaauacacaaaaucgagccucauuucaacacauccuggaugaguugggacggcugcgaccuggauuacuacugcaacaugggggacuggcccuccugcaccuacaccggcgucacgcagcacaaccacgccgcguucgugaaucugcucaacaucgagacagacuacaccaagaccuuccacuuccacagcaagcgagucacagcccacggggacacuccccagcuggaccugaaggcccguccgaccuacggggcgggcgagaucaccgugcuaguggaggucgccgacauggaguuacacacgaaaaagguggagaucuccgggcucaaguucgccagccucgcgugcaccgggugcuacgcuugcucaucggggauuuccugcaaggugcgcauccacgucgacgagccugacgagcuuaccgugcaugugaagaguucugacccugacgucguggcagccuccaccagcuuaauggcccgcaaacucgaguucggcaccgacuccaccuucaaggccuucagcgccaugcccaagaccucccugugcuuuuacauuguggaacgggaauacugcaagucuugcuccgaggaggacacccagaagugugucgacacgaagcuggagcagccgcagagcauccucauagagcacaaggggacaaucaucggcaagcagaacgacacuugcacggcgaaggccuccugcuggcuggagagcgugaaguccuucuucuacggccucaagaacauguuggggagcgucuucggcaacuucuucaucgggauacugcuguuccuugcucccuucguccuccuggugcuguucuucauguucggcuggaagauacucuucugcuucaagugcugccgccgagcucgugggcugcugaaguaccgccaccucaaggaugaugaggagaccggcuaccggaagaucaucgagcgccugaacaacaagaagggcaagaaccggcugcucgauggggaacgccuggcagaccggaagaucgccgagcuguucuccaccaagacccacaucggcuga

SEQ ID NO: 15257 - RNA, 5067 nt, Artificial Sequence
  derived and/or modified CDS sequence (opt11) from CCHFV(4495-ST-2008)__KR814869.1__GP
augcccaccaacaucaugcacacccugcucgugugcuucauccuguaccugcagcuccugggacccgggggagcccacgggcagccuaacgccacggagcacaaucgcacaaacaccaccacggcgccuagcaccucccagagccccaagccucccgucuccaccgccccgccccacgcccuggagagcccgaccaucaaguccacgacccccaccagcgagacagagggcucaggggagacgacgcccccuccgaacaccacccagggucccucuccgcccgagaccacucccgagcggcccgcaacuacugccacguccacccccaguaccgacaacacuaacuccacgacacacgugaccgacaacaaccccaccagcacgaucucuacaagcccgucaagcucccccagcacccccuccacgcccagaggaauacaccacccugcgagaaaucuccugagcgugagcuccccuaagacugccaccacccccacccccacgagcccgggggagaucuccucggagaccuccagccugcacuccgcgaugagccgcaccuccacccuuuacaccgccacgcaggcgagcaccgagaacgccaaccacuccacgccccggcagagcgaaucccccgcccagccgaccaccaccagccugaugaccucgcccgcccagagcauccuggucauguccgccgcacccaccgccauccagaacauccaccccagcccgacgaacagguccaaaaggaacuuagagauggagaucauccuaacuuuaucucagggcuugaagaaguacuacgggaagauccugaaacugcugcaccugacccuggaggaggacaccgaaggccuccuggagugguguaagcgcaaccuggggagcaacugcgacgacgacuucuuucagaagcggauagaggaguucuucaugacgggugagggcuacuucaacgaggugcuccaguucaaaacccuguccacgcugagccccaccgagccgucccacgcccggcccccgacgguggagcccuucaagagcuacuucgccaagggguuccuuuccaucgacagcgguuacuuuuccgccaagugcuacccccgcagcagcaccagcgggcugcagcugaucaaugucacccagcaccccgcuaggaucgcggagaccccgggccccaagacaaccucccucaagaccauaaacugcaucaaccugcgggccagcguauucaaggaacaccgcgagaucgagaucaacguguuacucccccagaucgccgucaaucuguccaacugccacguggugaucaacagccacgucugcgacuacucccuggacaccgacggccccgugagacucccgcauaucuaccacgagggaacuuucauccccggcaccuacaagauagucaucgacaagaagaacaagcugaacgaccgcugcacauuagucaccaacugcgugauuaaagggcgggaggugcgcaagggccagagcguacuccgccaguacaaaacugagaucaaaaucgggaaggucuccaccgggagccgcaaacugcugucggaggaguccggcgacgacugcaucagcagaacccaacuccugcgcacugagacggcagagauccacgacgacaacuacggaggccccggagacaaaaucaccaucugcaacggcuccaccaucguggaccagcgccuggggagcgagcucggcugcuacacaaucaaucgggucaaguccuucaagcugugcgagaacucggcgacgggcaaaaccugcgagaucgacaguacccccgucaagugccgccagggauucugccugaagauaacccaggagggccggggucacgugaaacuuagccgcgguuccgaggucgugcucgaugccugcgacucuuccugugaggucaugaucccaaaggggaccggcgacauccugguagacugcucgggcgggcagcagcacuuccugaaggacaaccucauagaccugggcugcccccacauaccccugcucggcaagauggccaucuacaucugccggaugaguaaccaccccagaacgacgauggcguuccuguucugguucagcuucggcuacgugauaaccugccuguucugcaaggcccucuuuuacucccuaaucaucaucggcacccuggggaaaaagaucaagcaauaccgggagcuccgcccgcagacguguaccaucugcgagacugcgcccgucaacgccaucgacgccgagaugcacgaucugaacugcagcuacaacauaugucccuacugcgccagccggcugaccucugacggccucgcgcgccacgugccgcagugccccaagcggaaggagaaggucgaggagacugagcuguaccugaaccucgaacggauccccuggaucguccggaagcugcuccagguguccgagucaaccgggguggcccugaagcgcagcuccuggcugaucguccugcucgugcugcugacugucagccucucccccguccagagcgccccggugggccacgggaagaccaucgagaccuaccagacccgggagggcuucaccuccauaugccuguucaugcugggaagcauccucuuccugguguccugccucgucaaagggcucguggacagcguguccgauucuuucuuccccggcuuguccgucugcaagacaugcagcauugguuccauaaacggcuucgagaucgagagccacaaguguuacugcucccuguuaugcugccccuacugccgccacugcagcgccgaucgggagauccaccagcugcaccugucuaucuguaagaagcgcaagacggggagcaacgugauguuagccgugugcaagcggauguguuuccgcgcgaccaucgaggcgucccguagagcccuguugauccggagcaucaucaauaccaccuucgucaucugcauccucacgcugaccaucugcguggugagcaccucagccgucgagauggagaaccugcccaguggcaccugggagaaggaggaggaccucacgaacuucugccaccaggagugccaggugaccgagacggagugccugugcccguacgaggcccucgugcuccggaagccccuguuccuggacaguauugucaaaggcaugaagaaccuccugaacagcaccagccuggagaccagccucuccaucgaggcucccuggggcgcgaucaacgugcagagcaccuucaagcccacaguguccaccgccaacaucgcgcugagcuggucgagcgucgagcauagggggaacaagauccuagugacagggcgguccgagagcauuaugaagcucgaggaacgcaccggcaucuccugggaccuggggguggaggaugccagcgaguccaagcugcucaccguaucgaucauggaccugucccagauguacucaccgguguucgaguaccuuagcggcgaccgucaaguggaggaguggcccaaggcuaccugcacuggcgacugucccgagcgcugcgggugcaccuccagcacaugccuccacaaggaguggccucacuccagaaacuggcgcuguaacccgaccuggugcuggggcgucgggaccggcugcaccuguugcgggguggacgucaaggaccuguucaccgaccacauguucgugaaguggaagguggaguacaucaagaccgaggccauagugugcgucgagcugaccagccaggagcggcagugcuccuuaaucgaggccggaacccgauucaaccuggggcccgugaccaucacccugucagagccgcggaacauucagcagaagcucccgccggagaucaucacccuccaccccaagguggaggagggguucuucgaccugaugcacguucagaaggugcucuccgccagcacggugugcaagcugcaguccugcacgcacggcauccccggggaccugcaggucuaucacauaggcaaccuccugaaaggcgacagagugaacgggcaccugauccacaagauugagccacacuucaacaccagcuggauguccugggauggcugcgacuuagacuacuauugcaauaugggggacuggccgucuuguaccuacacgggcgugacgcagcauaaccacgcggccuucgucaaccugcugaacaucgagaccgacuacaccaagacguuccacuuccacuccaaacgggugaccgcccacggugacacgccccagcucgaccugaaggcaaggcccaccuacggcgccggcgagaucaccguacugguggagguggcggacauggagcuccacaccaagaaggucgaaaucagcgggcugaaguucgccucccuggccugcaccggcugcuacgcaugcagcucggggauaucaugcaaggugcggauccacguggaugagccugacgagcucaccguccacgugaaguccagcgacccggacguuguagccgcgagcaccucccuaauggccaggaagcuggaguucggcaccgacagcaccuuuaaggccuucuccgccaugccuaagaccagccucugcuucuacaucguggagagggaauacugcaaguccuguagcgaggaggacacucagcgcugcguggauaccaagcuggaacagccccaguccauccugaucgagcacaagggaaccaucauuggcaagcaaaacgauaccugcacggccaaggcgagcugcuggcuugaguccgucaagagcuucuucuauggccugaagaacaugcuggggucuguguucgguaauuucuucaucgguauccuccuguuccuggccccguucgugcugcucgucuuguucuucauguucggcuggaagauccuguucuguuucaagugcugccgucgcgcuagagggcuccugaaguaccggcacuugaaggacgacgaagagaccggcuaccgcaagaucaucgagcggcucaacaacaagaagggcaagaaucgccugcuggacggggagcgguuggccgaccgcaagaucgcugagcuguucagcaccaaaacacacaucggcuga

SEQ ID NO: 15258 - RNA, 5067 nt, Artificial Sequence
  derived and/or modified CDS sequence (opt11) from CCHFV(3809-ST-2007)__KR814867.1__GP
augccuacuaauaucaugcauacucugcucgugugcuucaucuuguaccugcagcuccuggggcucgggggcgcacaggggcagagcaacgccacggagcacaacgagaccaauacgaccacggcgccgucuaccucucagucccccaagccgcccgucagcacaacaccccugcacgcauuagaguccagcaccauaaagcccacaacccccgcccgcgagaccgagggguccggggagacuacgcccccacccaacaccacccagggccccagcccaccugaggccacccccgagcggcccgccacaaccgcgacuuccgcacccagcacagacaacaccaauucuaccacccacgugacugacaacaacccgaccagcaccaucuccaccagccccuccucuucccccagcacucccuuuaccccgcagggcauucaccacccagcucgcaaccugcucagugugaguagccccaagaccgccaccacgccgaccccuacaagucccggggagcugagcuccgagacgucuucccugcacagcgcgaucuccaggacgagcacucucuauacugccacccaggucuccaccgagaaugccaaccacuccgcacccaggcaauccgagagcucagcccagcccacgaccaccucccccaugaccuccccggcccagagcauccuggugauguccgccgcucccacggccauccagaacauacauccgagccccaccaacagguccaagcgcaauuuagaaauggagaucauucucacccugagccagggccugaagaaauacuacgggaagauccugaagcuccugcaccucaccuuggaggaggacacggagggccuguuggaauggugcaagcgaaaccuggggagcaacugcgacgacgacuucuuccagaagcgcaucgaggaguucuucaugaccggcgagggcuauuuuaacgaggugcugcaguucaagaccuuauccacccugagccccacggagcccucccacgcccguccgcccgcggucgaaccauucaagaguuauuuugccaagggguucuuguccaucgauagcggcuauuucuccgccaaaugcuacccccgcagcucuaccagcgggcuccagcugaucaacgugacccaacaccccgcccggaucgccgaaacccccggccccaaaacgaccucucugaagaccaucaacugcauuaaccuucgcgcgagcguguucaaggagcaccgggagauagagaucaacgugcuacugccccagaucgccgugaaccucuccaacugccauguggucaucaacucgcaugugugugacuacucccuagacaccgauggcccugugcgccuaccccacaucuaccacgagggaacguucaucccuggcaccuacaagaucgucaucgacaagaagaacaagcucaacgaccgcugcacccuggugaccaacugugugaucaagggccgcgagguccggaagggccagagcgugcugcgccaguacaagacagagaucaagauagggaaagcauccaccggcagccggaagcuccugucugaggagcccggugacgacugcaucucccgcacgcagcuguugcggaccgaaacggccgagauccacgacgacaauuaugggggccccggggacaagaucaccaucugcaacggcucuaccaucguggaccaacgacugggguccgaacuggguugcuacaccaucaaccgcgucaagagcuucaagcucugugagaacucugccacgggcaagaccugcgagaucgacagcacccccgugaagugccggcagggguucugccugaaaaucacacaggaaggccgcgggcacgugaagcugucccgggguagcgaggucgugcuggacgcgugcgacuccaguugcgaggucaugauccccaaggggacgggcgauauauuaguggacugcuccggcgggcagcagcacuuccugaaggacaacuugaucgacuuaggcugcccccacaucccgcugcuggggaaaauggccaucuacauuugccgcaugucuaaccacccacggaccaccauggccuuccucuucugguucuccuucggcuacgugauaaccugcaucuucugcaaggcucuauucuacagccugaucaucaucgguacucucgggaagaagaucaagcaguaccgcgagcugaaaccccagacaugcaccaucugcgagaccgcccccgucaacgcuaucgacgccgagaugcacgaccugaauuguaguuacaacaucugcccguacugcgcaagccggcucaccuccgacggucuggcccgccacgucccacagugccccaagcguaaggagaagguggaggagacggagcucuaccucaaccuggagagaaucccauggaucguccgcaagcugcuccaggugagcgaaucuaccgggguggcgcugaagcgcagcagcuggcugaucgucuuauugguguuguuaaccgugucccugagccccguccaauccgcuccggugggccacggaaaaacaaucgagacguaucaaaccagggagggauucacuuccaucugucuguucaugcucggcuccauccucuuucuggugagcuguuuagucaaggggcuggucgacuccgugagcgacuccuucuuccccggccugagcgucugcaagacaugcuccaucggguccgugaacggguucgagaucgagucccacaagugcuacugcagccucuucugcuguccauauugccgucacuguagcgccgaccgggagauccaccagcugcaccugagcgugugcaagaagcgcaagaccgguuccaacguuaugcucgcagugugcaaacggaugugcuuccgcgccaccaucgaagcgagcagacgcgcccugcuuauccgcuccaucaucaauacaaccuucgugaucuguauccucacgcugaccaucugcguaguaagcaccucagccguggagauggagaaccuacccgcgggcaccugggagcgcgaggaggaccugacgaacuucugccaccaggagugccaggucaccgagacagagugccucugccccuacgaggcccuggugcuccggaagccccuguuccuggacagcaucgugaagggaaugaaaaaccuccugaacuccaccucccuggagacaucgcuauccauugaggccccguggggcgcuauaaacguccagagcaccuuuaagcccaccgucuccaccgcgaacaucgcccugagcugguccagcguggaacacagaggaaauaagauccugguuacgggacgauccgagucaaucaugaagcucgaagaacggacuggcguguccugggauuuagggguggaggaugcaagcgagaguaagcugcucacagucagcaucauggaccugucccagauguacagcccuguguucgaguaccuguccggcgaccgccagguggaggaguggcccaaggcaacauguaccggagauugcccggagcguugcgguugcaccagcuccacgugccuccacaaggaguggccccacagccgcaacuggcgcugcaaccccaccuggugcuggggcgucgggacgggcugcacgugcuguggcguggacgugaaggaucuguucaccgaccacauguucgucaaguggaaaguggaguacaucaagaccgaggccaucgugugcgucgagcugaccagccaggagagacaaugcucccucaucgaggccggcacacgguucaaccugggccccgugaccauaacucugucggagccucgcaauauccaacagaaacucccgccagagaucaucacccugcaccccaagguggaggagggguucuucgaccugaugcacguccagaaagugcucagcgccucaacgguguguaaacugcaguccugcacccacggcauccccggggaccugcagguauaucacauuggcaaucuccugaagggcgaccgggugaacgggcaccugauccacaaaaucgagccccacuuuaacaccagcuggauguccugggacggcugcgaccucgacuacuauugcaacaugggagacuggcccaguugcaccuacacgggaguuacacagcacaaccacgccgccuucgucaaccugcugaacauagagacagacuacacaaagacauuccacuuccauuccaagcgugugaccgcccacggggacacgccacaacucgaccugaaggcccggccuaccuacggcgccggcgagaucaccguccuaguggagguggcggacauggagcuccacaccaagaaggucgagaucagcgggcucaaguucgccucccuggcuugcaccggcugcuacgcgugcagcuccgggaucagcugcaaggugcgcauccacguggaugagcccgacgaacucaccguccacgucaagaguagcgaccccgauguggucgcagcguccacgagccugauggcccggaagcuggaguucgguaccgacagcaccuucaaggccuucagcgccaugcccaagaccagccucugcuucuacaucguggaaaaggaauacugccgcuccugcagcgaggaggacacgcaaaagugcguggacacaaaacuggagcagccgcaguccauccugaucgagcacaaggggaccaucaucgguaagcagaacgacacgugcaccgcaaaggccagcugcuggcucgaguccguaaagagcuucuucuacggccugaagaacaugcugggguccguuuucggcaacuucuucaucgggauccuccuguuccugaccccauucgugcuucugguucuguucuuuauguucggcuggaaaauccuguucugcuucaagugcugccgccgcacccgggggcuccuaaaguacaggcacuuaaaggacgacgaggaaaccggcuaccgccggauaauagagcgccucaacaauaagaagggcaagaaccggcugcuggacggcgagcgacucgccgaccggaagaucgcggaacuguucagcacgaaaacccacaucggcuga

SEQ ID NO: 15259 - RNA, 5067 nt, Artificial Sequence
  derived and/or modified CDS sequence (opt11) from CCHFV(3756-ST-2007)__KR814866.1__GP
augccuaucaacaucaugcauaccuuacucgugugcuucauccuguaccugcagcucagcggccuggguggcgcccacgggcaauccaacgccaccgagcacaaccgcacgaauaccacuaccgucccgggaacgagccagucccccaaaccgcccgcgagcaccacccugccccacacccccgaguccagcacugugaagcucacaacccccaccuccgaaacggaggggagcggcgagacuaccccuccgcccaacaccacucagggacugccccugcccgggaccaccccagagcggucugccaccacggcuaccagcaccuccagcacugacaacaugaacacgaccacacaggugaccgacaacacgcccaccuccaccgucagcaucucccccuccuccagccccuccaugccgaguacuucucagggcauccacuauccggugcgcucccuccugagcguguccucucccaagacggucaccacccccaccccgaugucacccggggagaugucucccgagacgucuagccagcacuccgccaugagccggauccccacccuuuacaccgcaacccagguaaguaccgagaacaucaaccgcagcacgccgcggcaguccgagagcuccguucagcccgcgacccagagccccaucaccuccccugcccagaccauccuccugaugagcgccgccccgaaggcgauacaggacaugcaccccucccccacgaaccgcagcaagcggaaccuggaggucgagaucauucucacccugagccagggccugaagaaguacuacgggaagauccuaaagcugcugcaccucacccuggaggaggacaccgaggggcugcucgaauggugcaagcgcaaccugggcuccaacugcgacgacgacuucuuccagaagcggaucgaggaguucuucaucaccggcgagggcuacuucaacgaggugcugcaguucaagacacucagcacccuguccccgaccgagcccagccacguccgccugcccaccgccgagcccuucaaauccuacuucgcuaagggguuccucagcaucgacucuggcuauuucagcgccaagugcuacccgcgguccagcaccucgggccugcagcugaucaacgucacccagcaccccgcccgcaucgcggagaccccugggcccaagacgaccagccucaaaaccaucaacugcaucaaccuucgggccuccguguucaaggagcaccgcgaaguggagaucaacguccugcucccgcagauugccgugaaccuguccaacugccacguggucaucaacucccacgugugcgacuacagccuggacaccgacgggcccgugcggcugccccgcauccaccacgaggggacguucauccccggaaccuacaagaucgucaucgaccggaagaacaaacugaacgaccgaugcucccuggugacuaacugcgugaucaaggggcgggagguccgaaagggccagagcgugcuccggcaguacaagaccgagaucaagaucggcaaggccagcacagguucccguaagcugcugagcgaggagccgggcgacgacugcauaucccgaacccagcuccugaaaaccgagaccgccgagauccacgacgacaacuacgggggccccggggacaaaaucacgaucugcaacggcagcacuaucgucgaccaacggcugggcuccgagcucgggugcuacaccaucaaccgcguuaagagcuucaagcugugcgagaacuccgcuaccgguaagacgugugagaucgacagcacccccgugaaaugccggcagggguucugccuuaagaucacccaggagggccgcggccacgugaagcucucccgggguucggagguggugcuagacgccugcgacuccucaugcgagaucaugauccccaagggcaccggggacauccuggucgacugcuccggcgggcagcagcacuuccuuaaggacaaccucaucgaccugggcugcccacacaucccccugcucgguaagauggccaucuacaucugccguaugagcaaccacccccggacuaccauggccuuccuguucugguuuuccuucggguacgugauuaccugcaucuucugcaaagcccuuuucuacagucuaaucaucaucggcacgcugggaaagaagauuaagcaguaccgcgagcucaagccccaaacauguacgaucugcgaaaccgcgccggucaacgcuaucgacgcugagaugcacgaccucaacuguucguauaacaucugccccuacugcgccagccggcugaccuccgacggccuggcccgucacgucacccagugccccaaacggaaagagaagguugaggaaacggagcucuaccugaaccuggagcgcauccccuggaucgugcggaagcucuuacaggucagcgagucuacuggaguagcucuuaagcgcuccucuugguuaaucgugcugcugguccuccugaccgugucccugucgccgguucaguccgccccugucggccacggaaagaccaucgagacguaccaaacccgggagggguuuaccucaaucugcuuguucaugcugggcuccauccuguuuaucgugagcugccucguuaagggacuggucgacuccgugagcgacucuuucuuccccggcuuaagcgugugcaagacuugcuccaucgggucgaucaacggauucgaaaucgagucccacaagugcuacugcagccucuucugcugcccguacugccgucacugcuccgccgaccgcgagauucaccagcugcaccuuagcaucugcaagaagcgcaagacgggcucuaacgucaugcucgccgugugcaagcggaugugcuucaaggcgacuaucgaggcuagccgccgcgccuuacugauccggagcaucauuaacaccaccuuugugaucugcaucuugacgcuggccaucugcgucguguccaccucugccguggagauggaagaccugcccgcugggaccugggagagggaggaggaccucaccaacuucugccaucaggagugccaggucacggagaccgagugccugugccccuacgaggcguuagugcuccgcaagccccuguucuuggacuccaucgugaagggaaugaagaaccuccugaacucuaccucccuggagaccagccucuccaucgaggccccguggggcgccaucaacguccagagcacguucaagcccaccguguccaccgccaacaucgcgcugagcugguccagcguggagcaccgcgggaacaagauccugguaaccggucgguccgaaagcaucaugaagcucgaggagcgcacgggaguguccugggaccuaggcguagaggacgccagcgaguccaagcugcucaccgucagcauuauggaccugucccagauguacagcccaguguucgaguaucugagcggggaccgccagguggaggaguggcccaaggcaaccugcaccggcgacugcccggagcggugcgggugcacguccaguaccugccuccacaaggaguggccccauucccggaacuggcgcugcaaccccacauggugcuggggcgucggaaccggcugcacgugcugcgggguggacguaaaggaccuguucacggaccacauguucauuaaauggaaggucgaguacaucaagaccgaggccauugugugcguggagcugaccagccaggagcgccagugcuccuuaaucgaggcagguacccgcuucaaccuggggcccgucacgaucacccucagcgagccgcggaacauccagcagaagcucccucccgaaaucauaacccuucaccccaaaaucgaagagggguucuucgaccugaugcacgugcaaaagguccucuccgcaagcacugucugcaaacuucaaucauguacacacggcaucccgggcgaccugcaaaucuaccacauugggaaccuccugaagggggaccgugugaacgggcaccugauccacaagaucgagccccacuucaacacuagcuggauguccugggacggcugcgaccucgacuacuacugcaacaugggggacuggcccagcugcaccuauaccggcgucacucagcacaaccacgcugccuucgugaaccugcugaauaucgagaccgacuacaccaagaccuuccacuuucacuccaagcgggugacggcccacggcgacacuccccagcucgaccugaaggcgcgcccgaccuacggggccggcgagaucaccguccugguggagguugccgacauggagcuccacacgaagaaggucgagaucagcgggcugaaguucgccucccuuaccugcaccggcugcuacgcuugcagcucugggauaagcugcaaggugcggauccacguggacgagcccgacgagcucacaguccacgugaaguccagcgaccccgacgugguagcggccagcacguccuugauggcucgcaagcuggaguucggcaccgacucuaccuucaaggccuucuccgccaugccuaagaccagccucugcuucuacaucgucgagcgggaguacugcaaauccuguagcgaagacgacacgaagaagugcguggacaccaagcuagaacagccgcagagcauccugaucgagcauaagggcaccaucaucgggaagcagaacgauaccugcacggcgaaggccagcugcuggcucgaguccgucaagagcuucuucuacggccugaagaacaugcuggggucaguguuuggcagcuucuucguggggauccuucuguuccugacccccuuuguguuguuggugcuguucuucauguucggcuggaagauccuguucugcuucaagugcugccgccggacccguggccuuuucaaguaccgccaccugaaggacgacgaagaaaccggguaccggcgcaucaucgagcgauuaaacuccaaaaagggcaagaaucgccuccucgacggggagcggcuggccgaccgcaagaucgccgagcuuuucagcacuaagacccacauuggcuga

SEQ ID NO: 15260 - RNA, 5067 nt, Artificial Sequence
  derived and/or modified CDS sequence (opt11) from CCHFV(81-R-2014)__KR814865.1__GP
augcccaccaacaucaugcacacacugcucgugugcuucauccuguaucugcagcuccugggccuaggaggggcccacgggcaauccaacgccacggagcacaacggcaccaacaccaccacgguccccuccaccagccagucccccaagccccucgugagcaccacacccccgcacgcgcuggaguccuccacgaucaagcccaccaccccaaccucggagacggaggggagcggcgagaccgccccucugccgaacacgacccagggaccaccgccgcccgaaacgacccccgagcgucccgcuaccaccgugacguccacccccagcaccgacaacaccaacuccacgauccacgucaccgacaacaacccgaccucgaccaucuccacgagccccuccucgucccccagcacccccuccaccccgcaggggauucaccaccccgcccggagccuccugagcguguccagccccaagacggccacgaccccuacuccgaccucccccggcgagaucaacagcgagacguccagccugcacuccgcgaugagccgcacucccacccuccacaccgccacccagguguccacggagaacgccaaccacagcgcaccccggcaguccgagagcagcgcccagccgaccaccaccagccugaugacgucgcccgcccagagcaucuugcucauguccgccgcccccaccgccauccagaacacccacccgagcccuaccaaccgcuccaagcggaaccuggagauggagaucauccugacgcuuagccaggggcugaagaaguacuacggcaagauucuaaagcugcugcaccugacccucgaggaggacaccgagggguugcuugaguggugcaagcgcaaccucggcagcaacugcgacgacgacuucuuccaaaagcggaucggcgaguucuucaugaccggggaaggcuacuucaacgagguccugcaguucaagacucuguccacccucagcccuaccgagccgucccacgcgcgccugccgaccguggagccguucaagagcuacuucgccaagggcuucuuguccaucgacagcggcuacuucagugccaagugcuacccccggagcuccacgaguggccuccagcugaucaacgugacccagcaccccgcacgcaucgccgagaccccggggcccaagaccacgucgcugaagaccaucaacugcaucaaccuccgggcgagcgucuucaaggagcaccgcgaaaucgagaucaacgugcugcugccccagauugcugugaaccuguccaacugccacgucgugaucaacagccacgugugcgacuacucccuggacaccgacggccccguccggcugccgcacaucuaccacgaggggaccuucauccccggcacguacaagaucgugauugacaaaaagaacaagcucaacgaccgcugcacccuggugacuaacugcgucauuaaggggcgggaggugcgcaagggccagucggugcugcggcaguacaagaccgagaucaagaucggcaaggccuccacggggagccgcaagcugcugagcgaggagcccggggacgacugcaucucccggacccagcugcuccgcaccgagaccgccgagauccacgacgacaacuacgggggccccggggacaagaucacgaucugcaacggcagcaccaucgucgaccagcggcugggcuccgagcuggggugcuacaccaucaacaggguaaagagcuucaagcucugcgagaacuccgccaccgguaagacgugcgagaucgacagcaccccggugaagugucgccagggguucugccucaagaucacccaggagggccgggggcacguaaagcugucccgcggcagcgaggugguccuggacgcgugcgacuccagcugcgaggugaugauccccaagggcaccggggacauccucguggacugcuccggcgggcaacagcauuuccugaaggacaaucugauagaccucggcugcccccacaucccccugcugggcaagauggccauauacaucugccggaugagcaaucacccgcgcacaacgauggccuuccucuucugguucuccuucggguacgucauaaccugcaucuucugcaaggcccuguucuacagccugaucaucauuggcacccuggggaagaagaucaagcaguaccgggagcugaagccccagaccugcacgaucugcgagaccgcccccgugaacgcgauugacgccgagaugcacgaccugaacugcuccuacaacauuugccccuacugcgcaagccgccucaccuccgacggccuggcacggcacgugccgcagugccccaagcgcaaagagaaggucgaggagacggaguuauaccucaaucuugagcggauccccuggaucgugcgcaagcugcuccaggugagcgagucaacgggggucgcgcuaaagcggagcagcuggcugaucgugcuccuggugcugcucaccgucucccugucaccggugcaguccgcccccgugggccacggcaagaccaucgagaccuaccagacacgcgagggcuucaccagcaucugccuguucaugcuaggcuccauccucuuccucgucuccugccucgugaaagggcuuguggacuccgucagcgacuccuucuuccccgggcuaagcgugugcaagaccugcuccauugggagcaucaacggcuucgagaucgagucucauaagugcuacugcagcuuguucugcugccccuacugccggcacugcuccgccgaccgcgaaauccaccaacugcaccugagcaucugcaagaagcggaagaccggcagcaacgucaugcuugccgucugcaagcgcaugugcuucagagccacgaucgaagcgagccgccgggcccugcugauccgcagcauaaucaacaccacguuuguaaucugcauccucacccugacgauaugcguggucagcaccagcgccguggagauggagaaccuucccgccgggaccugggagcgcgaggaggaccucaccaacuucugccaccaggagugccaggugacggaaaccgagugucugugucccuacgaggcacugguccugcgcaagcccuuauuccuggacuccauagugaagggcaugaagaaccuccugaacagcaccucccuggagaccagccucuccaucgaggcgccuuggggagccaucaacgugcagagcacguucaagccgaccguauccaccgcuaauaucgcccugucuuggagcagcguggagcaccgcggcaacaagaucuuagugaccgggcgguccgagagcaucaugaagcucgaggaacgcacggguguauccugggaccugggcguggaggacgccagcgaguccaagcugcucaccgugagcaucauggaccugucccaaauguacagccccgucuucgaguaccuguccggcgaccgccaaguggaggaguggcccaaggcaacgugcacuggcgacugccccgagcgcugcgggugcaccagcagcacuugccuccacaaggaguggccgcacucccggaacuggcgcugcaacccuaccuggugcuggggcguagggaccggcuguaccugcugcggcgucgacgugaaggaccuguuuacggaucacauguucguaaaguggaaggucgaguacaucaagaccgaggccaucguguguguggaacugaccagccaggagcgacagugcucccucaucgaagccgggacccgcuucaaucugggccccguaacuaucaccuugagcgagccccggaacauccagcagaagcucccgcccgagaucaucacccugcaccccaaggucgaggagggcuucuucgaucugaugcacguccagaagguccucagcgccagcaccgugugcaagcugcaguccugcacgcacggcauccccggggaccuacagguguaccacaucgggaaccugcugaagggcgaccgcaucaacgggcaccugauccacaaaaucgagccgcacuucaacacaagcuggauguccugggacggcugcgaccucgacuacuauugcaacaugggggauuggcccagcugcaccuacaccggcgucacgcagcacaaccacgcggccuucgugaaccugcugaacaucgagaccgacuacaccaagaccuuccacuuccauuccaagcgggucacggcccacggcgacacgccccagcucgaccugaaggcccgcccaaccuacggggcuggcgaaauaaccgugcugguagaggucgcggacauggagcuacacaccaagaagguugagaucagcggguuaaaguucgccucgcuggccugcaccggcugcuacgccugcagcuccgggaucagcugcaaagugcggauccacgucgacgagccggacgagcucaccgugcacgugaagaguagcgacccggacgucguggccgcguccaccagccugauggcccgcaagcuggaguucggcacggacagcaccuucaaggccuucuccgccaugccuaagaccagccucugcuucuacaucguggagcgggaguacugcaaguccugcagcgaagaagacacccaaaagugcgucgacacgcgccuggagcagccccaguccauccugaucgagcacaagggcaccaucaucgggaagcagaacgauaccugcaccgccaaggcgagcugcuggcucgaguccgugaagucauucuucuacggccugaagaacaugcucggguccguguucggcaacuucuucaucgggauccuacucuuccuggcccccuucguccuucucguguuguucuuuauguucggguggaagauccuguucugcuucaagugcugccggcgcacgcggggccuccugaaguaccgccaccugaaggacgacgaggagaccggguaccgccggaucaucgagcgcuugaacaacaagaagggcaagaaccgucugcuggacggggagcgccucgccgaucgcaagaucgccgagcuguucagcaccaagacccacaucggcuga

SEQ ID NO: 15261 - RNA, 5067 nt, Artificial Sequence
  derived and/or modified CDS sequence (opt11) from CCHFV(75-ST-2010)__KR814864.1__GP
augcccaccaacaucaugcacacccugcucgucugcuucauccuguaccugcagcuccugggccccgggggcgcccacgggcagcccaacgccacggagcacaaccgcaccaacaccaccacggcccccagcaccucccagucgcccaagccgcccgucuccaccgccccgccccacgcccuggagagcccgaccaucaaguccacgacccccaccagcgagaccgagggcuccggggagacgaccccgccgcccaacaccacccagggccccagccuccccgagacgacccccgagcggcccgccaccacggccacguccacccccagcaccgacaacaccaacuccacgacccacgugaccgacaacaaccccaccagcacaaucuccaccagccccuccagcucaccgagcacgcccuccacgccccgcggcauccaccaccccgcgcggaaccugcugagcguuagcuccccgaagaccgcaaccaccccaacccccacgagccccggggagauauccagcgagacauccagccuccacuccgccaugagcaggaccuccacccuguacaccgccacgcaggcgagcacagagaacgccaaccacuccgccccgcggcagagcgagaguccagcccagcccacgaccacgagccugaugaccuccccggcccagagcauccucgucauguccgcggcccccacugccauccaaaacauccaccccagccccaccaaccgcuccaagcggaaccuggagauggagaucauccugacgcucagccagggccugaagaaguacuacgggaagauccugaagcuccugcaccugacccucgaggaggacaccgagggccugcuggaguggugcaagcgcaaccuugggagcaacugcgacgacgacuucuuccagaagcggaucgaggaguucuucaugaccggcgagggcuauuucaacgaggugcugcaguucaagacgcuguccacccucagcccgaccgagcccucccacgcccggcccccaaccguggagccguucaagagcuacuucgccaagggguuccuguccaucgacagcggcuacuucuccgcgaaguguuacccccgcagcuccacgagcggucuacagcucaucaacgucacccagcaccccgcccgcaucgccgagacccccggcccgaagaccacgucccugaagaccaucaacugcaucaaccugcgggccagcguguucaaggagcaccgcgagaucgagaucaacgugcuccugccccagaucgccgucaaccuguccaacugccacguggugaucaacagccacgucugcgacuacucccucgacaccgacggacccguucggcuaccccacaucuaccacgagggaaccuucaucccgggcacguacaagaucgugaucgacaagaagaacaagcugaacgaccgcuguacccucgucaccaacugcgucaucaaggggcgggaggugcggaagggccagucaguccugcggcaguacaagaccgagaucaagaucgggaagguguccacgggcagccgcaagcugcuaagcgaagaguccggcgacgacugcaucagccgcacccagcugcugcgcaccgagaccgcggagauccacgacgacaacuacgggggccccggggacaagaucacgaucugcaacggcuccaccauuguggaccagcgccucgggagcgagcugggcugcuacaccaucaaccgagucaaguccuucaagcugugcgagaacagcgccaccggcaagacgugcgagaucgacuccacccccgugaagugccgccagggguucugcuuaaagaucacccaggagggccgggggcacgugaagcugaguaggggcuccgaggucgugcuggacgccugcgacagcucaugcgaggucaugauccccaaggggaccggcgacauccugguggacugcagcggcgggcagcagcacuuccucaaggacaaccugaucgaccugggcugcccgcacaucccccuccuggggaagauggccaucuacaucugccggauguccaaccaccccaggaccacgauggccuuccuguucugguucagcuucggcuacgugauuaccugccucuucugcaaggcgcuguucuacucucugaucaucaucggcacccucgggaagaagaucaagcaguaccgggagcugcgcccccagaccugcacgaucugcgagaccgccccggucaacgccaucgaugccgagaugcacgaccugaauugcagcuacaacaucugccccuacugcgcaucccggcucaccagcgacggccuggcccgccacgugccccagugcccgaagcggaaagagaagguggaggagaccgagcuguaccucaaccuggagcgcauccccuggaucguccggaagcugcuccagguuuccgagaguacagggguggcccugaagcgcagcuccuggcugaucguccugcuggugcugcucaccgucagccugucccccguccaguccgcccccgugggccacgggaaaaccaucgagaccuaccagacgcgggagggcuucaccuccaucugccuguucaugcucggcagcauccuguuccugguguccugccucgucaaggggcugguggacagcguguccgacagcuucuucccgggccuguccgucugcaagaccugcagcauaggguccaucaacggcuucgagaucgagagccacaagugcuacugcucccuccuguguugccccuacugccgccacugcagcgccgaccgggagauccaccagcugcaccucuccaucugcaagaagcgcaagaccgggagcaacgugaugcuggcggugugcaagcggaugugcuuccgcgccacgaucgaggccucccgccgggcccugcucauccgcagcaucaucaacaccaccuucgucaucugcauccuuacccuaaccaucugcguggugagcaccuccgccgucgagauggaaaaccuccccagcggcaccugggagaaggaggaggaccugaccaacuucugccaccaggagugccaggugacggaaaccgagugccugugccccuacgaggcgcucgugcugcggaagccgcuguuccucgacuccaucgucaagggcaugaagaaccugcugaacagcaccucgcucgagaccagccuguccaucgaggcccccuggggcgccaucaacgugcagagcacguucaaacccaccguguccaccgccaacaucgcccucagcugguccuccgucgagcacagggggaacaagauccucgugaccgggcgguccgagagcaucaugaagcuggaggagcgcacgggcguguccugggaccugggggucgaggacgcgucagagaguaagcuccugaccgugagcaucauggaccugucccagauguacagccccguguucgaguaccucagcggcgaccggcagguagaggaguggccaaaggcgaccugcaccggcgauugcccggagcgcugcgggugcacguccuccacgugcuugcacaaggaguggccccacagccggaacuggcgcugcaaccccaccuggugcuggggcguggggaccggcuguaccugcugcgggguggacguaaaggaccuguucaccgaccacauguucgugaaguggaagguggaguacaucaagaccgaggccaucgucugcguggagcucaccagccaggagcggcagugcucucugaucgaggccgguacccgcuucaaccugggcccggugacgaucacccucagcgagccccggaauauccagcagaagcugccgcccgagaucaucacccugcaucccaaggucgaggagggguucuucgaccucaugcacgugcagaagguacuguccgccagcaccgucugcaagcugcaauccugcacacacggcauccccggggaccuccagguguaccacaucggcaaccugcugaagggcgaccgcgugaacgggcaccucauccacaagaucgagccccacuucaacaccagcuggaugaguugggacggcugcgaccuggacuacuauugcaacaugggggacuggcccagcugcaccuacaccggcgucacgcaacacaaccacgccgccuucgugaaccugcucaacaucgagacagacuacaccaagaccuuccacuuccacaguaagcgggucacggcccacggggacaccccgcagcuggaccugaaggcccgccccaccuacggcgcgggcgagaucaccgugcucguggaggucgccgacauggagcugcacacgaagaagguggagaucagcgggcugaaguucgccucccucgccugcaccggcugcuaugccugcagcuccggaaucagcuguaaggugcggauccacgucgacgagcccgacgagcugaccgugcacgugaaguccagcgaccccgacgucguggcggccagcaccucccugauggcccgcaagcucgaguucggcacggacagcaccuucaaggccuucuccgccaugcccaagaccagccugugcuucuacaucguggagcgggaguacugcaaguccugcagcgaggaggacacccagaagugcgucgacacgaagcuggagcagccccaguccauccucauugagcacaaggggaccaucaucggcaagcagaacgauaccugcaccgcuaaggccagcugcuggcuggaguccgucaagagcuucuucuauggccugaagaacaugcucggguccguguucggcaacuucuucaucgggauccuccuguuccuggcccccuucgugcuccuggugcuauucuucauguucggcuggaagauccucuucugcuucaaaugcugucgccgggcacgcgggcugcugaaguaccgccaccucaaggacgacgaggagacgggcuaccggaagaucaucgagcgccugaacaacaagaagggcaagaaccggcugcucgacggggagcgccuggcggaccggaagaucgccgagcuguucucaaccaaaacccacaucggcuga

SEQ ID NO: 15262 - RNA, 5067 nt, Artificial Sequence
  derived and/or modified CDS sequence (opt11) from CCHFV(75-R-2012)__KR814863.1__GP
augcccaccaacaucaugcacacacugcuuguuugcuucauucuguaccugcagcuccugggccucggcggggcccaucgucagagcaacgccacagggcacaacgggaccaacaccaccaccgcccccuccaccagccagucccccaagccccucgugagcaccgcgcccccgcacgcccuggaguccagcaucaucaagcacaccacgcccgugagcgagaccgagggguccggcgagaccacgccgccgcccaacaccacccagggcccaagcccccuggagacaacuccugaacggcccgccaccaccgccaccagcacgcccuccaccgacaacaccaacagcaccacucacgugacggacaauaaucccaccuccaccaucagcaccucccccagcucgagcccguccacgccgagcacgccccagggaauccaccacccagcccgcaaccuccuaagcgucuccagccugaaaacagccaccacgccgacccccaccucccccggcgaaauuuccagcgaaaccagcuccuuacacuccgccauguccaggacaucuacccuguacaccgccacccagguguccaccgagaacgcuaaccacagcgcgccaaggcaguccgagagcuccgcccagcagaccaccaccagcccgaugaccucccccgcccagagcaucuuaguuauguccgccgcucccaccgccauacagaacacccaccccucaccgaccaaccggagcaagcgcaaccucgagauggagauaauccugacacugucgcaagggcucaagaaguauuacggcaagauccugaaguuauuacaccugacgcuggaggaggacaccgaggggcuccuggaguggugcaagaggaauuugggcagcaacugcgaugacgacuucuuccagaagcgcauagaggaguucuucaugaccggcgaaggguauuucaacgagguucuccaguucaagacccuuagcacgcagagccccaccgagcccucacacgcucggccucccaccguggaacccuucaagucauauuucgccaagggauuucuuucgaucgacagcggcuacuucagugccaagugcuacccccgcuugagcaccuccggcuuacagcugaucaacgugacgcaacacccggcgaggaucgccgagaccccgggucccaaaaccaccucgcucaagacgaucaacugcaucaaccugcgcgcuucgguauuuaaggaacaccgggagaucgagaucaauguccugcucccccagaucgcugugaacuuaucuaacugccacgucgugaucaacucccacgucugcgacuacagcuuggacaccgauggcccgguccgacucccccauaucuaccacgaggggaccuuuauccccggaaccuacaaaaucguaaucgacaagaagaacaagcugaaugaccgaugcacgcugguuacuaacugugucaucaaggggcgcgagguccgaaaggggcaguccguccuccgccaguauaagaccgagaucaagaucggcaaagcaaguaccggaagccgaaagcugcuguccgaggagccgggggacgacugcauuucacgaacucagcuccuacggacugagacugcggagauucacgacgacaacuacggugggccgggggacaaaaucaccaucugcaaugggagcacgauagucgaccagcgccugggcagcgagcucggcugcuacaccaucaaccgcguuaagucguucaagcugugugagaacucagccacagggaaaaccugcgagauugacucugcacccgucaagugccgacagggcuuuugccugaagaucacgcaggagggacgcggccacguuaagcugagccggggguccgagguaguacucgacgccugcgauagcuccugcgaggugaugauccccaagggcacuggcgauauccugguggauugcagcgggggccagcagcacuuccuaaaggacaaucugauugaccuggguugcccccacaucccgcugcucggcaagauggccaucuacaucugccguauguccaaccacccccggacgaccauggcguuccuauucugguuuagcuucggcuauguuaucacaugcaucuucuguaaggcccucuucuauucccucaucauuaucgggacgcuagguaaaaagauaaagcaguaccgggagcugaagccccagaccugcaccauuugcgagaccgcccccgugaacgccaucgacgcggagaugcacgaccuaaacugcucauacaacaucugccccuacugcgccucccggcugacgagcgacgggcucgccaggcacgugccccagugcccuaagcggaaggagaaggucgaagagaccgagcucuaccucaaccuggagcggauucccuggaucgugagaaagcuccuccagguguccgaaagcaccggcgucgcccugaagcgcagcuccuggcucauugugcugcugguguuguugacggucagccuguccccgguucagagcgcccccguggggcacggcaagacgaucgagaccuaccagacccgggaaggcuucaccuccauuugccuuuucaugcucgggagcauucuguuucucguaaguugccuggugaagggucucgucaauagcgucuccgacuccuucuucccggggcucuccgugugcaagacgugcagcaucggcuccaucaacggauucgagauugagagccacaaguguuacugcucccuguuuugcugcccuuacugccgccacugcagcgcggaccgagagauccaccagcugcaccucucuaucugcaagaaacgcaaaaccggcagcaacgugaugcuggcagucugcaagcggaugugcuuccgcgccaccaucgaggccucgcggcgcgcccuccucauccgcagcauaauuaacaccacguucgugauauguauccugacccugacuauuugcguggucagcacuuccgcagucgagauggagaaccuccccuccggcacuugggagcgggaggaagaucugaccaacuucugccaucaagagugucagguaaccgagaccgagugccugugcccguacgaggcucucguccugcgcaagccucuguuccucgacuccaucgugaaggggaugaaaaaccugcugaacucgacgucacuggaaaccagccuguccaucgaggccccguggggcgccaucaacguacagagcaccuucaaacccaccgucuccacggccaacaucgcguugaguugguccagcguggaacaccguggcaacaagauccucgugaccggucgcuccgagagcaucaugaagcuggaggaacggaccggggucuccugggaccugggcguagaggacgccuccgaguccaaacuccugaccgugucgaucauggaccugucccaaauguacaguccugucuucgaguaccucucgggcgaccgccagguggaggaauggcccaaggccacgugcacgggggacugcccggagcggugcggcugcaccuccuccacgugccugcacaaggaauggccccacucccgcaauuggcggugcaacccgaccuggugcuggggcgugggaaccgggugcacauguugcggcgucgacgugaaggaccuauuuaccgaccacauguucgugaaauggaaggucgaguacaucaagaccgaggccauaguuugcguggagcucacgagccaggaacgccagugcucgcugaucgaggcggggacucguuuuaacuuaggacccgucacuauaacacucagcgagccgcguaacauccagcagaagcucccgcccgagaucaucacgcugcacccuaaaguggaggagggcuuuuucgaccuaaugcaugugcagaagguccucuccgccucuaccgugugcaagcugcaguccugcacccacggaaucccgggcgaccuccaaguguaccacaucggcaaucuccugaagggggaccgggucaacggccaucucauccauaagaucgaaccacacuucaauaccagcuggauguccugggaugggugugaccucgacuacuacugcaauaugggcgacuggccgucauguaccuauacaggggugacccagcacaaccacgccgcguucgucaaccuguugaacaucgagacugauuacacgaagaccuuucacuuccacucaaagcgagugacggcucauggcgauacgccccagcuggaccugaaggcgcggccgaccuacggcgccggggagaucaccgugcucgucgagguugccgauauggagcugcacaccaagaaaguagaaaucagcggccugaaguucgcuucccucgccugcacaggaugcuacgcuugcagcuccggcaucagcugcaaaguccgcauacauguagacgagcccgacgagcugaccgugcacguuaagucgucggaucccgacgugguggccgccucaaccucccugauggcccggaagcucgaguucgggaccgacagcaccuucaaggccuucagugcgaugcccaagacgagccugugcuucuacaucgucgagcgcgaguacugcaaguccugcagcgaggaggacacccaaaagugcguggacaccaaguuagagcagccgcaguccauacuuauagagcacaagggcaccaucaucggcaagcagaacgacacaugcaccgccaaggcaagcugcuggcuugaguccguaaagagcuuccuguacgggcucaaaaacaugcugggguccgucuucgggaacuucuucaucggcauccugcuguuccucgccccauucgugcuccuggugcuguucuucauguucgguuggaagauccucuucugcuucaagugcugccgucgcaccagaggccuccucaaguaccgacugcuuaaggacgacgaggagaccggcuaccgccggaucauugaacgacucaacaacaagaaagggaagaaccgacugcuggacggcgagcgccucgcggaccggaagaucgcugagcuguucaguaccaagacacacauuggguga

SEQ ID NO: 15263 - RNA, 5067 nt, Artificial Sequence
  derived and/or modified CDS sequence (opt11) from CCHFV(52-R-2014)__KR814862.1__GP
augcccacaaacaucaugcacacccugcucgugugcuucauccuguaccugcagcucuugggccugggaggugcacaccggcagagcaacgccacggaacacaacgggaccaacaccaccacggcgcccuccaccagccagucccccaagccgcccgucagcaccgcuccgccccacgcccccgaguccagcaccaucaagcccacgacccccgccuccgaaaccgagggcagcggagagaccacgccuccgcccaacaccacccagggccccuccccgccagaggccacccccgaacggcccgcgacaaccgccaccuccacccccuccaccgacaacaccaacagcaccacccacgccacggacaacaaccccaccuccaccaucaguaccagucccagcucgagcccguccacgcccagcacuccucagggaauccaccacccggcaagaaaccugcugucaguguccagcccgaagaccgcgaccacccccaccccaaccucccccggggacauaagcucggagaccagcucccugcacagugccaugucccggacgccgacccuccacaccgcgacgcaggccucaaccgagaacgccaaccacuccgcgccccgccagagcgaguccagcgcccagcagacuaccaccucccccaugaccuccccugcccagcccauccuggugaugucagccgcccccacggcgauccagaacauccaccccagcccgaccaaccgguccaagaggaaccuggagauggagaucauccucacccugagccagggacugaagaaauacuacgggaagauucucaagcugcugcaccucacccuggaagaggacaccgagggccugcucgaguggugcaagcggaaccuggggagcaacugcgacgacgacuucuuucagaagcgcaucgaggaguucuucaugaccggggagggcuacuuuaacgagguccugcaguucaaaacccucuccacacucagccccacggagcccucccacgcccggcccccgaccguggagcccuucaagagcuacuucgcaaaggguuuccuguccauugacagcggcuacuuuuccgccaagugcuacccccgccucagcaccagcgggcugcagcugauaaacgugacucagcaccccgcccggaucgcagagacgccgggacccaagaccaccagucucaagaccaucaacugcaucaaccugcgcgccuccgucuucaaggagcaccgggagaucgaaaucaacgugcugcucccccagauagccgugaaccugagcaacugccacgucgucaucaacucccacgugugcgacuacagccuggacacggacggccccguccgccucccgcacaucuaucacgaggggaccuucauccccggcaccuacaagaucgugaucgacaagaagaacaaacugaacgaccggugcacccugguaacgaacugcgucaucaaggggcgcgaaguacgcaaggggcaguccguguuacgccaguacaagaccgagaucaagaucgggaaggccagcaccggcucccggaagcugcugagcgaggagcccggcgacgacugcaucagccgcacccagcuccugcggacggagaccgccgaaauccacgaugacaacuacgggggccccggggacaagaucaccaucugcaacggcuccaccauaguagaccagcgccucgggagcgagcucggcugcuacacgaucaaccgcgugaaguccuucaaguuaugcgagaacagcgcaaccggcaagaccugcgagaucgacuccaccccagugaagugccggcagggcuucugccugaagaucacgcaggaaggccgcggccacgucaagcucagccggggcucugagguggugcuagacgccugcgauaccagcugcgaggucaugauacccaaggggacgggcgacauccugguggauugcuccggcgggcagcagcacuuucugaaggauaaucucaucgaccugggcugcccccacgucccucugcucgggaagauggccaucuacauuugccgcaugagcaaccacccgcggaccaccauggccuuccuguucugguucuccuucggcuacgugaucacgugcaucuucugcaaggcgcuauucuauucacucauaauuaucggcacccuggggaagaagauuaagcaguaccgcgagcuaaagccccagaccugcaccaucugcgagacggcccccgugaacgccaucgacgccgagaugcacgacuuaaacugcaguuacaacaucugcccguacugugccagccggcugaccuccgacggccuggcgcgucacgucccccagugccccaagcggaaggagaagguggaagaaaccgaacuguaccugaaccuggagcggauacccuggaucgugcggaagcuacuucaggucuccgaguccaccgggguggcccugaaacgcagcuccuggcucauugugcugcugguccuccuaacggugagccugagccccgugcaguccgcccccgucggccacgggaagaccaucgagaccuaccagacccgggaaggcuucacgagcgugugucucuucaugcuggguuccauccuguuccucgugagcugucuggucaaggggcugguggauuccgugagcgacuccuucuuccccggccucagcgucugcaagaccugcuccaucgggagcaucaacggcuucgagaucgagagucacaagugcuacugcagccuguucugcugccccuacugccgucacuguagugccgaccgggagauccaccagcugcaccucagcaucugcaagaaacgcaagaugggaucaaacgugaugcuugccguuugcaagcggaugugcuuccgcgcgaccaucgaggcgagccggcgcgcccugcucauccgcuccaucaucaacaccacguucgucaucugcauucugacccugaccaucugcguggugagcaccuccgccgucgagauggagaaccucccgagcggcacgugggagcgggaggaggaccugaccaacuucugccaccaggagugccaggugaccgagaccgagugccugugccccuacgaggccuuggugcugcgcaagccccuguuccucgacagcaucgucaaaggcaugaagaaccugcugaacuccaccagccucgagaccucacugagcaucgaggcccccuggggcgccaucaacguucaguccaccuuuaagccgaccgugagcacggcgaacaucgcccugucauggagcuccguagaacaccgggggaacaagauauugguaaccgggcgcagugaguccaucaugaagcuggaggagcguaccggcgugagcugggaccugggggucgacgacgcguccgagagcaagcuccugaccguguccaucauggaccugagccagauguacucccccguuuucgaguacuuauccggcgaccgccaggucgaggaguggccgaaggcaacgugcaccggcgacugccccgagcggugcgggugcaccuccuccacgugcuugcacaaggaguggccgcacagccgcaacuggcggugcaaucccaccuggugcuggggcguggggaccggcugcacgugcugcgguguggacgucaaggaccuguucaccgaucacauguucgugaaguggaagguggaguacaucaagaccgaggccaucguaugcguggagcucacaagccaggaacgccaaugcagccugaucgaggccgguacacgguucaaccugggccccgugaccauuacccucuccgagccccgcaacauccagcaaaagcugccucccgagaucauaacgcugcaccccaaggucgaggagggguucuucgaccuuaugcacguacagaaggugcugagcgcguccaccgucugcaaacugcagagcugcacacacggcauccccggagaccuccagguguaccacaucggcaaccugcugaagggcgaccgggugaacgggcaccucauccauaagaucgagccgcacuuuaauaccuccuggaugagcugggacggcugcgaccuggacuacuacugcaacaugggggacuggcccuccugcacguacaccggcgucacccagcacaaccacgcggccuucgugaaccugcucaacauagagaccgacuacacgaaaaccuuccacuuccacagcaagagagucaccgcccauggggauacgccccagcuggacuuaaaggcccggcccaccuacggcgccggcgagaucaccguguuaguggaggucgcggacauggagcugcacacgaagaagguggagaucuccgggcugaaguucgccagccucgccugcaccggcugcuacgccugcuccagcggcaucagcugcaaggugcgcauccacgucgacgagccugacgagcugacggugcacguaaagagcaacgaccccgacgugguggccgcguccaccagccugauggcccguaagcucgaguucgguaccgacuccaccuucaaggccuucagcgcuaugcccaagacgagccugugcuucuacaucgucgagcgcgaguauugcaagaguugcucagaagaggacacccagaagugcgucgacaccaagcuggagcagccacaguccauccucaucgagcacaaggggacaaucaucggcaagcaaaacgauacuugcaccgcgaaggccgguugcuggcuggagagcgugaaguccuucuucuacgggcugaagaacaugcucggcagcguguucgggaacuucuucaucggcauccuacuguuccucgccccguuuguccugcuggugcuguucuucauguucggcuggaagauccucuucugcuucaagugcugccggcgcacccggggccugcugaaguaccgccuccugaaagacgacgaggagaccggcuaccgccggaucauagagcgccuaaacaacaagaaggggaagaaccggcuccuggacggggagcgcuuagccgaccggaagauugccgagcuguucuccacgaagacccacaucggauga

SEQ ID NO: 15264 - RNA, 5067 nt, Artificial Sequence
  derived and/or modified CDS sequence (opt11) from CCHFV(47-ST-2013)__KR814861.1__GP
augcccaucaacaucaugcacacccugcuggccugcuucauccuguaccugcagcuauccgggcucggcggagcccacgggcaguccaacgccaccgagcauaacgguaccaauaccaccaccgugccggggacuucccagucgcccaagccgccggccaguaccacccugccgcacacccccgagagcagcacggucaaacucaccacccccaccuccgagaccgagggcagcggcgagacaacgcccccgcccaacaccacccaggggcugccaccgcccggcaccaccccggagcgcuccgccaccaccgccaccuccaccuccagcaccgacaacaugaacuccacgacgcagaugaccgggaacacccccacccccaccgucaauaugagcccuaguaguucccccagcaugcccuccaccagccagggaauccacuacccuguccggagccugcucuccgucccgagccccaagacagccaccacccccacuccaguuagccccggugagaugagccccgagaccuccagccagcauuccgcaacgagccgcauccccacccuguacaccgccacccagguguccaccgaaaauacaaaccggagcacgccccgccaaaguaagaguuccgugcagccggccacccagagccccaucacaccgccagcucagacgauccugcucauguccgcggccccaaaggccauccaggacaugcaucccagccccacgaaucgguccaagcgcaaccuggagguugagaucauccugacccucagccagggccugaagaaguauuacggcaagauucugaagcuccugcaccugacgcucgaggaggauacggaggggcuccuggaguggugcaagcggaaccucggcuccaacugcgacgacgacuucuuccagaagcgcaucgaggaguucuucaucaccggggagggcuacuucaacgaagugcugcaguucaaaacccugagcacccucagccccacugagcccucccacguccggcugcccaccgccgagcccuucaagagcuacuacgccaagggcuuccugagccuggacagcggcuacuucuccgcgaaguguuacccgcggucguccacuagcggccugcagcuaaucaacgugacccagcaccccgcccggauugccgagacgcccgggcccaagaccaccuccuuaaagaccaucaacugcaucaaccugcgcgccuccguuuuuaaagagcaucgggaggucgagaucaacgugcuacucccgcagaucgccgugaaccugagcaacugccacgucgugaucaacagccacgugugcgacuacccccuggacacggacggccccguucgccucccccggauccaccacgaggggaccuucaucccgggcaccuauaagaucgucaucgacaagaagaacaagcugaacgaccgcugcucccuggugaccaacugugucaucaagggacgugaggugcgcaaggggcagagcgugcuccggcaguacaagacggagauaaagaucggcaaggcguccaccgggagccgcaagcugcuguccgaggaacccggcgacgacugcaucagccggacccagcuccugaagaccgagacggccgagauccacgacgacaacuacgggggucccggcgacaagaucaccaucugcaacgggagcaccaucguagaccagcgccugggcuccgagcucggguguuacaccaucaaccgcgugaaauccuucaagcucugcaaaaauucggccacuggcaagaccugcgagaucgacagcacccccgucaagugccggcagggguucugccugaaaaucacccaggagggccgcggccacgugaaguugucccggggaagcgaggugguccucgacgccugcgacucaagcugcgagaucaugaucccuaagggcacuggggacauucugguggauugcuccggcggccagcagcacuuccugaaggacaaccucaucgaccugggguguccccacauaccccugcucgggaagauggccaucuacauuugucgcaugagcaaucacccccggacaaccauggcguuccuguucugguucuccuucggguauguuaucacgugcaucuucuguaaggcccucuuuuacagccucaucauuaucggcacucuggggaagaagaucaagcaguaccgcgagcucaagccgcagacgugcacuaucugcgagaccgcccccgucaacgccaucgacgcagagaugcacgaccucaacugcucguacaacauuugccccuacugcgcgagccggcuaacguccgacgggcuggcccgccacgucacgcaguguccgaaacggaaggagaaaguggaagagaccgagcucuaucugaaccuggagcgcauccccuggauuguccggaaacuccuccaggugagcgaauccaccggcguggccuuaaagcgcagcaguuggcucauuguccugcuggugcuccuaacggugagccuaagccccguccaguccgcccccgugggacauggcaagaccaucgagaccuaccagaccagagagggguucaccagcaucugccucuuuaugcugggcuccauacuguucaucgugagcugccucgucaaggggcugguggacuccgugagcgacuccuucuucccgggccugagcguaugccgcacgugcuccaucggcagcaucaacggguucgaaaucgagucccacaagugcuacugcagccucuucugcugccccuacugccggcauugcuccgcggaccgugagauccaccagcugcaccugagcaucugcaagaagcgcaaaaccggcuccaacgugaugcucgccgugugcaagaggaugugcuucaaggccaccauugaggccucccggcgcgcccuguucauccgcuccaucauuaacacuacguucgugaccugcauccugacccucgcgaucugcguggugagcaccuccgcggucgagauggaggaccuucccgcagggaccugggagcgggaggaggaccuaaccaacuucugucaccaagagugccaagugacagagaccgaaugccugugccccuacgaagcccuggugcugcguaagccgcuguuucuggacucuaucgucaaggggaugaagaaccugcucaacagcacgucacucgagaccagccuguccaucgaggcccccuggggcgcgauaaacgugcagucgaccuucaagcccaccguguccaccgcgaacaucgcucuaagcugguccagugucgaacaccggggcaacaagauccuggugaccggccgcuccgaguccauaaugaagcuggaggagcgaaccggggugucgugggaccucggcgucgaggacgccagcgaauccaagcugcugaccgugagcaucauggaccucucccagauguauagccccguguucgaguaucuauccggggaccggcaggucgaagaguggccgaaggcuacaugcaccggcgagugccccgaacggugcggguguaccagcagcacguguuuacacaaggaauggccccacagcagaaauuggcggugcaaccccaccuggugcuggggcguggguaccggaugcacgugcugcggcguggacgucaaggaccucuucaccgaccacauguucaucaaguggaagguggaguacaucaagaccgaggcgaucguaugcgucgaacugacgagccaggagcgccagugcuccuuaaucgaggccgggacucgguucaaccucggcccggugacaaucacccugagcgagcccagaaacauccagcagaagcuaccgcccgaaaucaucacgcuccacccgaagaucgaggaaggcuucuucgaucugaugcacgugcagaagguccuguccgccagcaccgugugcaagcuccaguccugcacccacgggauccccggagaccugcagaucuaccauauugggaaucugcugaaaggcgaccgggugaaugggcaccugauucacaagaucgagccucacuucaacaccagcuggaugaguugggacggcugcgaccuggacuacuauugcaacaugggcgacuggcccucaugcacguacaccggggucacccagcacaaccacgccgcguucgugaaccugcuaaacaucgagaccgacuacacuaagaccuuccauuuucacuccaagcgcgucaccgcgcacggcgauaccccgcagcuggaccucaaggccagaccuacuuacggggccggcgagaucaccgugcuuguggagguagccgacauggagcugcacaccaagaaaguggaggugagcggacucaaguucgcgucccuggccugcacaggcugcuacgccugcagcuccggcaucagcugcaaaguccgcauacacguugacgagcccgacgagcugacggugcacguuaagucuagcgaccccgacgugguggccgcguccaccagccucauggcgcggaagcuggaguucgggaccgacuccaccuucaaggcauucagcgccaugccgaagaccagccugugcuucuacaucgucgagcgcgaguacugcaaguccugcucggaagaugacacaaagaaauguguggacaccaagcucgagcagccccagucaauccugaucgagcacaagggcaccaucaucgggaagcagaacgacacguguacggccaaggccuccugcuggcuggaguccgucaagagcuucuuuuacggccuuaagaacaugcugggguccgucuucggcaauuucuuugugggcauccuccuguuccuggcgcccuucgugcugcugguacucuucuucauguuuggauggaagauccuguucugcuucaaguguugcagacgcacccgaggccuguucaaguaccgccaccucaaggacgacgaagagaccggauaucgccggaucauagagagacugaacagcaagaagggcaagaaccggcugcuggacggcgagcgccuggccgaccgaaagaucgccgagcuguucuccacgaaaacccacaucgguuga

SEQ ID NO: 15265 - RNA, 5067 nt, Artificial Sequence
  derived and/or modified CDS sequence (opt11) from CCHFV(46-ST-2012)__KR814860.1__GP
augcccaccaacaucaugcacacccugcucgugugcuucauccuguaccuucagcucuugggccuuggaggcgcccacgggcagagcaacgccacggagcacaacggcaccaacaccaccacggucccguccaccagccagucccccaagccccuggugagcaccacgcccccgcacgcucuggaguccagcaccaucaagcccaccacccccaccuccgagacggaggggagcggcgagaccgcgccccugccgaacaccacccaggggcccccgccgcccgagaccacccccgagcgccccgccaccaccgugacguccacccccagcaccgauaacaccuccagcacgauccaugucaccgacaacaaccccaccuccaccaucagcacgucccccagcuccagccccuccacccccagcaccccgcagggaauccaccaccccgcccggagccuccuguccgugagcagccccaagacggccacgacccccaccccgaccagccccggcgagaucaacuccgagaccagcucccugcacagcgccaugucccgcacccccacccuccacaccgccacccaggugagcacggagaacgccaaccauuccgcgccccggcagagcgaguccagcgcccagccgaccaccaccucccugaugacgagccccgcccaauccauccugcucaugagcgccgcccccaccgcuauccagaacauccacccgucccccaccaaccgcagcaagcggaaccuggagauggagaucauccugacccucagccaggggcugaagaaguacuacggcaagauccugaagcuccugcaccugacgcucgaggaggacaccgagggguuacuggaguggugcaagcgcaaccucggcuccaacugcgacgacgacuucuuccagaagcggaucgaggaguucuucaugaccggcgagggguacuucaacgaaguacugcaguucaagacccugagcacgcucucccccaccgagcccagccacgcgcgccugccgaccguggagcccuucaaguccuacuucgccaagggcuuccugagcguggacuccggguacuucagcgccaagugcuacccccgguccagcaccuccggccuccagcugaucaacgugacgcagcaccccgcccgcaucgcggagaccccgggccccaagaccaccucgcugaaaacgaucaacugcaucaaccuccgggcgucgguguucaaggagcaccgagagaucgagaucaacgugcugcugccccagaucgccgucaaccucagcaacugccacguggugaucaacucacacgucugcgacuacagccuggacaccgacgggcccgugcggcugccccacaucuaccacgagggcaccuucaucccggggaccuacaagaucgugaucgacaaaaagaacaagcucaacgaccgcugcacgcuggucaccaacugcgugaucaaaggccgggaggugcgcaagggacagucaguccugcggcaguacaagaccgagaucaagaucggcaaggccagcaccggcagccgcaagcuccuguccgaggagcccggggacgacugcaucagccggacgcagcugcuccgcaccgagaccgccgagauccacgacgacaacuacggcgggcccggcgacaagaucaccaucugcaacggguccacuaucguggaccagcgacugggcagcgagcuaggcugcuacaccaucaaccgcgugaaguccuucaagcugugcgagaacagcgcuaccgggaagaccugcgagaucgacuccacgccggucaagugccgccagggcuucugccucaagaucacccaggaagggagaggccacgugaagcugagccgcggguccgaggucgugcuggacgcgugcgacagcuccugcgaggucaugaucccgaaaggcaccggcgauauccucgucgacugcagcgggggccagcagcacuuccugaaggacaaccugauagaccucgggugcccccacaucccccuguuaggcaagauggccaucuacaucugccggauguccaaccacccgcgcaccaccauggccuuccucuucugguucagcuucggcuacgugaucacgugcaucuucugcaaggcccuguucuacucccugaucaucaucgggaccuuaggcaagaagaucaagcaguaccgggagcugaagccccagaccugcaccaucugcgagacggcccccgugaacgcgaucgacgccgagaugcacgaccugaacugcagcuacaacaucugucccuacugcgccucgcgccucaccagcgacgggcuagcccggcacgucccgcagugccccaagcgcaaagagaagguggaggagaccgaguuauaccucaaccuggagcggaucccauggaucgugcgcaagcugcuccaggucuccgagagcaccgguguggcgcugaagcggagcucuuggcugaucgugcuucugguccugcucacggugagccucagcccugugcagagcgcccccgucgggcacggcaagaccaucgagaccuaucagacccgcgagggcuucacguccaucugccuguucaugcucgggagcauccuguuccugguguccugccucgugaagggccuggucgacagcguguccgacagcuucuucccagggcuguccgugugcaagaccugcagcaucggcucuaucaacggguucgagaucgagagccacaaguguuacuguucccucuucugcugccccuacugccggcacugcagcgccgaccgcgagauccaucaacugcaccuguccauuugcaagaagcggaagaccgggagcaaugucaugcucgccgugugcaagcgcaugugcuuccgggccaccaucgaggcgucccgccgggcccugcugauccgcagcaucaucaacgccacguucgugaucugcauacucacccugaccaucugcgucgugagcaccuccgccguggagauggagagccugccugccggcacgugggagcgcgaggaggaucucaccaacuucugccaccaggagugucaggucaccgagaccgagugccugugccccuacgaggcgcuggugcuacggaagccccuguuccuggacuccaucgugaaggggaugaagaaccuccugaacagcacgucccuggagaccagccucuccaucgaggcccccuggggcgccaucaacguccagagcaccuucaagccgaccguguccacggccaacaucgcccugagcugguccagcguggagcaccgcgggaacaagauacuggucaccggccgguccgagagcaucaugaagcucgaggagcgcaccgggguguccugggaccugggcguggaggacgcgagcgagucaaagcugcucaccgugagcaucauggaccugucccagauguacagcccgguguucgaguaccugagcggcgaccgccagguggaagaguggcccaaagccacgugcacaggggacugccccgagcggugcggcugcaccuccagcacgugccuccacaaggaguggccgcacucccggaacuggcgcugcaacccgaccuggugcuggggcgucggcaccgggugcacgugcugcggcguggacgugaaggaccuguucaccgaucacauguucgucaaguggaagguugaguacaucaagaccgaggccauugugugcgucgagcugacaagccaggagcggcagugcucccucaucgaggccggcacacgcuucaaccuggggcccgugaccaucacccugagcgagccccggaacauccagcagaaguugccgcccgagaucaucacgcugcaccccaagguggaggagggcuucuucgaccugaugcacguccagaaggugcucuccgcgucaaccgugugcaaacugcagucaugcacccacgggauccccggcgaccugcaggucuaccacaucgggaaccuccugaagggggaccgcaucaacggccaccucauccacaagaucgagccgcacuucaacaccagcuggauguccugggacgggugcgaccucgacuacuacugcaacaugggcgacuggcccagcugcacguacaccgggguaacccagcacaaccacgccgccuucgucaaccugcugaacaucgagaccgacuacacgaagaccuuccacuuccauuccaagcgggugaccgcccacggcgacacgccccagcucgaccugaaggcccgccccaccuacggcgcgggggagaucaccgugcuggucgagguggccgacauggagcugcacaccaagaagguggagaucagcggccuuaaguucgccucccuggccugcacagggugcuacgccugcagcuccggcaucagcugcaagguccggauccacguggacgagccggacgagcucacagugcacgucaaguccagcgaccccgacgugguggcggccagcacuucccugauggcccgcaagcuggaguucgggaccgacagcaccuucaaggccuucuccgccaugcccaagacgagccucuguuucuacaucgucgagagggaguacugcaaguccugcagcgaggaagacacccagaagugcguggacacccgccuggagcagccccaguccauccugaucgagcacaagggcaccaucaucggaaagcagaacgacacgugcaccgcgaaggccagcugcuggcucgaguccgucaagagcuucuucuacgggcugaagaacaugcugggcuccguuuucgggaacuucuucaucggcauccuccuguuccuggcuccguucgugcugcucgugcuguucuucauguucggguggaagauccuguucugcuucaagugcugccggcgcacccggggccuccugaaguaucgccaccugaaggacgacgaggagacuggcuaccgccggaucaucgagaggcucaacaacaagaaggggaagaaccggcugcuggacggcgagcgccucgccgaccggaagaucgcggagcuguuuagcacgaagacgcacaucggguga

SEQ ID NO: 15266 - RNA, 5067 nt, Artificial Sequence
  derived and/or modified CDS sequence (opt11) from CCHFV(44-ST-2010)__KR814859.1__GP
augcccaucaacaucaugcauacccugcucgugugcuucauccuguaccugcagcucagcggccugggcggcgcccacgggcaguccaacgccaccgagcacaacggcacgaacacaacuaccgucccggggacgagccagucccccaagccgcccgcgagcaccacccugccccacacccccgagucauccacggugaagcucaccaccccaacaagcgagacggaggggagcggcgagaccacgcccccgcccaacaccacgcagggucugcccccgcccggcaccacccccgagagacccgccacaacggcaaccuccaugagcuccaccgacaauaugaauagcaccacccaggugaccgacaacacccccaccuccacggucagcauauccccgagcuccagccccuccaugccuagcaccagccagggaauccacuaucccguacggucccugcucagcguguccagcccgaagacagucaccacgcccacccccaugucccccggcgagaugagcccggaaaccuccagccagcacuccgccaugagccgcauccccaccuuguacacggccacccagguguccaccgagaacaccaaccgguccacuccccgccaguccgagagcuccgcgcagcccgccacccagagcccgaccaccucccccacccagacgauccuguuaaugagcgccgcacccaaggcuauccaggacaugcacccgucccccaccaaccggagcaagcgcaaucuagagguggagaucauccugacccucagccaggggcugaagaaguacuacgguaagauucugaagcuccuucaccugacccucgaggaagauacggagggccugcuggaguggugcaagcggaaucucggguccaacugugacgacgacuucuuccagaagcgcaucgaagaguucuucaucaccggcgagggguacuucaacgagguccugcaguucaagacccugagcaccuuauccccuacggagcccagccacgugcggcugccgaccgccgagcccuucaaguccuacuuugccaagggcuuccugagcaucgacuccggcuauuucagcgccaagugcuacccccgcuccagcaccuccgggcuccagcugaucaacgucacccagcaccccgccaggaucgcggagacgccuggcccaaagaccaccagccugaagaccaucaacugcaucaaccuccgcgccuccgucuucaaggagcaccgggagguggagaucaacgugcugcugccgcagaucgccgugaaccugagcaacugccauguggugaucaacucccacgucugcgacuacagccuggacacggacgggcccgugcgccugccgcggauccaccacgagggcaccuucauccccgggacauacaagaucgugaucgacaagaaaaacaagcucaacgaccgcugcuccuuagucaccaauugcgugaucaaaggccgggaggugcguaagggucagagcguccugcggcaguacaagacggagaucaagaucgggaaggccagcaccggcucccgcaagcuccugagcgaggagcccggggacgacugcaucucccggacccagcugcucaagacugagacggccgagauccaugacgacaacuacggcggacccggagacaagaucaccauuugcaacggcagcacaaucguggaccagcgccugggcucggagcugggcugcuacaccaucaaccgcgucaagagcuucaagcucugcgagaacuccgcgacggggaagaccugcgagaucgacagcaccccggugaagugccggcagggcuucugccugaagaucacccaggaagggcgcggccacgugaagcugucccggggcagcgaggucgugcuggacgccugcgacuccagcugcgagaucaugauucccaaggggacgggcgauauccucguggacugcuccgggggccagcagcacuuccugaaagacaaccugaucgaucucggcugcccccacaucccccugcuggggaagauggccaucuacaucugccgcaugagcaaccacccccggaccaccauggccuuccuccugugguucagcuucggcuacgucauuaccugcaucuucugcaaggcccuguucuacagccucaucaucaucgggacccugggcaagaagaucaagcaguaccgcgagcugaagccccagacgugcaccaucugcgagaccgcgcccgugaacgccaucgacgccgaaaugcacgaccucaacugcuccuacaacaucugccccuauugcgccagccgacugaccuccgacgggcuggcccgccacgugacgcaaugcccgaagcggaaggagaagguagaggagaccgaacucuaccugaaccuggagcgcauccccuggaucgugcggaagcuccuccaggugagcgagagcaccggcgucgcgcugaagcgguccagcuggcugaucguguuguuggugcuucugaccgucucccugagccccgugcagagugccccgguaggccauggcaagacgaucgagaccuaucagacccgggagggcuucaccaacaucugccuuuucaugcuagggagcauccuguucaucgucagcugccucgugaagggccugguggacagcgucuccgacagcuucuucccgggucuguccgugugcaagacgugcagcuucggcuccauaaacggcuucgagaucgaaagccacaagugcuacugcucccucuucugcugccccuacugccgccauugcucagccgaccgggagauccaccagcugcaccuggggaucugcaagaagcgcaagacuggauccaacgugaugcucgccguuugcaagcggaugugcuucaaggcgacgaucgaggccucccgccgggcccugcugauccgcuccaucauuaacacaacguucguuaucuguauccugacccuggccauaugcguggucagcaccagcgcgguggagauggagaaccugcccgcggggaccugggagcgcgaggaggaccucacgaacuucugccaccaagagugccagguauccgaaacagagugccugugcccguacgaggcucugguccuccggaagcccuuauuccuggacagcaucguaaaaggcaugaagaaccuacugaacuccaccagccuggagacuucccuuagcaucgaggcgcccuggggcgccauuaacgugcaguccacguucaaaccgaccgucagcaccgccaacaucgcacuguccuggagcuccguggagcaccgcgggaacaagauccuggugaccggccggagcgaguccaucaugaagcucgaggagcgcacgggggucagcugggaccugggcguggaggacgcguccgagagcaaguuacucaccguguccaucauggaucugagccagauguacuccccggucuucgaguaccugagcggggaccgccagguggaggaauggcccaaggcuaccugcaccggcgauugccccgagcggugcgggugcacgagcuccacgugccuccacaaagaguggccgcacagcaggaacuggcgcuguaacccgaccuggugcuggggcgugggcaccgggugcaccuguugcggcguggacguaaaggaccuguucacugaccacauguucaucaaguggaagguggaguacaucaagaccgaagccaucgucugcguggagcugaccucccaggagcggcagugcagccucauugaggcugggacccgcuucaaccugggccccgugacgaucacccucuccgagccccggaacauccagcagaagcucccgccggagaucaucacccugcaccccaagaucgaagaaggauuuuucgaccugaugcacguccagaagguccucagcgcauccaccgugugcaagcugcagagcugcacgcacgggauacccggcgaccugcagauuuaccacaucgggaaccuccugaagggcgaccgccugaacggccaccucauccacaagaucgagccgcacuucaacaccucuuggaugagcugggacggcugcgaccuggacuacuacugcaauaugggcgacuggccguccugcaccuauaccggggucacgcagcacaaccacgccgccuucgugaaccugcucaacaucgagaccgacuacaccaagaccuuccacuuccacagcaagcgggucacggcccacggcgacacgccccagcuggaccugaaggcgcgcccaaccuacggggcuggcgagaucaccgugcucguggaggucgccgacauggagcugcacaccaagaagguggagaucuccggucugaaguucgccagccucgccugcaccggcugcuacgcgugcuccagcggcaucuccugcaagguccggauccacguugacgagcccgacgagcugaccgugcacgucaagagcuccgacccggacgugguggccgccagcaccagccugauggcacgcaaguuagaguuuggaacggacuccaccuucaaagccuucucagcgaugccgaagaccucccugugcuucuacaucguggagcgggaguacugcaagagcugcucugaggaugacaccaagaagugcgucgacacgaagcuggaccagccucaaagcauccucaucgagcauaaggguaccaucaucgggaagcagaacgacaccuguaccgccaaggccuccugcuggcuggagagcgugaaguccuucuucuacggccugaagaacaugcucggauccguguucggcaacuucuucgucggcauccugcuguuccuggcccccuucgugcuccuggugcuguucuucauguguggguggaagauccucuucugcuucaagugcugccgccggacgcgcggccuguucaaauaccggcaccugaaggacgaugaggagacgggguaccgccgcaucauagagcggcucaacuccaagaagggcaagaaccgccugcuggacggcgagcggcucgcugaccgcaagaucgcggagcuguucagcacaaagucccacauuggguga

SEQ ID NO: 15267 - RNA, 5067 nt, Artificial Sequence
  derived and/or modified CDS sequence (opt11) from CCHFV(37-R-2013)__KR814858.1__GP
augcccaccaacaucaugcacacccugcucguguguuucauccuguaccuucaguuacuggggcuugggggagcccaccgccagagcaacgccacggagcacaacggaaccaacaccaccacggcgcccuccaccagccagucccccaagccucccgucagcaccgccccgccccacgcccccgagaccuccaccaucaagcccaccaccccggccuccgagacggagggcuccggugagacgacucccccgcccaacaccacgcagggccccagcccacccgaggccacgcccgagcggccggcgacgaccgugacauccacacccagcaccgacaacacuaacuccaccacgcacgccaccgacaacaaccccacgagcacgaucuccacgagccccucaagcuccccgagcaccccauccacgccccagggcauccaccaccccgcccgcaaccuccugagcguguccuccccgaagaccgccaccacucccacccccaccagccccggggacaucuccagcgagacguccagccugcacuccgcgaugucucggaccccgaccuuacacacagcgacccaggccuccacggagaacgccaaccacagcgcuccccgccaguccgagagcuccgcgcagcagaccacaaccucccccaugacgucuccggcccagcccauccuugucaugagcgccgcccccaccgccauccagaacauccaccccuccccgaccaaccggagcaagaggaaccuagagauggagaucauccucacccugucccagggccugaagaaguacuacgggaagauccucaagcugcugcaccucacgcuggaggaagacaccgagggccugcucgaguggugcaagcggaaccuggggagcaacugcgacgacgacuucuuccagaaacgcaucgaggaguucuucaugaccggugagggguacuucaacgaggugcugcaguucaagacccucagcacgcugucccccaccgaacccagccacgcgcggcccccgaccguggagcccuucaagucuuacuuugccaagggguuccugagcaucgacuccggauacuucagugccaagugcuacccccgccucacaacguccgggcugcagcugaucaacgucacccagcaccccgcccggaucgccgagaccccgggccccaaaaccacgagccucaagaccaucaacugcaucaaccugcgcgcguccguguucaaggaacaccgggagaucgagaucaacgugcugcucccccagaucgccgucaaccugagcaacugccacguggugauuaauucccacgucugcgacuacagccuggacacagacggccccgugcgccucccgcacaucuaccacgagggaaccuucauccccggcacguacaagaucgugauagacaagaagaauaagcugaacgaccgguguacccuggucacuaacugcgugaucaaagggcgcgaggugcggaagggccaguccguccuccgccaguacaagaccgagaucaagaucgggaaggccagcacgggcucccggaagcuguuaagcgaggagcccggcgacgacugcaucucccgcacccagcuccugcggaccgagaccgccgagauccacgacgacaacuacgggggccccggggacaagaucacgaucugcaacggcagcaccaucguggaccagcgccuugguagcgagcucgguugcuacaccaucaaccgcgugaaguccuucaagcugugcgagaacagcgccaccggcaagacgugcgagaucgacuccaccccgguuaagugccggcagggguucugucugaagaucacucaggagggccgcgggcacgugaagcucagcaggggcuccgaggugguccucgacgcgugcgacaccagcugcgaggugaugauccccaaggggaccggcgacauccuggucgacugcuccggcgggcagcagcacuuccugaaggacaacuugaucgaccugggcuguccccauaucccccugcucgggaagauggccaucuacauuugccgcaugagcaaccacccgcggacgacuauggccuuuuuauucugguucuccuucggauacgugauaaccugcaucuucugcaaggcccuguucuacagccucaucaucaucgguacccuggggaagaagaucaagcaguaccgggagcugaagccccagacaugcaccaucugcgagaccgcgcccgugaacgccaucgacgccgaaaugcacgaccucaacugcuccuacaacaucugcccguacugcgccagccggcugaccuccgacggccuggcacgccacgucccccagugccccaaacggaaggagaagguggaggaaacggagcucuaccugaaccuggaacgcauccccuggaucgugcggaagcuccugcaggucuccgaguccacugggguagcgcugaagagaucuuccuggcucaucgugcugcugguccuccugaccgucagccuguccccggugcagagcgcccccgugggucacgggaagaccaucgagacguaccagacccgggagggcuucaccagcgugugccucuucaugcugggcucuauccuguuccucgugagcugccuggucaagggccugguggacuccgugagcgauuccuucuuccccggccucagcgucugcaaaaccugcuccaucgggagcauuaacgguuucgagauugagucacacaagugcuacugcagccuguucugcugccccuauugccgccacugcagcgccgaccgggagauccaccagcuccaccucagcaucugcaagaaacgcaagaugggguccaacgugaugcuggccgugugcaagcggaugugcuuccgcgccacgaucgaggcgagcaggcgcgcccuguugauacgcuccaucaucaacaccacguucgucaucugcauccugacccugacgaucugcguggugagcacguccgccgucgagauggagaaccucccgagcggcaccugggagcgggaggaggaccuuaccaauuucugccaccaggagugccaggucacggagaccgagugccugugccccuacgaggcccucgugcugcgcaagcccuuauuccucgacucgaucgucaagggcaugaagaaccugcugaacagcaccagccucgagaccucccugagcaucgaggcccccuggggugcgaucaacgugcagucgacguucaagccaaccgugucaaccgccaacaucgcccugagcuggagcucugucgaacaccgggggaacaagauccuggugaccgggcgcagcgaguccauaaugaaguuagaggagcggacgggcguaagcugggaccugggcgucgacgacgcauccgaaagcaaacuccugaccguguccaucauggaucugagccagauguacuccccaguguuugaguaccucagcggcgaccgccaggucgaagaguggcccaaggcgaccugcacaggcgacugcccugagcggugcgguugcacauccagcacgugccugcacaaggaguggccgcacucccgcaacuggcggugcaaccccaccuggugcuggggcguggggaccggcuguaccugcugcgggguggacguaaaggacuuauucaccgaccacauguucgugaaguggaagguggaguacaucaagaccgaggccauagucugcguggagcucaccagccaggagcgccagugcagccugaucgaggccggcacccgguucaaccugggacccgugacgaucacccucuccgagccgcgcaacauccagcagaagcugccgcccgagaucaucacccuccaccccaaagucgaagaggguuucuucgacuuaaugcacgugcagaaggugcugucagccuccaccgucugcaagcugcagagcugcacgcacggcaucccaggggaccuccagguguaccacauuggcaaccuacugaagggcgaccgggugaacggccaccucauccacaagaucgagccacacuucaacaccucauggaugagcugggacggcugugaccuggacuacuacuguaacaugggggacuggcccuccugcaccuacaccggcgucacucagcacaaccacgccgcguucgugaaccugcucaacaucgaaacagacuacaccaagaccuuccacuuccacagcaagcgcgucaccgcccacggggacacgccccagcuggaccugaaggcccgucccaccuacggcgccggcgagauaaccguucucguggaggucgccgacauggagcugcacacgaagaagguggagaucuccgggcugaaguucgcgagccucgccugcaccggcugcuacgccugcuccagcgggaucuccugcaaggugcgcauccacgucgacgagccggacgagcugaccgugcaugugaaaagcaacgaccccgacgucguggccgccuccaccagccugauggcgcggaagcucgaguucggcacagacuccaccuuuaaggcguucagcgcgaugcccaaaacaucccugugcuucuacaucguggaacgcgaguacuguaagagcugcagcgaggaggacacccagaagugugucgacacgaagcuggagcagccgcaguccauccucaucgagcacaagggaaccaucauuggcaagcagaacgugaccuguaccgccaaggcgagcugcuggcuggaguccgucaagagcuucuucuacggccugaagaacaugcucggguccguguucggcaacuucuucaucgguauccugcuguuccuugcccccuucgugcugcuuguucuguucuucauguucggcuggaagauccucuucugcuucaagugcugccgacgcacgcgggggcugcugaaguaccgccuccugaaagacgacgaggagaccggcuaccgccggaucauugagcgccugaacaacaagaagggcaagaaccggcuccuggacggggagcgccuggccgaccggaagaucgccgaacucuucagcaccaagacccacaucggcuag

SEQ ID NO: 15268 - RNA, 5067 nt, Artificial Sequence
  derived and/or modified CDS sequence (opt11) from CCHFV(36-ST-2014)__KR814857.1__GP
augcccaucaacaucaugcacacacugcucgugugcuucauccuguaccugcagcuuagcggcuuagggggcgcccacgggcaguccaacgccaccgagcacaauggcacgaacaccacuaccgucccggggacgagucagucucccaagccgcccgcgagcaccacccucccccauacccccgaauccagcacugugaagcucaccacucccaccuccgagaccgagggcucgggcgaaacaacgcccccgcccaacaccacgcagggacugcccccucccggcaccacccccgagcgccccgccaccacggccaccuccaugucauccaccgacaacaugaacagcaccacccaggugaccgacaacacacccacauccacggucagcaucucuccgucguccagcccuuccaugccgagcaccagccaagggauccacuaccccgugcggucccugcucagcguguccucaccgaagaccgucaccacgcccaccccaaugucccccggcgaaaugagcccggagacuuccagccagcacuccgccaugucucgcauccccacccuguacacggccacccagguguccaccgagaacaccaaccggagcacgccccgccaguccgagagcuccgcgcagcccgccacgcagagcccgaccaccagcccuacccagacgaucuugcugaugagcgccgcacccaaggcgauccaagacaugcacccaucccccacaaaccgaagcaagcgcaaccuggagguggagauaauccugacccucagccaggggcugaagaaguacuacggcaagauccugaaacuccugcaucugacccucgaggaggacacggagggccugcuggaguggugcaagcggaaccucggcuccaacugcgacgacgacuucuuccagaaacgcaucgaggaguuuuucaucaccggcgagggguacuucaacgagguccugcaguucaagacccugagcacccucucccccacggagcccucucacgugcggcugccgaccgccgagcccuucaagucguacuucgccaagggcuuccugagcaucgacuccggauacuuuagcgccaagugcuauccacgcuccucgaccuccgggcuacaacugaucaacgugacccagcaccccgcccggaucgcggaaacgccgggccccaagaccaccagccugaagaccaucaacugcaucaaccuccgcgccuccguguucaaggagcaccgagaaguggagaucaauguccugcugccccagaucgccgucaaccucagcaacugccacguggugauuaacucccacgucugcgacuacagccuggacacggacgggcccgugcggcugccgcggauccaccacgagggcaccuucauuccaggcaccuacaagaucgugaucgacaagaagaacaagcucaaugaccgcugcucccuggugaccaacugugugaucaagggccgggaggugcgcaagggccagagcguccugcggcaguacaagacggagaucaagaucgggaaggccagcaccggcucacgcaagcuccuaagcgaggagcccggggacgacugcaucucccggacccaguuacugaagaccgagacggccgagauccacgacgacaacuacggcgggcccggcgacaagaucaccaucugcaacggaagcaccaucguggaccagcgccuggguuccgagcugggcuguuacaccaucaaucgaguuaagagcuucaagcucugcgagaacuccgcgacggggaagaccugcgagaucgacagcaccccggugaagugccggcagggcuucugccugaagaucacccaggaagggcgcggccacgugaagcugucccggggcagcgaggucgugcuggacgccugcgacuccagcugcgagaucaugauccccaaggggacgggagacauccucguggacugcuccgguggccaacaacacuuucugaaggacaaccugaucgaccucggcugcccccacaucccccugcuggggaagauggcuaucuacaucugccgcaugagcaaccacccucggaccacgauggccuuccucuucugguuuuccuucggcuacgucaucacaugcaucuucugcaaggcccuguucuacagccugaucaucaucggcacccugggcaagaagaucaagcaguaccgcgagcugaagccccagacgugcaccaucugugagaccgcgccgguuaacgccaucgacgccgagaugcacgaccugaacugcuccuauaacaucugccccuacugcgcuagccggcucaccagugacgggcucgcccgacacgugacgcagugcccgaagcggaaggagaaggucgaggaaaccgagcuguaccucaaccuggagcgcauccccuggauugugcggaagcugcuccaggugagcgagagcaccggcgucgcgcugaagcgcuccucguggcugaucgugcuccuggugcugcugacugucucccugucacccgugcaguccgccccggugggccacgggaagacgaucgagaccuaccagacccgggagggcuucacgaacaucugccuguucaugcuagggagcauccuguucaucgucuccugccuggugaagggccucgucgauagcgucuccgacagcuuuuuccccgggcuguccguaugcaagacgugcagcaucggcuccaucaacggcuucgagaucgagagccacaagugcuacugcucccuguucugcugccccuacugccgccacugcagcgccgaucgggagauccaccagcugcaccuggggauaugcaagaagcggaagaccggauccaacgugaugcuggccgucugcaaacggaugugcuuuaaggcgaccaucgaggccagccgccgggcccuccugauccguuccauaaucaacaccacuuucguaaucugcauccugacccucgccaucugcguggucagcaccagcgccguggagauggagaaccugcccgcggggaccugggagcgcgaggaggaccugacgaacuucugccaucaggagugccagguguccgagacugaaugucucuguccguacgaggcccugguccuccggaagccccuuuuccuggacucuaucgugaagggcaugaagaaccuccucaacuccaccagccuggagaccucccugagcaucgaggcccccuggggagccaucaacgugcaguccacguucaagcccaccguuaguaccgccaacaucgcccucagcuggagcuccguggagcaccgcggcaacaagauccugguaaccggccggagcgaguccaucaugaaacuggaggagcguacugggguuagcugggaccucggcguugaagacgccuccgagagcaagcugcugaccguguccaucauggaccucagccagauguacucgccugucuucgaguaucugagcggggaccggcagguugaggaguggcccaaggcaaccugcacgggcgacugccccgagcgcugcggguguacgagcuccacuugccugcacaaggaguggccccacagccggaacuggcgcugcaacccgaccuggugcuggggcgugggcaccgggugcacgugcugcggcgucgacgugaaggaccucuucacggaccacauguucaucaaauggaagguugaguacaucaagaccgaggccaucgucugcguggaacugaccucccaggagcggcagugcagccugauugaggccgggacccgcuucaaccuaggccccgugacgaucacccuguccgagccccggaacauccagcagaagcugcccccggagaucaucacccuccaccccaagauagaggagggcuucuucgaccugaugcacguacagaagguccugagcgccuccaccgugugcaagcuccagagcugcacgcacgggauccccggcgaccugcagauauaccacaucgggaaccugcucaagggcgaccggcugaacgggcaccugauccacaagaucgagccccacuucaacaccuccuggaugagcugggacgggugcgaccucgacuacuacugcaacaugggugacuggccgucgugcaccuacacaggggucacgcagcacaaccacgccgccuucgugaacuuacugaacaucgagacagacuacaccaagaccuuccacuuccacagcaagcgggucacggcccacggcgacacgccccagcucgaccugaaagcccgccccaccuacggggccggcgagauaacggugcugguggaggucgccgacauggagcugcacacgaagaagguggagaucuccgggcugaaguucgccagccuggccugcaccggcugcuacgcgugcuccagcggcaucuccugcaaggugcggauccaugucgacgagcccgacgagcucaccguccacgucaagagcagugacccggaugugguggccgccagcaccagccugauggcccgcaaacuugaguucgggacggacuccaccuucaaggcuuucagcgcgaugcccaagacguccuugugcuuuuacaucgucgagcgggaguacugcaagagcuguuccgaggacgauaccaagaaaugcgucgacaccaagcuggaccaaccccagagcauccugaucgagcacaagggcaccaucauagggaagcagaacgauaccugcaccgccaaagccuccugcuggcucgagagcgugaaguccuuuuucuacggccugaagaacaugcuggggagcguguucggcaacuucuucgucggcauccuccuguuucuggcccccuuugugcugcucgugcuguucuuuaugugcggguggaaguuccuguucugcuucaagugcugccgccggacgcgcggccucuuuaaguaccggcaucugaaggacgacgaggagaccggguaccgcagaaucaucgagcggcugaacuccaagaagggcaagaaccgccuccucgacggcgaacgucuggcagaccgcaagaucgcggaacucuucagcaccaagucccacaucggguga

SEQ ID NO: 15269 - RNA, 5067 nt, Artificial Sequence
  derived and/or modified CDS sequence (opt11) from CCHFV(24-R-2012)__KR814856.1__GP
augccgaccaacaucaugcacacccugcucgugugcuucauccuguaccuucagcuucucggccucggaggcgcccaucgccagagcaacgccacggagcacaacggcaccaacaccaccacggcuccguccaccagccagucccccaagccgcccguaaguaccgccccgccccacgcccccgaguccagcaccaucaagcccacgacccccgccuccgaaaccgagggcagcggggagacaacgcccccgcccaacaccacccagggccccucuccgcccgaggccacccccgagcggacagcgaccaccgccaccagcacgcccuccaccgacaacaccaacagcaccacgcaugccacggacaacaaccccaccuccaccaucagcacgucccccaguuccagccccuccaccccgagcacgccccagggcauccaccaccccgcccgcaaccugcuguccguguccagccccaagaccgcuaccaccccgacccccaccucccccggggacaucagcuccgagacgagcucccugcauagcgccaugaguagaacccccacacuccacaccgccacccaggccagcacggagaacgccaaccacuccgcgccgcgccagagcgaguccagcgcccagcaaaccaccaccucccccaugacgucgcccgcccaaccgauccuggugauguccgccgcccccaccgcgauccagaacauccacccuagccccaccaaccggucuaagcgcaaccuggagauggagauuauccucacccugagccagggccugaagaaguacuacgggaagauccucaagcugcuccaccucacgcuggaggaggacaccgagggccugcucgaguggugcaagcggaaccugggcagcaacugugaugacgacuucuuccagaagaggaucgaggaguucuucaugaccggcgagggcuacuucaacgagguccuacaguucaagacgcucaguacgcugucaccgaccgagcccucccacgcccggccgcccaccguggagccguucaagagcuacuuugccaaggguuuccugucaaucgacagcggcuacuucuccgcgaagugcuacccccgccucucuaccuccgggcugcagcugaucaacgugacgcagcaccccgcccggauagcggagacccccgguccgaagaccaccucgcucaagacgaucaacugcaucaaccugcgcgcaagcgucuucaaggaacaccgggagaucgagauaaacgugcugcucccccagauagccgugaaccugagcaacugccacgucgugaucaacucccacgugugcgacuacagcuuggacaccgacggccccguucgccucccccacaucuaccacgaggggaccuucaucccgggcaccuacaaaaucgugaucgacaagaagaacaagcugaacgaccggugcacgcuggugaccaacugugucaucaaggggcgcgaggugcggaagggccagagugugcuccgccaguacaagaccgagaucaagauugggaaggccagcacgggcucccggaaacugcugagcgaggagcccggcgacgacugcaucagccgcacacaguuacugagaaccgagaccgccgagauccacgacgacaacuacgggggccccggggacaagaucaccauuugcaacggcuccacgaucgucgaccagcgcuuggggucugagcucggcugcuauaccaucaaccgggucaaguccuucaagcugugcgagaacagcgcgaccggcaagaccugcgagaucgacuccacacccgugaagugccggcagggguucugccuaaagaucacccaggagggcagggggcacgucaagcucagcagaggcuccgagguggugcuggacgccugcgacaccaguugugaggucaugaucccgaaggggaccggcgacauccugguggacugcagcggcgggcagcaacauuuccugaaggacaaccucaucgaccugggcugcccccacaucccccugcucgggaagauggccaucuacaucugccgcaugagcaaccacccccggaccacgauggccuuucuuuucugguucuccuucggcuacgucaucacgugcaucuucugcaaagcgcuguucuauagccuaaucaucaucggcacccuggggaaaaagaucaagcaguaccgcgagcugaagccgcagaccugcaccaucugcgagaccgcccccguaaacgccaucgacgccgagaugcacgaucucaacugcuccuacaacaucugccccuacugugccagccggcucaccuccgacggucuggcgcgacacgugccgcagugccccaagcggaaggagaagguggaagagaccgaguuguacuuaaaccuggagcgcauucccuggauagugcggaagcuccuccaggugagcgagucaacagggguugcccugaagcggagcuccuggcugaucgugcugcugguccuccugaccgucagccuaagccccguccaguccgccccggugggccaugguaagaccaucgagaccuaccagacgcgggagggcuucaccagcgucugccucuucauguugggcuccauccuguuccucgugagcugccuggugaaggggcuggucgacuccgugagcgauuccuucuucccgggccucagcgucugcaagaccugcuccaucgggagcaucaacggcuucgagaucgagucccacaagugcuacugcagccuguucugcugccccuacugccgccauugcuccgccgaucgggagauccaccagcugcaucucuccaucugcaagaagcgcaagauggguuccaacgucaugcucgccgugugcaagcggaugugcuuccgcgcgaccauagaggccagccggcgggcccugcucauacgcucaaucaucaacacgaccuucguaaucugcauccugacccugaccaucugcgucgugagcacguccgccgucgagauggagaaccuucccagcggcaccugggagcgggaggaggaccugaccaacuucugccaccaggagugccaggucaccgagacggagugccuaugcccguacgaggcccucgugcugcgcaagccccuuuuccucgacagcaucgugaagggcaugaagaaccugcugaacuccaccucgcucgagaccucccugagcaucgaggcgcccuggggcgccaucaacguccaguccaccuucaagcccacggugagcaccgccaauaucgcccuguccuggagcuccguggagcaccgggggaacaagauccucgucaccgggcgcagcgaguccaucaugaagcuggaggagcggaccggcgugagcugggaccuggguguggaggaugcguccgaauccaagcuccugacggucuccaucauggaccugagccagauguacucccccguguucgaguacuuaagcggcgaccgccagguggaggaauggcccaaggcgacaugcacgggcgacugucccgagcgcugcgggugcaccuccuccacgugccugcacaaggaauggccccacucucgcaauuggcggugcaauccgacguggugcuggggaguugggacgggcuguacgugcuguggggucgacgugaaggaccuguucaccgaccacauguucgucaaguggaagguggaguacaucaagaccgaggccaucgugugcgucgagcucaccagccaggagcgccaaugcagccugaucgaggccggcaccagguucaaccugggccccgugacgaucacgcucuccgaaccccgcaacauccagcagaagcugcccccugagaucaucacccugcaccccaagguggaggagggguucuucgaccucaugcauguccagaaggugcugagcgccuccaccgugugcaagcugcagagcugcacccacgggauccccggggaccuacaggucuaccacaucggcaaccugcugaaaggugaucgggugaacgggcaccucauccacaagaucgagccccauuucaacacguccuggaugucuugggacggcugugaccuggacuacuacugcaacaugggggacuggccguccugcaccuacaccggcgucacccagcacaaccacgccgccuucgucaaccugcucaauaucgagacggacuacaccaagaccuuccacuuccauagcaagcgcgugaccgcccacggugacacgccccagcuggaucugaaggcccggcccaccuacggcgccggcgagaucaccguccucguggagguggcggacauggagcugcacaccaagaaggucgagaucuccgggcugaaguucgccagccucgccugcaccggcugcuacgccugcuccagcgggaucuccugcaaggugcgcauccacguggacgagcccgacgagcugaccguccacgucaagagcaacgacccggacgugguggccgcauccaccucacugauggcccggaaauuggaguucggcaccgacuccacguuuaaggccuucuccgccaugcccaagaccagccugugcuucuacaucguggagcgcgaguacugcaaguccugcagcgaggaggacacccagaagugcguggacacaaaacuugagcagccccaguccauccucaucgagcacaaggggacgaucaucggcaagcagaacgacacgugcaccgcgaaggccagcugcugguuggaguccgucaagagcuucuucuacggcuugaagaacaugcucggguccguguucggcaacuucuucaucgggauccugcuguuccucgccccguucgugcugcuggucuuguucuucauguucggcuggaagaucuuauucugcuucaagugcugccggcgcacgcgggggcugcugaaguaccgccuccucaaggacgacgaggagaccggcuaccgccggaucaucgagcgccugaacaauaagaagggcaagaaccgucuccuggacggggaacgccuggccgaccggaagaucgccgagcuguuuagcaccaagacccauaucggcuga

SEQ ID NO: 15270 - RNA, 5064 nt, Artificial Sequence
  derived and/or modified CDS sequence (opt11) from CCHFV(Oman-199809166)__KR864901.1__GP
augccagugaacaccaugcacacccuacucgucuacgccguguucugccugcagcuauggagcccgggcgggacgcgcgggcucuccaacgagacacagcacaacgagaccgggaucaccagggcccccgaaggcucacaggggcccucgcugcccgugagcacugcgagcccgaucaugucggaccccuccaucaccacucugagcgccuccaccagcggccuggagggaaguggggacacgaccccgcccgccaucacucagggccccacccugcccgagaccacccccgagcccagcaccaccacggguacgaacgccuucucgaccgccaucgcgaacgucagcacacagacgguuaaggacacaccgacccccaccgugcagacguccccgcccagcacccccgacgccuccaccaucccgcaaggcacccaccacacggcacgcggcuugcucucugucaccgugaccaagcccgaggaggugcccacaccaacgggcccugaacaggccuccaucgaaaccaacucuagccgacuugcgaccagcaagacccccagccccuccccgacggcccagguaacuacggagaauagcaaccccaacaccucgaggcagcuggugcucucaacccagcccgccacuagcagccccgugaccuccccggcccagcugaacuucguacagagcgccaccaccaucgccgugcaagacgcccaccccagucccacgaaccgaucuaagcgcaaccuggagauggaggugauccucacccugucccagggccugcggaaguacuaugggcgcauccucaagcugcuggaccucacccuggaggaggacaccgaaggccugcucgaauggugcaaacggaaccuggggcugacaugcgacgacaacuucuuccagaaacgcaucgaggaguucuuucucaccggcgaagggcauuuuaacgagguccugcaguucaagaccccgagcacauugucccccacggagagcgcaucugugggucuccccacuguggaacccuucaagagcuacuuugccaagggcuuucuguccaucgauagcgguuacuuuagcgccaagugcuacccccgggcguccaacagcggccugcaguuaaucaacgucacccagcacucagcccgcauagccgacacucccgggcccaagaucacgaaucuaaagaccaucaacugcaucaaccugaaggcccucguguucaaggagcaccgggagaucgagauaaacgugcuacugccccagguagccgugaaccuaagcaacugccacgugcacaucaagucccacguaugugacuacagccuggacaucgacggcacugugcgccugccccggauccaccacgaggguaccuucauccccgggacguacaagaucgucaucgacaagaagaauaagcagaacgaccgcugcaaccucgugaccaacugcgugaucaagggccgggagguccgcaaggggcaauccguuuugcggcaguaccgaaccgagauucggauaggcaaagcaagcuccggaucccgccgccugcucuccgaggagagcggcgaggacugcaucucccggacucagcugcugcgcaccgagaccgccgagauccacggcgacaacuacgggggccccggggauaagaucaccaucugcaacggcagcaccauaguggaccagcggcucggguccgagcugggcugcuacacgauaaaucgcgucaaaaguuucaagcugugcgagaacuccgcuaccggcaagagcugcgagauagauaacacccccguuaagugcaagcagggguuuugucugaagaucacccaggagggccgggggcacgugaagcucagccgcgacuccgagguggugcuggacgccugugacucuuccugcgagaucaugaucccgaagggcacgggcgacauuuuaguagacuguucugggggccaacaacacuuccucaaggauaaccugaucgaccugggaugccccaacaucccccuccucggcaagauggcgauauacaucugccggauguccaaccaccccaaaaccaccauggcguuccuguucugguucagcuuuggcuaugucaucacgugcauucugugcaaggugaucuucuacuuacugauaguggucggaacccugggcaagaaguucaagcaguaucgcgagcuaaagccgcagaccugcaccaucugcgaaaccaccccgguuaacgccauugacgccgagaugcacgacuugaacugcucguauaacaucugccccuacugcgccagccggcucacguccgaugggcuugcgcgccacguaaugcagugccccaagcgaaaggagaagaucgaggagaccgagcuguaccucaaccuugaacgcauccccuggguggugcggaagcugcuccaggugagcgaguccaccggcgucgcacugaagcgcagcucuuggcugaucgugcuccuggugcuucucaccgucagucuguccccugugcaauccgcccccauagggcacggcaaaacgaucgagaccuaccaaacgagagagggguacaccuccaucugcuuauucgugcucggcucuauccuguucaucgugucccacuuaaugaagggcuuaguggauagcguagggaacagcuucuuucccggccuauccaucugcaagacgugcagcauuggguccaucaacggcuuugagaucgagagccacaagugcuacugcucccuguucugcuguccguacugccgccacugcagcgccgacaaggagauacacaagcuccaccuguccaucugcaagaagcgcaaggccgggagcaacgucaugcuggcugugugcaaacgcaugugcuuucgggccacaauggagguauccaacaaggcacugcuuauccgcagcgucaucaacacgacuuucgugguaugcauccugauccuagccgucugcguggugucgacgucggccgucgaaauggagucccugcccgcgggaaccugggagcgcgaggaggaccuuaccaacuucugccaccaggagugucaggugaccgaaacggagugccucugccccuaugaggcacuggugcuucggaagccccucuuccuggauagcaucgccaaagggaugaagaaccugcucaacuccaccagccuggagaccucccucagcaucgaggcccccuggggcgccauaaauguucaguccaccuucaagcccacgguguccaccgcgaacaucgcccucagcuggaguagcguggagcaccgcgggaauaagauccuggucuccgggcggagcgagaguaucaugaaguuggaggagcgcacaggcauuagcugggaccuggggguggaggacgccuccgaaagcaagcuacugaccguguccgucauggaccucagccagauguacucccccguguucgaguaucugagcggcgaccgucagguggaggaguggccgaaggcuacgugcacaggggacugccccgagcggugcggguguaccuccuccacgugccugcacaaggaguggccgcacagccggaacuggcgcuguaaccccacauggugcuggggaguagggacagggugcacgugcugcggcuuggacgugaaggaccuguucaccgacuacauguucgucaaguggaaaguugaguacauaaagaccgaggcgaucguuugcgucgaguuaacaucucaggagcggcaaugcucccucaucgaggcugguacacgauucaaccuggggccggugacgaucacgcuuucggagccccggaacauccagcaaaagcucccucccgagaucgugacucugcacccccgcaucgaggagggguucuucgaccugaugcacguccaaaagguguuaucagccagcaccgugugcaaauugcaguccugcacccauggcguccccggggaccuacagguguaccacauuggcaaccugcucaagggcgacaaagugaacgggcaccugauccauaaggucgagccccacuucaacaccuccuggauguccugggacggaugugaccucgacuacuauugcaauaugggggauuggcccuccugcacguacaccggcgugacccagcacaaccacgccgccuucgugaaucuguugaacaucgagaccgacuacacgaagaauuuccacuuccacagcaagcgcgucacagcgcacggggauaccccgcagcuugaccuuaaggccaggcccaauuacggcgccggggagaucacgguguuaguggaggucgccgacauggagcuccacacgaagaagaucgagaucuccgggcugaaguucgccagcuuaaccugcaccggcugcuacgcuugcaguagcgggaucuccugcaaggugcggauacauguggacgaaccagacgaacucaccguccauguaaagagcgaagauccagauaucguggccgccuccucaagccugauggcccggaagcuggaguucggcacggauagcaccuucaaggcguucucagcgaugccgaagaccagccugugcuuuuacaucguggagcgggaguacugcaagaguugcagcaaagaggacacccaaaagugcgugaacgccaagcuggagcgcccccaguccauccugaucgagcauaagggcacaaucaucggcaagcagaacgauaccugcaccgccaaggccagcugcuggcucgagagcguuaaguccuucuuuuacggccugaagaauaugcugagcgggaucuucggcaacgucuucaucgggaucuuccucuuccuggcucccuucauauuacugauacucuuuuucauguuuggauggcggauccuguucugcuucaagugcugccgccggaccaggggccuguuuaaguaccgccaccucaaagacgacgaggagaccggguaccgaaagauaaucgagcguuugaacaacaagaagggcaagaacaagcugcuugacggggagcgguuagccgaccgcaagaucgccgaacucuucagcacgaagacccacauaggcuga

SEQ ID NO: 15271 - RNA, 5064 nt, Artificial Sequence
  derived and/or modified CDS sequence (opt11) from CCHFV(Oman_812956)__KY362518.1__GP
augcccguaaacaccaugcauacucugcucgucuaugccguguucugccugcaacuguggagccccggcggaacccgcggccucuccaacgagacccagcacaacgagacugggaucacccgagcccccgagggcagccaggggcccucccugcccgugagcacggcguccccgaucaugucagaccccuccauuaccacccucagcgccucuaccagcggccucgagggcuccggggauacgaccccgcccgccaucacccagggaccgacccugcccgagacgacccccgagcccagcacaaccacggggacgaacgcauucuccaccgccaucgcgaacgucagcacucagacggugaaggacacuccgacccccaccgugcagacguccccgccaagcacccccgacgccuccaccauuccccagggcacccaccacacggcccgcgggcugcucagcgucaccgugaccaagcccgaggaggugcccaccccgacgggccccgaacaggcauccaucgagaccaacagcccccggcuggcuaccucaaagacccccuccccgagccccacggcccaagucacuaccgagaacuccaaccccaacacaagccgccagcuggugcucuccacccagcccgccacgagcucaccgguuaccagcccagcccagcugaacuucguccaguccgcgaccaccauugcggugcaggacgcccaccccagcccgacgaaucgguccaagcgcaaccuggagauggaggugauccucacucugagccaggggcugcggaaguacuacggccgcauccucaagcuguuggaccucaccuuagaggaggacaccgagggccugcucgaguggugcaaacggaaccuggggcugacgugcgacgacaacuuuuuccagaagcgcaucgaggaguucuuccucaccggcgaaggccauuucaaugaggucuuacaauucaaaacgcccuccacccuaagcccgacggaauccgcgagcgucggguuaccuaccguggaaccguucaaguccuacuucgccaagggcuuccuuagcaucgacuccggguacuucagcgccaaguguuacccccgcgcgagcaauuccggccugcaguuaauaaacguuacccagcacucagcccgcauugccgacacgcccgggcccaagaucacgaacuuaaagaccaucaacugcaucaaccugaaggccuuaguguucaaggagcaccgggagaucgagaucaacgugcuccuuccgcaagucgccguaaaccucuccaacugccacguacauaucaagagccacgucugcgacuacucccuggacaucgacggcacugugagacugccccggauucaccacgagggcaccuucauccccgggaccuacaaaaucgucaucgauaagaagaacaagcagaacgaccgcuguaaccucgugaccaacugcgugaucaagggccgggagguccgcaaaggucagagcgugcuucggcaguaucgcaccgagauccggaucggcaaggcguccagcgggucccgccgccugcucagcgaggagucaggcgaggacugcauaagcaggacacagcuccugcgcacggagaccgccgagauccacggcgacaauuacgggggcccuggggacaagaucaccauaugcaacgguagcaccaucguggaccagagauuagguucugagcugggcugcuauacuauaaaccgcguuaagucguucaagcugugcgagaacucagccaccgggaaguccugcgagaucgacaacaccccagugaagugcaagcaaggguucugucugaagaucacccaggagggccgggggcacgugaagcucagccgcgacagcgaggucguauuagacgccugcgacaguagcugcgagaucaugauccccaagggcacgggcgauauccugguggacuguuccgguggccaacagcacuuucucaaggacaaccugaucgaccuggggugccccaacaucccccuccugggcaagauggcgaucuacaucugccgaaugagcaaccacccgaagaccaccauggcauuucuguucugguucucguucggguacgucauaacgugcauccuaugcaaggugaucuucuaccugcugaucguggucggcacgcucggcaagaaguucaagcaguaccgcgagcucaagccccagaccugcaccaucugcgagaccacucccgugaacgccaucgacgcggagaugcacgaccugaacugcucauacaacauaugccccuacugcgccucccggcucacgagcgacgggcuggcgcgccacgugaugcagugcccgaagcgaaaggagaagaucgaggagaccgagcuguaucucaaccuggagcgcaucccaugggucgugcggaagcugcuccagguguccgaaagcaccggcgucgcccugaagcgcuccagcuggcucaucgugcuccuagugcugcucaccgucucccugucacccguacaaucugcccccaucgggcacggcaagacgaucgagaccuaccagacccgggagggguacaccagcaucugccuuuucgugcucggcuccauccuguucaucguaagccaccuaaugaagggccucguagacuccguggguaacagcuuuuucccgggccugagcaucugcaagacgugcuccauagggagcauaaacggcuucgagaucgagucccacaagugcuauugcagccuguucugcugccccuacugucgccacugcuccgccgacaaagagauccauaagcuccaccugagcaucugcaagaaacggaaagccggguccaacgucaugcuggcggugugcaagcgcaugugcuuucgggccaccauggaggugagcaacaaggcgcuacugauccgcuccgucaucaacacaaccuuugugguaugcaucuugauccucgccgucugcguggugagcacguccgccgucgagauggagagccugcccgcgggcaccugggagcgagaggaggaccuuaccaacuucugccaccaggagugucaggugaccgagacggagugccucugcccguacgaggcccuggugcugcggaaaccccucuucuucgauuccauagccaaaggcaugaagaaccugcugaacagcaccucccuagagaccagccuguccaucgaagcccccuggggcgccauaaacguccagagcaccuuuaagcccacgguguccacugcgaauaucgcacugagcuggagcucaguggagcaccgugggaauaagauccucgucagcggccgguccgagagcaucaugaagcuggaggagcgcaccggcaucucaugggaucugggcguggaggacgccagcgaguccaagcuccugaccgugagcgucauggaccucucacagauguauagcccgguguucgaguaccucuccggcgaccgacagguggaggaguggccuaaagccacgugcaccggcgauugccccgagcggugugggugcacgagcuccacgugcuuacacaaggaauggccccacagccgaaacuggcgcugcaacccgaccuggugcuggggcgucgggaccgggugcacgugcugcggguuggacgugaaggaccucuucaccgacuacauguucgucaaauggaagguggaguauaucaagaccgaggcgaucgucugugucgagcugaccucccaggagcggcagugcucacugaucgaggccgggacccgguucaaccugggccccgugaccaucacgcugucggaaccccggaacauacaacagaagcugcccccagagaucguaacccuccacccccgcauugaggagggauuuuucgaccuuaugcacguccaaaaggucuuaagcgccucgaccgugugcaaacuucagagcugcacccacggcgugcccggggaccuccagguguaccacaucgggaaccuucugaagggcgacaaggugaacgggcaccugauucacaaggucgagccccacuucaacaccagcuggauguccugggacggcugcgaccuggauuauuacugcaacaugggcgauuggccaagcugcacguauaccggugugacccagcacaaccacgcagccuucgugaaccuccugaacauugagaccgacuacacgaagaacuuccacuuccacuccaagcgggucaccgcgcauggggacacgccccagcuggauuugaaagcccgacccaacuacggcgccggcgagaucacuguguugguagagguagccgauauggaguugcacaccaagaaaaucgaaaucagcgggcucaaguucgccucccugaccugcacuggcugcuacgccugcucgucggggaucagcuguaaggugcggauccacguggacgagcccgacgagcugaccgugcacgugaaauccgaggaccccgacaucguggccgccagcuccagccucauggcccgcaagcuggaguuuggcacggauucaaccuuuaaggccuucucggcgaugcccaagaccucccugugcuucuacaucgucgagcgggaauacugcaagagcuguucgaaggaggauacccagaagugcgugaacgccaagcucgaacgcccccagagcaucuugaucgagcacaaaggaacgaucaucgggaagcagaacgacacuugcaccgccaaggccuccugcuggcuggagagcgucaagagcuucuucuacggccucaagaacaugcuguccgguaucuuuggcaacguguucaucgggaucuuucuguucuuggcgcccuuuauccuccuuauacuuuucuucauguucggcuggcggauccucuucugcuuuaagugcugcagaagaacccgcggccucuucaaguaccgccaccugaaggacgaugaggagaccggguaucggaagaucaucgagcgccucaacaacaagaagggcaagaacaagcugcuagacggggagcgucucgccgaccgcaagaucgccgagcuguucagcaccaagacccacaucggcuga

SEQ ID NO: 15272 - RNA, 5064 nt, Artificial Sequence
  derived and/or modified CDS sequence (opt11) from CCHFV(Oman)__DQ211632.1__GP
augcccgugaacacgaugcacacacuccuggucuacgccgucuucugccugcagcuguggagcccgggcgggacucgcgggcucucaaacgagacccaacacaacgagaccgggaucaccagggccccugagggcagccaggggcccucccuccccgugaguacugcguccccgaucaugagcgacccaaguauaacaacccccagcgccuccaccucuggcuuagaggguuccggggacacgacgcccccggccauaacccagggccccaccccgccugagaccacccccgagcccagcaccaccaccgggaccaacgccuucuccaccgccauugcgaacgucagcacccagacggugaaggacacccccacucccacagugcagacguccccgccgaguacccccgacgcauccaccauaccccagggcacccaccacacggcccgcggucuccugagcgucaccguuaccaagccggaggaggugcccacacccacgggcccggagcaggccuccauagagaccaacucuccucgccuugccaccagcaagaccccuucccccagcccgacggcacaggucacaaccgagaacuccaacccuaacaccagccgccagcucgugcuguccacccagccugccacgagcucccccguaaccuccccggcccaacugaucuucguccagagugccacaaccguggcggugcaagacgcccaccccagccccacgaaccggucaaagcgcaaccucgagauggaggucauccugacccuaagccagggccuccgcaaguacuacgggcguauccugaagcuacuagaccugacccuggaagaagacaccgagggucuccuggaguggugcaagcggaaccuggggcucacgugcgacgacaacuucuuccagaagcgcaucgaggaguuuuuccugaccggcgagggccacuucaacgaggugcugcaguuuaagaccccguccacucucucaucuacugagagcgcuucgguggggcugccgaccgucgagcccuuuaagucguacuucgcuaaaggcuuccuguccaucgacagcggguacuuuagcgcuaaguguuacccccgggcgagcaacagcggccuccagcugaucaacgugacccagcacuccgcccgcaucgccgacacuccugguccgaagaucacgaaccugaagaccauaaacugcaucaacuuaaaagcccugguguucaaggagcaccgggaaaucgagaucaacguccugcucccccagguggccgugaaccugagcaacugccauguccacaucaagucccacgugugcgacuacagccuggacaucgauggcaccguccgccuccccaggauccaccacgagggcaccuucauccccgggacguacaagaucgugaucgacaaaaagaacaagcagaacgaccgaugcaaucuggugacgaacugcgucaucaagggccgggaggugcgcaaaggccaguccguccugcggcaguacagaacagagauccggaucggcaaggcgagcucagggagccgucgucucuugucagaggagaguggcgaggacugcaucucacggacccagcugcuccgcacggagaccgccgagauccacggcgacaacuacgggggcccuggggacaagaucaccaucugcaacggcucgaccaucguugaccagagguuaggguccgagcugggcugcuacaccauaaaccgcgucaagagcuuuaaacucugcgagaacagcgccaccggcaagagcugcgagaucgacaacacccccgugaagugcaagcagggguucugccugaagaucacucaggaaggccgggggcacgugaaguuaagccgagacagugaggucgugcuggacgccugugacagcuccugcgagaucaugaucccuaagggaacgggcgacauccucgucgacugcagcggcggccaacagcacuuccugaaagacaaccugaucgaccucgggugccccaacaucccgcuucugggcaagauggcuaucuacaucugccggauguccaaccaucccaagaccaccauggcguuccucuucugguucagcuucggguacgugauaaccugcauccugugcaaggugaucuucuaccuguuaaucgucgugggcacauuaggcaagaaguucaaacaguaccgcgaguugaaaccccagacaugcaccaucugcgagaccacccccgugaacgccaucgacgcugagaugcacgaccugaacugcuccuacaacaucuguccguacugcgccagccgacugacguccgaugggcuggcgcgccaugucaugcagugcccuaagcggaaggagaaaaucgaggagaccgaacuuuaccugaaccuggagcgcauccccuggguggugcggaaacuccuacaggucagcgaguccaccggcguggcccugaagcgcagcuccuggcuaaucgugcugcucguccuccuuaccgugagccuguccccaguucagagcgccccgaucgggcacggcaagacgaucgagaccuaccagacccgggaaggauacaccuccaucugccucuuuguccugggcucgauccuguuuaucgugucccaccucaugaagggccugguggacagcgucgggaacaguuucuuccccggucuuagcaucugcaagaccugcagcaucggguccaucaauggcuucgaaaucgagagccacaaaugcuucugcucccucuucuguugccccuacugccgccacugcagcgccgauaaggagauccacaaguugcaccuguccaucugcaagaagcggaaggccggaagcaacgugaugcucgccgugugcaagcgcaugugcuuccgagccaccauggaggucuccaacaaggcccugcugauccguagcgugaucaacaccaccuucguggucugcauccugauccuggccgugugcguggucuccacaagcgccguggagauggagucccugccggccggcacgugggagcgcgaggaggaccucaccaauuucugccaccaggagugccaggugaccgagacggagugccugugcccuuacgaggcccugguccucaggaagccauuauuccuggacagcaucgccaagggcaugaagaaccuccugaacuccaccagccuggaaaccucccucagcaucgaggcucccuggggcgccaucaacgugcaguccaccuucaagccgacggugagcaccgcgaacauagcccugagcugguccagcgucgagcaccgcgggaacaagauccugguguccgggcggagcgaguccaucaugaaacucgaggagaggaccggcaucagcugggaccuggggguggaggacgccuccgagagcaagcugcucaccguuucggugauggacuugagccagauguacucccccguguucgaguaccugagcggcgaucggcaagucgaggaguggcccaaggccacgugcaccggagacugccccgagcgcugcgggugcacauccuccacgugccuccauaaggaguggccgcacucccggaacuggcgcugcaaucccaccuggugcuggggcguggguacaggcugcacuugcugcggccuggacgucaaggaccuguucaccgacuacauguucgugaaguggaagguggaguauaucaagaccgaggcgaucgugugcguggagcucaccagccaggagcggcagugcucccugaucgaggcugguacccgcuucaaccugggccccgugaccaucacgcucagcgaaccccggaacauccaacagaagcugccucccgaaaucgucaccuuacacccccgcaucgaagagggauucuucgaccuaaugcacguccagaaggugcugagugccagcaccgucugcaaguuacagagcugcacccacggcguucccggcgaccuccagguguaccacaucggcaaccuguugaagggcgacaagguaaacggacaccugauccacaaaguggagccgcacuucaacaccuccuggaugucuugggacggcugcgaucuggacuacuacugcaacaugggugacuggcccuccugcacguacaccggcgugacccagcacaaccaugccgcguucguaaaccuguuaaacaucgaaacugacuacacgaagaacuuccacuuccacagcaaacgugugaccgcgcacggggacacgccccagcuggaucugaaggcccgccccaacuacggcgccggcgaggugaccguccucguggagguggcggacauggagcugcauaccaagaagaucgagauuuccggacugaaguucgccagccugaccugcaccggcugcuaugcuugcuccagcgggauuuccugcaagguccggauccacguggacgagccggacgagcucaccgugcaugucaagagcgaggaucccgacaucguggccgccuccagcucucugauggcccgcaagcucgaguucggcacggacagcaccuucaaggccuucuccgcgaugcccaagacgagccugugcuucuacaucguggagcgggaguacugcaaguccuguagcaaggaggacacgcagaagugcgucaacgccaagcucgagcgcccacaguccaucuugauugagcauaaagggacgaucauugggaaacaaaacgacacgugcaccgcuaaggccagcugcuggcuggagagcgucaaguccuucuucuacggccugaagaacaugcucagcgggaucuucggcaacguauucaucgggaucuuccuguuccuggcgccguuuauccugcucauccuguucuucauguucggcuggcggauccuguucugcuucaagugcugccgcaggacccguggccucuucaaguaccgccaccugaaggacgaugaggagaccggguaccggaagauaaucgagcgccugaacaacaaaaagggcaagaacaagcuccuggauggggagcggcuggccgaccgcaagaucgccgagcuguucuccaccaagacucacaucggcuga

SEQ ID NO: 15273 - RNA, 5064 nt, Artificial Sequence
  derived and/or modified CDS sequence (opt11) from CCHFV(3820-ST-2007)__KR814868.1__GP
augcccauaaacaucaugcacacccugcucgugugcuucauccucuaccugcagcucagcggccugggaggcgcccacgggcaguccaacgccacggagcacaacggcacgaacaccaccaccgucccggggacgagccaguccccaaagccgcccgcgagcaccacccugccccacacccccgaguccagcacggugaagcucaccacccccacuuccgagacggaaggcagcggcgagacaacgcccccgaacaccacccagggccugccccugcccggcaccacacccgagcgcuccgccaccacggccacgagcacauccagcaccgacaacaugaacuccacgacccagguuaccgacaacaccccaacgucaaccgugucaaucagccccuccagcuccagcagcaugcccucuaccagccaggggauccaccaccccgugcggucccugcugagcguguccucaccgaagaccgucacgacccccacccccaugucccccggcgagaugagcccggagacauccagccagcacuccgccaugagccgcgugcccacgcuguacaccgccacccagaucuccacggagaacaccgaccgguccacgccccgccaguccgagagcuccgugcagcccgcgacccagagcccgaucacguccccugcccaaaccauccuccugaugagcgccgcccccaaagcgauccaggacaugcaccccucgccgacuaaccgguccaagcgcaaccuggaggucgagaucauccucacccugagccaggggcugaagaaguacuacggaaagauccucaagcugcugcaccucacgcuggaggaggacaccgagggacugcucgaguggugcaaacggaaucugggguccaacugugacgacgacuucuuucagaagcgcaucgaggaguucuucaucacgggugaggguuacuucaacgaggugcugcaguuuaagacccuuagcacccugucucccaccgagcccagccaugugcggcugccgaccgccgaacccuucaaguccuacuuugccaaaggcuuccucagcaucgacuccgguuacuuuagcgccaagugcuacccccgcuccagcaccuccgggcugcagcuaaucaacgucacccagcacccugcccggaucgcggagaccccaggccccaagacgaccagccucaagaccauuaacugcaucaaccugcgcgcauccguguucaaggagcaccgggagguggagaucaacguccugcucccccagaucgcugugaaucugagcaacugccacguggucaucaacucccacgugugcgacuacagccuggacaccgacgggcccgugcgccuuccgcggauccaccacgagggcacguuuauccccgggaccuacaagaucgucaucgaccgcaagaacaagcugaacgaccggugcagccucgugaccaacugugugaucaaaggccgggaaguccggaagggccaguccguccuccgccaguacaagacugagaucaagaucgggaagacgagcaccggcucccggaagcugcuguccgaggagccaggggacgacugcauaucccgcacccagcuccugaagaccgagacggccgagauccacgacgacaacuacggcagccccggugacaagaucaccaucugcaauggcuccaccaucgucgaccagcgccugggcagcgaacucggguguuacaccaucaaccgggugaaguccuucaagcugugcgagaauagugccacgggcaagaccugcgagaucgacuccacccccgugaagugucgccaaggguucugcuugaaaauaacccaggaaggucgggggcacgucaagcugagccggggcagcgagguggugcucgacgcgugugacagcuccugcgagaucaugauccccaagggcacgggggacauccuggucgacugcagcggcggacagcagcacuuccugaaggacaaccucaucgaccugggcuguccccacaucccccugcucgguaagauggccaucuacaucugccggaugaguaaccacccgcgcacaacgauggccuuccuguucugguucaguuucggguacgugauaaccugcaucuucugcaaggcccuguucuacucccucaucaucaucggcacccuggggaagaagaucaagcaguaccgggaacugaagccccagacguguaccaucugcgagaccgcccccguaaacgcgaucgacgccgagaugcacgaccucaacugcagcuacaacaucugccccuacugcgccagccgccuaaccuccgauggacuggcccggcacgucacgcagugcccgaagcgcaaggagaagguggaggagacugaguuauaccugaaccucgagcggauccccuggaucgugcgcaagcugcugcaggucagcgaguccaccggggucgcccugaagcggucuuccuggcucaucguacugcugguccuccuggcggugagccugucccccguccagagcgcacccgucggccacgggaagaccaucgagacguaucagacccgcgagggguucaccuccaucugccucuucaugcugggcagcauccuguucaucguguccugccuugugaaggggcuggucgacagcguguccgacagcuucuucccgggucuguccgugugcaagaccugcagcaucggguccaucaacggcuucgagaucgagagccacaagugcuacugcucccucuucuguugccccuacugccggcacugcagcgccgaccgugagauccaccagcugcaccugagcaucugcaagaagcggaagacggguuccaacgucaugcuggccgugugcaagcgcaugugcuucaaggcgaccaucgaggccucccguagggcccugcugauccgcuccaucaucaacaccaccuucguaaugugcauccucacgcuugccaucugcgucgugucaaccuccgccguugagauggaggacuugcccgcggggacuugggagcgcgaggaggaccucaccaacuucugccaccaggagugccaggucacggagacagagugccugugcccguacgaggcccuggugcuccguaagccccuguuccuggacagcaucgugaagggcaugaagaaccuccugaacuccaccagccuggagaccucccucagcaucgaggcccccuggggcgccaucaacguccaguccacguucaagcccaccgugagcaccgccaacaucgcgcuguccuggagcuccgucgagcaccgggggaacaagauccuggucaccggacgcagcgaguccaucaugaagcucgaggagcggacgggcgugagcugggaccugggcguggaagacgccuccgagagcaagcugcucaccgucagcaucauggaccugucccagauguacagcccuguauucgaguaccuguccggggaccgccaaguggaggaauggcccaaggcaaccugcaccggagacugccccgagcguugcgggugcacgagcuccacgugccuccacaaggaguggccccacagccgcaacuggcggugcaacccgaccuggugcuggggcgucgggaccggcuguaccugcugcggcguggacgugaaggaccuguucacugaucacauguucaucaaguggaaggucgaguauaucaagaccgaggcuaucgugugcgucgagcugaccucccaggagcgccagugcagccucaucgaggcagggacccgguucaaccugggccccgucacgaucacccuauccgagccgcguaacauccagcaaaagcucccgcccgagaucaucacccugcaccccaagaucgaggagggguucuucgaccugaugcacgugcagaaggugcucagcgcuucaacugucugcaagcugcagagcugcacgcauggcauccccggcgaccugcaaaucuaccacaucgggaaucuccugaagggcgacagggugaacgggcacuugauccacaagaucgagccucacuucaacaccuccuggaugagcugggacggcugcgaccucgacuacuacugcaacaugggugacuggccguccugcaccuacaccggcgucacgcagcauaaccacgcagcuuucgugaaccugcugaacaucgagaccgacuacaccaagaccuuccauuuccacagcaagcgcgugacggcccauggcgacacgccccagcucgaucugaaggcgcggcccaccuacggggccggcgagaucaccguccugguggagguugcagacauggaacuccacaccaaaaaggucgagauuuccgggcugaaguucgccagccugacuugcaccgguugcuacgccugcuccagcgggaucagcugcaaggugcgcauccacguggacgagcccgacgagcucaccguccacgugaaguccagcgacccggacguggucgcggcuuccacgagccugauggcccggaaacuugaguucggcaccgacuccaccuuuaaggccuucagcgccaugcccaagaccucccucugcuucuacaucguggagcgcgaguacugcaagagcugcuccgaggacgacacgaagaagugcguggacaccaaguuggagcagccccagagcauccugaucgagcacaagggcaccauuaucgggaagcaaaacgauaccugcacggcgaaggccuccugcuggcucgagagcgucaaguccuucuucuacggccuuaaaaacaugcuggggagcguuuucggguccuucuucguggggauccuccuguuccuggcccccuucguccugcucgugcuguucuucauguucggcuggaagauccuguucugcuuuaaguguugccggcgcacccgaggucucuucaaguaccgccaccugaaggacgacgaggagaccggguaccgcagaaucaucgagcgccugaacagcaagaagggcaagaaccggcuccuggauggggagcgcuuggccgaccggaaaauagccgaguuauuuuccaccaaaacacacaucggcuga

SEQ ID NO: 15274 - RNA, 5058 nt, Artificial Sequence
  derived and/or modified CDS sequence (opt11) from CCHFV(SR3)__AJ538199.1__GP
augcauaucuccuuaauguaugcaguguucugccuccagcuuugcggacuggggaaaacgaacggcccccacaacgggaccgagcacaacaacacgcacgucaugaccaccccggacgauucccagagccccgagccgcccguguccacggccuuacccgugacgcccgaccccagcaccgucacccccuccaccccggcuagcggguuggagggguccggcgaaguguauacgagcuccccuaucaccacuaaaggccugagccuucccgaggccaccuccgagcccccggcgacgaccagcguagucacuuccagcgccuccgacaccgacagcuccacgcaggccgcgggggacacccccaccccuaccguucgcaccucgcugcccuccucgccgagcacccccuccaccagccagggcacccacuaccccgugagauccuugcucagcgucacguccccgaagccggaggagacccccacccccucaaaauccgggaaggacgacuuagccaccaacucaccccaccccgccacgucccgcccuaccacgccacccaccacggcccagaagcccaccgagaacaacucgcacaacaccaccgagcagcuggagucauugacgcaccuggcgacccugggccucaugaucagccccacccagaccgugcugccccaguccgugacgagcaucgccauccaggauauccacaauuccccgacgaaccggaguaagcgcaaccuggacauggagaucauccucacccugucccaggggcugaagaaauacuacggcaagaucuuaaaacugcugcaccucacccuagaggaggacaccgagggccugcucgagugguguaagcguaaucuggggcuggacugcgacgacacguucuuccaaaagcgcaucgaggaguuuuucaucaccggcgaggggcacuucaacgagguucuccaguuccggacgcugggcacccuuagcacgaccgaguccacacacgccggcagccccaccguggaacccuucaagagcuacuucgccaagggguuccucuccaucgacagcggcuauuucuccgccaagugcuacagccgcacgucaaauagcggacugcaacugaucaacgugacacgacacucaacaagaauugcugacacccccgguccgaaaauaacaaaccucaaaaccaucaacugcaugaaucugaaggccagcgucuuuaaggagcaccgcgagguugagauaaacguacugcuaccccaggucgccguuaaccuguccaacugccacguggccaucaagucccacaucugcgacuacucacuggauaccgacggggccauccggcucccccagauccaccacgagggcaccuucaucccaggcacuuauaaaaucgucaucgacaagaagucacgccugaacgaucgcugcacccuguucaccaacugcgugaucaaggggcgggaggugcgcaagggccaguccguccuccgucaguacaagaccgagauccgcaucgggcgggcgagcacgggaucccgccggcugcuaagcgaggagucaggagacgauugcaucagccgcacccagcucuugcgcacagagaccgcugagguucauggggacaacuacggcgggcccggcgacaagaucacgaucugcaaugggucgacggucgucgaccagcggcugggcucugagcuggggugcuacacuaucaaccgcgugcggucauucaagcucugcgaaaauuccgccaccgguaagagcugcgagaucgacuccauccccgucaagugcaagcagggcuacugccugaagaucacgcaagaggggcgcggccaugugaagcugucgcgcggauccgaggugguccucgacgugugcgacagcuccugcgaagugaugauucccaaaggcaccggcgacauccuagucgacuguagugggggccagcaacauuuccucaaagacaaccucguggaccuggggugccccaagauuccgcuccucggcaagauggccaucuacaucugcagaauguccaaccaccccaaaacuaccauggccuucuuauucugguucaguuucggauacgugaucacgugcauccugugcaaggcaauauucuuucuccugaucaucuuuggcacccuggguaagagguucaagcaguaccgcgagcucaagccgcaaaccugcacgaucugcgagaccacgcccgugaacgccaucgacgccgagaugcacgaccuuaauugcuccuacaacauuugcccuuacugcgcaagucggcuaaccagcgacgggcuggcccgccacgucacccagugcccccggcgcaaggagaaaguggaggaaaccgaguuauaccugaaccucgagcggauccccugggucguucgcaagcugcuccaggugagugaauccacugguaccguccugaagcggagcucguggcugauagugcuucucgugcuguucaccgucucccugagccccgugcaguccgccccgaucggacacggcaagaccauagagacguaccgcgugcgggaggaguacacgagcaucugccucuucguccugggguccauccuguucaucgugagcuuccucaugaagggccugguggacggcguagggaacauauucuuccccggacuguccgugugcaagacguguuccaucgggaguaucaacggcuucgagaucgaaagccacaagugcuacugcagccucuuuugcugccccuacugucgccacugcuccgccgacggagagauccaccagcuccaccuguccaucugcaagaagcggaagacuggcagcaaugugauguuggccgucugcaaacgcaugugcuuccgcgccacgauggagguguccaacaaggcgcuguucauccggagcauaaucaacaccaccuucguaaugugcauccugaagggcgaguucgccgccgugaaaucaauccaucccaucgagauggagagccucccggccgggaccugggagagggaggaggaucugacaaacuuuugccaccaagagugccaggugacugagaccgagugccugugucccuacgaagcccucguucugcggcgcccacuguuucuagacuccaucguuaaagguaugaagaaccugcugaacuccaccucccucgagaccucacugagcaucgaggcgccguggggugccauaaacgugcaguccacauacaagcccaccgugagcaccgccaacaucgcccugucuuggagcagcgucgaacaccgggggaacaaggugcucgugucagggcgcuccgaaagcauaaugaaacuggaggagagaacggggaucuccugggaccugggcgucgaggacgcaucagaguccaagcuccugacagugucugugauggaccuuucccagauguauagccccguauucgaguaccucuccggagaccgccagguggaggaguggccuaaggcgacaugcaccggagauugcccggaacggugcgggugcacgagcucaaccugucugcacaaggaguggccgcauagcaggaacuggcggugcaaccccaccugguguuggggcguagguaccgggugcacgugcugcggccuggacgucaaggaccuuuucaccgacuacauguucgucaaguggaagguggaguacaucaagaccgaggccauagucuguguagagcugaccagucaggaacgacagugcagccugaucgaggccgguacccgguucaaccucggcagcgucaccaucacccuguccgagccccgcaacauucagcagaagcuaccgcccgaaaucaucacacuccaccccaagaucgaggaggguuucuucgaccugaugcacguucagaagguccuaagcgcuuccacggucugcaaacuccaaaguugcacacacggcguacccggcgaucugcaaguauaucacaucgguaaccuguuaaagggcgaccgggucaacgggcaccugauucauaagaucgaacagcauuucaacaccuccuggaugagcugggacggcugcgaucuugacuacuacugcaacaugggggacuggccguccugcacguacaccggugugacucagcacaaccacgcuagcuucgugaaccuccugaacauagagaccgacuacacuaagacuuuccacuuccacuccaagcgcgucacugcgcauggcgacacgccccagcuggaccucaaggcccggcccacauacggagccggcgagaucaccguguugguggaggucgccgacauggagcugcacacgaagaagauugagaucagcggucucaaguucgcgggucugaccuguaccgggugcuacgcaugcagcagcggcaucuccugcaagguaaggauccacguggaugagcccgacgagcucacgguccacgugaagucagacgacccggacguggucgccgccuccagcucccucauggcccguaagcuggaguucggcacggacagcaccuuuaaggcguucuccgcaaugccuaagaccagccuuugcuucuacaucguugagcgcgaauacugcaagagcugcaacaaggaggauacccagaagugcgugaauacgaagcucgagcagccccaauccauccugaucgaacacaaggggacaaucaucggcaagcagaacaauaccugcaccgcaaaggccagcugcuggcuggaguccgucaagaguuucuucuacgggcucaaaaacaugcugggcggcaucuucgggaacguguucaucggcaucuucacauuccugacccccuucaucuugcucauacuuuucuucauguucggguggcggauccuguucugcuucaagugcugccgccgcacucggggccucuucaaguaccgccaucugaaggaugacgaagagaccggcuaccgaaagaucaucgagcgccugaacaacaagaaggggaagaaucggcuccuagacggcgagcgccuggccgaccggaaaaucgcggagcucuuuuccacgaagacccacauaggguga

SEQ ID NO: 15275 - RNA, 5055 nt, Artificial Sequence
  derived and/or modified CDS sequence (opt11) from CCHFV(SPU 187/90)__KJ682814.1__GP
augcauaucagccucauguacgcagugcuuugccugcaguuaugcucccucggugagacccaccgcucucacaacgagaucgggcacaacaagaccgacgucaugacgacgcccggcgauaaccuguccagcgagcagccgguguccaccgcacugagcaucacccccgaccccuccacgguaacuccaaccaccccggcgagcggguccgagggcucuggggaggucuacacgucaucacccauaaccaccgagucccucagccugcccgaaaccacgcccgagcugccggccaccaccggcaucgacaguucuucugccagcggcguugacuccagcacgcaggccgccgggggcacgagcgcgcucaccguacggaccucccugcccaacagcccguccacccccagcacaccgcaggacaccuaccaccccguccgcauccugcucuccgugaccgggcccggcccggaggagaccagcacgccguccgggagcggcaaggagucgagcgccaccuccagccugcaccccaucuccgaccggcuaccgacgcccccggcgaccgcccagggccccaccgagaacaacagccacaacgcgaccgagcaccccaaaccccucacccaguccgccacuccggggcugaugacuagccccacccagaucgugcacccccaguccgccaccagcaucaccguccaggacacguaccccuccccgaagaaccgcagcaagcggaaucuggagauggagaucauccucacccuaagccagggcuugaagaaguacuacgggaagauccuccgccugcugcgguugacccuggaggaggacaccgagggccugcucgaguggugcaagcgcaaccuuggccuggacugcgacgacaccuucuuccaaaagcggauugaggaguucuucaucacgggggagggccacuucaacgaggugcuccaauucaagaccccggggacccuguccaccacggagagcacccccgccgagcugccgaccgccgaacccuucaaguccuacuucgcgaagggcuuccuaagcaucgacuccggauacuacuccgccaagugcuacuccggcaccagcaacuccggccuacagcugaucaacauuacgagacacagcacccggaucguggacaccccugggcccaagaucaccaaccucaagacgaucaacuguaucaaccugaaggccuccaucuucaaagagcaucgcgaagucgagaucaacgugcugcuaccgcagaucgccgugaaccugagcaacugccaugucgugaucaagucccacgugugcgacuacagccuggacaucgauggcaccguccggcucccccacaucuaucacgaggggguauucauccccggcaccuacaagaucgugaucgacaagaagaacaagcugaacgaccgcugcacccuguucacgaacugcgucaucaaggggcgggaggugcguaagggccaauccguccuccggcaguacaagaccgaaauccgcaucggcaaggccuccaccgggucccgacgccugcuuagcgaggagcccagcgacgacugcaucucccggacccagcuauugcgcacggagaccgcggagauccacggcgacaacuacgggggcccgggggacaagaucaccaucugcaacggcagcaccaucgucgaccagcgccugggcuccgagcuggggugcuacacgauaaaccggguaaagagcuucaaacuaugcgagaacuccgccaccggcaagagcugcgagaucgacuccguucccgugaagugccgccaaggguacugccugcggaucacccaggagggccgcggccacgugaaguuaagccggggguccgaggucgugcucgacgccugcgacaccagcugcgagaucaugauccccaagggcacgggggauauccugguggacugcuccggcgggcagcaacacuuccugaaagacaaccucaucgaccugggcugccccaagaucccgcugcucggcaagauggccauauacaucugccgcaugagcaaucaccccaagaccaccauggccuuccuguucugguucuccuucggauaugucauuacgugcauccugugcaaggcgaucuuuuaucuccugaucaucaucggcaccuuagguaagcgguuuaagcaguaccgcgaacucaagccccaaaccugcaccauuugcgagaccacgcccgugaacgccaucgacgccgagaugcacgaccugaacugcagcuauaacaucugcccguacugcgccucccgacugaccagcgacggccucgcccgccaugugacccagugucccaagcggaaggagaagguggaggagaccgagcuguacuuaaaccucgagcgcauaccauggguggucaggaagcugcuucaggucuccgagagcacagggguggcccucaagcgcuccagcuggcugaucgugcugcuaguccuguucacggugagccugucccccgugcagagcgccccgaucgggcacgggaagaccaucgaggccuaccgcgcccgcgagggguauaccuccaucugccucuucguccugggcucuauccuguucguaguguccugccucaugaaggggcuggucgacucugugggcaacuccuucuucccagggcugagcaucugcaagaccugcuccauagguucuaucaacggcuucgagaucgagucccacaagugcuacugcucucucuucugcugccccuacugccggcacugcuccgcagacaaggagauccacaagcugcaccugagcauuugcaagaagcgcaagacaggguccaacgugaugcucgccguaugcaagcggaugugcuuccgcgccaccauggaggugagcaaccgagcccuguucauccguuccaucaucaacaccaccuucgugcugugcauccucaucuuagccgucugcguggugagcacuuccgcgguggagauggagaaccugcccgccggcacaugggagcgcgaggaggaucucaccaacuuuugccaucaggagugucaggugaccgagacggagugccuguguccguacgaggcccuggugcuccggcgcccccuguuccuggacagcaucguuaagggaaugaaaaaccuccugaacagcaccucccuggaaaccucgcucuccaucgaggcccccuggggcgccauaaacgugcagagcaccuacaagccgacgguuucgaccgcgaacaucgcccuaagcugguccagcgucgagcaccgggggaacaagauccugguguccggccgcagcgaguccaucaugaagcucgaggagcggaccggcaucagcugggaccuggggguggaggacgccuccgagagcaagcugcucaccgucuccgugauggaccugagccagauguacucccccguguucgaguaccugagcggcgaccgccaggucgaggaguggcccaaggccacgugcaccggggacugccccgagcgguguggcugcaccuccucaacgugccuccacaaggaguggccgcacagccgcaacuggcggugcaaccccaccuggugcuggggcguggggaccggcugcacgugcugcgggcuggacgugaaagaccuauucaccgacuacauguucgucaaguggaagguggaauacaucaagacagaggccaucgugugcgucgagcucaccucccaagagcgccagugcagccugaucgaggcgggcaccagguucaaccuggggcccgugaccaucacgcucuccgagccccgcaacauccagcagaagcugccgcccgagaucaucacccugcacccccggauagaggagggcuucuucgaccucaugcacgugcagaaaguccugagcgccagcaccgugugcaagcugcagagcuguacucacggcguccccggggaccuccaaguguaccacaucggcaaccugcugaaaggggacaaggugaacgggcaccucauccacaagaucgagccgcacuucaacacguccuggaugucuugggacgggugcgaccuggacuacuacugcaacaugggggacuggccgucauguaccuacaccggcguaacucagcacaaccacgccagcuucgugaaccugcucaacaucgagaccgacuacaccaagaacuuccacuuccacucuaagcgcgugaccgcccauggggacacgccccagcuggaccugaaggcgcggccaaccuacggcgccggggagaucaccguccucguggagguggccgacauggagcugcacaccaagaagaucgagaucagcggccugaaguucgccucucugacgugcacggggugcuacgccugcagcuccggcaucagcugcaagguccgcauccacguggacgagccggacgagcucacgguacacgucaagucagacgaccccgacgugguggcggccagcuccagccugauggcucguaagcucgaguucggcaccgacagcaucuucaaggcauucuccgcuaugcccaagacgagccugugcuucuacaucgucgaacgcgagcacugcaaguccugcagcgaggaggacacgaagaagugcgugaacacgaagcuggagcagccucaguccauccuaaucgagcacaaggggaccaucaucggcaagcagaauagcacgugcaccgcgaagaccuccugcuggcucgagagcgugaaguccuucuucuaugggcugaagaacaugcugagcggcaucuucgggaacguguucaucgggaucuuucucuuccuggcaccguucauccugcucauucuauucuucauguuuggcuggcggauccuguuuugcuucaagugcugccgccgcacccggggccucuucaaguaccgacaccugaaggaugaugaggagaccggguaccggcgcaucaucgagcggcugaacaacaagaaggggaagaacaagcuccuggacggggagcgccuggccgaccggcgcaucgcagagcuguucuccacuaagacgcacaucggcuga

SEQ ID NO: 15276 - RNA, 5055 nt, Artificial Sequence
  derived and/or modified CDS sequence (opt11) from CCHFV(SPU 48/90)__KJ682813.1__GP
augcauaucagccugauguacgcggugcugugucugcagcugugcgguuugggggaaacccaccgcucccacaacgagaccggacauaauaaaacugacgucgccaccacccccggggacaaccugucuuccgagcagcuagugagcaccgcgcuauccaucaccccggaccccagcaccgugacccccaccacguccgccagcggccuggagggguccggcgaggucuacaccagcucccugauaacgacggagagccucucccugcuggagacaacgcccaagcucccgaccaccacgggcaucgacacaagcucugccagcgacguggacuccaguacccaggccgccggggacaccuccgcgcugacgguacggaccagcccucccagcaaccccuccacccccagcacgccucaggacacccaccaccccaugcgcaaccugcuauccgucaccagccccggcccggaggagaccucuacucccagcggcuccggcaaggagagccccgccacgaguagcccccauccugugucgaacaggagccagaccccgcccgcaacggcccaggggcccaccgaggacaacucuuacaacgcgacggagcaccccgagcacuuaacccagagcgccaccuccggccugaugaccagccccacgcagaucgugcacccccaguccgccaccuccaucaccguccaggacacauaccccuccccaacgaaccgcagcaagcggaaccucgagauggagaucauccugacgcuuagccagggccucaaaaaguacuacgggaagauccugcgccugcuccggcugacgcuggaagaggacacggaaggcuuacuugaguggugcaagcgcaaccuggggcucgauugugacgacaccuucuuccagaaacggaucgaggaguucuucaucacgggcgagggccauuuuaacgagguuuuacaguucaagacaccagggacccuguccaccacggagagcacccccgccgagccuccgacagccgagcccuucaaguccuacuucgcgaagggguuccucagcaucgacuccggguacuacagcgccaagugcuacuccggcacuagcaacucagggcugcagcugaucaacaucacgcgacacucgaccaaaaucgccgacacccccggcccgaagaucaccaaccucaagacgaucaauugcauuaaucugaaggccuccaucuucaaggagcacagggagguagagaucaacguccugcuaccccagguggcggugaaccuaagcaacugccacgucgugauaaaaucccacgucugcgacuacccccuggauaucgacgggaccgucagacugccgcacaucuaccacgagggggucuucauuccgggcaccuacaagauugugaucgacaaaaagacuaagcugaaugaccggugcacgcuguucaccgacugcgucauuaagggccgcgaggugcggaaaggccagagcgugcuccgccaguacaagaccgagauucggaucgggaagaccagcacggggagccgacggcugcuguccgaggagcccagcgacgacugcaucagucgaacccagcuccugcgaaccgaaaccgcggagauccacggcgauaacuacggagggcccggggauaagaucacgauaugcaauggcuccaccaucguagaccaacgccuggggucggaacugggcuguuacaccauaaaccgagugaaaucguucaaacucugcgagaacucugccacugggaagucuugugucaucgacagcguccccgugaagugccggcagggauacugccugagaaucacgcaggagggccgggggcacguuaaacuuagccgcggcagcgagguaguccucgacgccugcgacaccuccugugagauuaugaucccgaagggcaccggcgauauccuggucgacugcucaggcggacaacagcacuuucucaaggacaaccucaucgaucugggcugcccgaagauuccccugcucggcaagauggcgaucuacaucuguaggaugucgaaccaccccaccacgaccauggccuuccucuucugguuuucauucggcuacguuaucacgugcauccuguguaaggccaucuuuuaccuccucaucaucauuggcaccuuaggaaagcgcuuccggcaguaucgcgagcucaagccgcaaaccuguaccauaugcgagaccacccccgugaacgccauagaugcggagaugcacgaccugaauugcucuuacaauauaugcccguacugcgcuagccggcugaccuccgauggccuagcccgccacgucacgcagugccccaaacggaaagagaagguggaggaaacggaacuguacuuaaaccucgagcgaaucccauggguggugcguaagcugcuccaggugagcgaguccaccgggguggcuuuaaagagaucuuccuggcucaucguccuccucgugcuguucaccgugagccucucgcccguccaauccgcucccaucggacacgggaagacgaucgaagccuaccgagcccgagagggcuauaccagcaucugccuuuuugugcugggguccauacuguucgugguaucuugccucaugaagcgguugguagacucuguggggaacucauucuuccccggccucuccaucugcaagaccugcagcauuuccagcaucaacggauuugagaucgagucccacaagugcuacugcagccuuuucugcugcccguacugccgccacugcuccgcggacaaggagauacauaagcugcaccugucgauuugcaagaagcggaagaccggguccaacgucaugcucgccguguguaagagaauguguuuccgcgccacgauggaagucagcgaccgggcccuguucauccgcuccaucaucaacaccaccuucguccugugcauccucauccuggccgugugcgugguaagcaccucagcgguggagauggagaaccugcccgcagggaccugggaacgugaggaggaccucaccaacuucugccaccaggagugccagguaaccgagaccgagugccugugccccuacgaggccuuaguccuccgcaagccccuguuccgggacagcaucgugaagggcaugaagaaccugcucaacagcacgucccuugagaccagccucuccaucgaggccccguggggcgccaucaacguucagucuacuuacaagcccaccgucuccacggcgaacaucgccuuaagcugguccagcguggaacaccgcgggaacaagauccuggugucaggccggagcgaguccaucaugaaacuggaggaacgcaccgggaucagcugggaccucggcguggaagacgcguccgagagcaagcugcugaccguguccguuauggaccucagccagauguauuccccaguguucgaauaccugagcggugaccgccagguggaagaguggccgaaggcgaccuguacgggcgacugccccgagcggugcggcuguaccucgaguacuugccugcacaaggaguggccccacucgaggaacuggcgcugcaacccuaccuggugcuggggcguagggacggggugcacaugcugcggccucgacgucaaggaucuguucaccgacuacauguucgugaaguggaaaguggaguacaucaagaccgaggccauuguuuguguugagcuaacuucccaagagagacaaugcucacucaucgaagccggcacccgcuuuaaccuggggccggugacgauuacgcucuccgagccccggaacauucagcagaagcucccacccgagaucaucacccugcacccccgcaucgaggagggcuucuuugaccugaugcacguccagaaggugcucagcgccuccacggucuguaagcugcagagcuguacccauggggugccgggcgaccuccagguguaccacauuggcaaccuucugaagggcgauaaggucaacggccaccucauccacaagaucgaaccccacuucaacaccucguggaugagcugggacgggugcgacuuggacuacuacugcaacaugggcgacuggcccuccuguaccuauacaggggugacgcagcacaauagggccucuuucgugaaccugcuaaacaucgagaccgacuacaccaagaacuuucacuuccacucgaagcgcgugacggcacauggcgacaccccgcagcucgacuuaaaggcacggccgaccuauggggccggcgagaucacagugcuaguggagguagccgacauggagcuccacaccaagaagaucgagaucagcggauuaaaguucgccucccugaccugcaccgggugcuacgcauguagcucaggcaucagcugcaaggugcgcauccacguggacgagcccgacgaauugacaguccacgucaagucagacgaccccgaugugguugcggccagcuccagccugauggcccgcaagcuggaguucgggacggacuccaccuucaaggccuucuccgccaugccgaaaaccagccucugcuucuauaucguggaaaaggaguacugcaaauccugcagcgaggaagauaccaagaagugugugaacacgaaacuggagcaaccccaguccauccugaucgaacacaagggcaccaucaucgggaagcagaacuccacgugcaccgcgaaggucucgugcuggcucgagagcgcuaagucauucuucuacgggcugaaggacaugcugagcggcaucuucgguaauguguucaucggcaucuuccuguuccucgcccccuucauccugcugauccucuucuucauguucggauggcgcauacugcucugcuucaagugcugucgccggacccgcggccuauucaaguaccggcaccugaaggacgacgaggagaccggguaccgccggaucauagagcgccugaauaauaagaaagggaagaacaagcuccuggacggcgagcggcuggccgaccgccgaaucgcggagcuguuuaguaccaagacgcacaucggauga

SEQ ID NO: 15277 - RNA, 5055 nt, Artificial Sequence
  derived and/or modified CDS sequence (opt11) from CCHFV(Sudan AB1-2009)__HQ378187.1__GP
augcacaucagccucaucuacgccauccucugccugcagcugugcggccucggggagacccacggcucccacaacgagacccgccacaacaagacggacaccaucaccacccccggggauaaccugagcuccgagccgagcguguccacggcucugagcaucacccccgaccccuccaccgucacccccacgaccccggcgagcggacucgagggguccggcgagguguacaccagcccgcccaucaccacgggcucccugccccugccugggaccacccccgagcuccccgccaccacgggaaccgacaccagcuccgccagcgacguggacuccagcacccagacggccgggggaaccuucacccuuaccguccggacgucccugccccgcagcccguccacccccagcacgccccaggacacccaccaccccguccggaaccuccugagcgugaccuccccggggcccgacgagaccagcacccccuccggcaccggcaaggagagccccgccacguccagcccgcaccccguuuccaaucgcccgcccaccccgcccgcgaccgcccaagggcccaccgagaacgacagccacaacgcuacggagcaccccgagucccugacccagagcgcuaccaccggccccaugaccucccccacgcagaucguccacccccagucugcgaccccgaucaccgugcaggacacccaccccucccccacgaaccggagcaagcgcaacuuggagauggagaucauccugacccugucacaggggcucaagaaguacuacggcaagauccugcggcugcuccaccugacccuagaggaggacaccgagggccuccuggaguggugcaagcgcaaccuggggcuugacugcgaugacacguucuuccagaagcggaucgaggaguucuucaucaccggcgaggggcacuuuaacgagguccugcaguuccgcacccccggcacccugagcacuaccgaguccaccccggccgggcuccccaccgccgagcccuucaagagcuacuucgccaagggcuuccuguccaucgacagcggcuacuacagcgccaagugcuacagcgggacgagcaauuccggccugcagcucaucaacaucacccggcacagcacccgcaucguggacacccccgggccgaagaucacgaaccugaagaccauuaacugcaucaaccugaaggcguccauauucaaggagcaccgggagguggagaucaacguccuccucccccaggucgccgugaaccuaagcaacugccacgucgugaucaagucccacgugugcgacuacucgcucgacauagacggcgccguccgccugccccacaucuaccacgaggggguguucauccccggcaccuacaagaucgugaucgacaagaagaacaaguugaacgaccggugcacccucuucacgaacugcgucaucaagggccgcgaggugcggaaggggcaguccgugcugcgccaguacaagaccgaaguccggaucggcaaggccagcacggggucccgccggcugcucagcgaggagccguccgacgacugcaucagccgcacccaacugcugcgcacggagaccgccgagauccacggcgacaacuacgggggccccggcgacaagaucacgaucugcaacgggucuaccaucguggaccagcggcucggcagcgagcuggggugcuacacgaucaaccgcgucaaguccuucaaacugugcgagaacagcgcgaccggcaagaacugugagaucgacuccguucccgugaagugccggcagggcuacugccugcguaucacccaggaggggcggggccacgucaagcucucccgcgggagcgagguggugcuggacgccugcgacaccuccugcgagaucaugauccccaagggcacgggggacauccuggucgacugcagcggcggucagcagcacuuccucaaggacaaccugaucgaccuggggugcccgaaaaucccccuccugggcaagauggccaucuacaucugccggauguccaaccaccccaagaccaccauggccuuccuguucugguucagcuucggguaucucaucacgugcauccugugcaaggccaucuucuaccugcucaucaucaucgggacccuugggaagcgucugaagcaguaccgggagcucaagccccagaccugcaccaucugcgagaccaccccggugaacgcgaucgacgccgagaugcacgaccugaacugcuccuacaacaucugccccuacugcgccagccgccugacguccgacggccucgcccggcacgugauccagugccccaagcgcaaggaaaaggucgaggagaccgagcuguaccugaaccucgagcggauccccuggguggugcggaagcugcugcaggucagcgaauccacuggcguggcccucaagcggagcuccuggcugaucgugcugcucguccuauucaccgucucuuugucccccgugcagagcgcgccaaucgggcagggcaagacgaucgaggccuaccgcgcccgggagggguacaccuccaucugccucuucguccuggguagcauccuguucaucguguccugccucaugaaggggcugguggacagcgucggcaacagcuucuuccccggccuguccaucugcaagaccugcagcauuuccagcaucaacggguucgagauagagucccacaagugcuacugcagccucuucugcugcccguacugccgccacugcuccaccgacaaggagauccacaagcugcaccugagcaucugcaagaagcggaagacgggcuccaacgugauguuggccgugugcaagcgcaugugcuuccgcgcgaccauggaggucagcaaccgggcccuguucauccgcuccaucaucaacaccaccuucgugcugugcauccucauccuggccguaugcgucguaagcacguccgccguggagauggagaaccugcccgcggggaccugggagcgggaggaggaccucaccaacuucugccaccaggagugccaggucaccgagacggagugccugugccccuacgaggcgcuggugcuccgcaagccccuguuccuggacagcaucgccaagggaaugaagaaccuccugaacuccaccagccuggaaaccucccucagcaucgaggccccguggggcgccaucaacgugcaguccacauacaaacccacggucagcaccgccaacaucgcucugagcugguccagcguggagcaccgggggaacaagauccugguguccggccgcagcgaguccaucaugaagcucgaggagcggaccgggaucagcugggaccugggcgucgaggacgccuccgaaagcaagcugcucaccguguccgugauggaccugucccagauguauucccccgucuucgaguaccugagcggggaccgccagguggaggaguggccgaaggcuacgugcaccggcgacuguccggagcggugcggcugcaccuccagcacgugccuccacaaggaguggccccacucccgcaacuggcgaugcaaccccaccuggugcuggggcguggggaccggaugcacgugcugcggccuggacguuaaggaccuguucaccgacuacauguucgugaaguggaaggucgaguacaucaagaccgaggccaucgucugcguggagcucaccagccaggagcgccagugcucccugaucgaggccgggacccgguucaaccugggacccguuaccaucacccucagcgagccgcgcaacauccagcagaagcugccgcccgagaucauuacgcugcacccccggaucgaggagggcuucuucgaccucaugcacguccagaaggugcugucagcgagcaccguuugcaagcugcagaguugcacccacgggguccccggcgaccuacaaguguaccacaucgggaaccugcugaagggcgacaaggucaacggacaccucauccauaagaucgagccucacuucaacaccuccuggaugagcugggacggcugcgaccuggacuacuauugcaacaugggcgacuggcccuccugcacguacaccggagugacccagcacaaccacgccagcuucgugaacuuacucaacaucgagaccgacuacacgaagaacuuccacuuucacuccaagcgcgucaccgcccacggcgacacgccccagcuggaccugaaggcccggccgaccuacggggcgggcgagaucaccgugcucguugagguggccgacauggagcugcacaccaagaagaucgagaucucagggcugaaguucgccagucuuaccugcaccggcugcuacgccugcuccuccggcaucucuugcaaggugcgcauccacguggacgagcccgacgagcucacgguccacgugaaguccgacgaccccgacguggucgccgcgagcuccagccugauggcccggaagcucgaguucgggaccgacuccaccuucaaggccuucagcgccaugcccaagaccucccugugcuucuacauuguggaacgcgagcacugcaagagcugcaacgaggaggacacgaagaagugcgugaacaccaagcuggagcaaccgcaguccauccucaucgagcacaagggcaccaucaucgggaagcagaacagcacgugcaccgcccgggcgagcuguuggcuggaguccgucaagagcuucuucuacggccugaagaacaugcuguccgggaucuucgggaacguguucaugggcaucuuccucuuccuggcccccuucauccugcucauccuguucuucauguucggguggcguauccuguucuguuucaagugcugccgccggacccgcggccucuucaaguaccggcaccugaaggacgacgaggagaccggguaccgccggaucaucgagcgccugaacaacaagaaaggcaagaacaagcuccuggacggcgagcggcuggccgaccgccggaucgccgagcuguucagcaccaagacgcacaucggguga

SEQ ID NO: 15278 - RNA, 5055 nt, Artificial Sequence; identical to SEQ ID NO: 11992
  derived and/or modified CDS sequence (opt11) from CCHFV(Sudan Al-Fulah 9-2008)__HQ378185.1__GP

SEQ ID NO: 15279 - RNA, 5055 nt, Artificial Sequence; identical to SEQ ID NO: 11993
  derived and/or modified CDS sequence (opt11) from CCHFV(SPU4/81)__DQ157175.1__GP

SEQ ID NO: 15280 - RNA, 5055 nt, Artificial Sequence
  derived and/or modified CDS sequence (opt11) from CCHFV(NIV 11703)__JN572086.1__GP
augcacaccagccugaucuacguggucuugugccugcagcugugcucccucggcaagacgcacgggagccacaacggcacggagcacaacaagacggacgugaugaccacccccggggacaaucaguccccggagccccuggugagcacggcucuacccgucacacccgacccguccaccgugacccccacggcccccgcuagcggccucgaggggagcggagaaguguacaccagcuccucaaucaccacaaagggucugagccugcccaaggccaccagcgaacuccuggcaaccaccgggauggucaccuccagcgccuccgacaucgacccgagcacacaggccgcgggcgacacccccacccccacagugcguacgagccugcccaacagccccuccaccccuagcaccagccaggacacucaccaccccgugcggaaucuucuguccgucacgagccccaagccggaggagacccccacgcccuccaagagcgacaaggacucaagcgccaccaacagcccccacccggcggccagccgccuguccacgccgcccaccaccgaccaggggcccaccgagaacaacaaccacaacagcacggagcaacucgagucccugacgcggagcgcgaccagcagcuccauggugagccugacccagacggugcucccccaguccgccaccagcaucgccacccaggacacccaccccucccccaccaaucgcagcaaacgcaaccuggagauggagaucauccugacucucccccagggccuaaagaaguauuacgggaagauccugaagcuccuucaccugacucucgaagaggauaccgagggccugcuggagugguguaagcgcaaucucggccuggacugcgacgacaccuucuuucagaagagaauugaggaguucuuuauuacgggagagggucacuucaacgagguccugcaguuccgagccccggguacccucucuaccaccgagccaacgcacgccggcucccccaccgcggaaccguuuaagagcuacuucgcgaagggcuuccuguccaucgacucuggauauuucuccgccaagugcuacagccgaaccucaaacagcggccugcagcucaucaacgugacgcgccacagcacgcggaucgccgacacccccgggcccaagaucaccaaccugaagaccaucaacugcaucaaccugaaggccagcguguucaaagagcaccgcgagguugagaucaacgugcugcugccccaaguggcagucaaccuguccaacugccacguggccaucaagucucacgugugcgacuacucccuugacacggacggggccauccgguugccgcacauccacuaugagggaacguucauaccugguaccuauaagaucgucauugacaagaagaacaagcugaacgacaggugcacucucuucacgaacugcgugaucaagggccgugaggugcggaaggggcagagcguccugcggcaauacaagaccgagauccgcaucggacgggccaguaccgggagcaggcgguuacucagugaggagagcggagacgauugcaucagccgcacccagcugcugcgcacggagacggccgaggugcacggggacaacuacggcggccccggggauaagaucaccaucuguaauggcaguaccgucguggaccaacggcuggggagcgagcucggcugcuacacgaucaaccgcgugaaguccuucaagcugugcgagaacagcgccacagggaaauccugcgagauugacagcauacccgugaagugccggcagggcuacugccugaagaucacacaggagggccgcgggcacgugaagcucuccaggggcucugaggugguccuggacgccugcgacuccagcugcgagguuaugaucccgaaggggaccggcgacauccugguggacugcucaggugggcagcagcacuuccucaaggauaaccugauugaccuaggcugccccaagaucccccuccucgggaagauggccaucuacaucugccgcaugagcaaccaccccaagacgaccauggcauuccuguucugguucuccuuuggcuacgugauaacaugcaucuuaugcaaagugaucuucuaccugcugaucaucuuuggcacccuuggaaagcgguucaagcaauaucgcgaguuaaagccgcagaccugcaccaucugcgagaccacccccguuaacgccaucgacgcugaaaugcacgaccugaacugcucguacaacaucugccccuacugcgccucccgguuaacuagcgacggccuggcccgucacgucacacagugccccaagcggaaggagaaaguggaggagaccgagcuguaccucaaccuggaacgcauccccuggguggucagaaagcugcuccagguguccgagagcaccgggaucgcccucaagcgcagcagcuggcugaucguccuccugguccuguucacugugagcaucacgcccgugcaguccgcgcccaucggccacgggaagaccaucgaggccuaucgggcccgcgaggaguacaccucaaucugucucuucguccuaggcuccgugcuguucguggucagcugccucaugaaggggcugguggacagugugggcaacaucuucuuccccggccuguucauaugcaagaccugcagcaucggguccaucaacggcuucgagaucgagucccacaaaugcuacugcuccuuguucugcugcccguacugccggcacugcagcgccgaccgcgagauccaccagcugcaccuguccauuugcaagaagcggaagacggggagcaacgucaugcuggccgugugcaaaaggaugugcuuccguaccaccauggagguguccaacaaggcgcuauucguccggagcaucaucaacaccaccuucgugguuugcauccugauccucgccgucugcgugguguccaccagcgccgucgagauggaaucgcugcccgcugguaccugggagcgagaggaagaccugaccaacuucugccaccaggagugccaggugacggagaccgagugccucugcccguacgaggcccuggugcugcggcgcccccuauucuuagauagcaucgugaagggcaugaagaacuuacuaaacuccaccagcuuagagacaucacuguccaucgaggcgccguggggcgccaucaacgugcagagcacguacaagcccacaguguccgccgcgaauaucgcccucagcugguccagcgucgagcaccggggaaacaagauccugguguccggccggagcgaguccaucaugaagcuggaggagcgaaccggcaucagcugggaccucggggucgaagacgcuuccgagagcaagcugcugaccgucagugugauggaccucagccaaauguacucucccguguucgaauaccugagcggggaccgccaggucgaggaguggccgaaggccacgugcaccggggauugccccgagagaugcggcugcacuucaagcacgugccuacacaaggaguggccccacucccgcaacuggcgguguaaccccaccuggugcuggggcguggggaccggcuguacaugcugcgggcucgacgugaaggaccuguucaccgacuacauguuugucaaguggaagguggaguacaucaagacggaggccaucgucugcguugagcugaccagccaggaacgccagugcagccucaucgaggccggaacccgguucaacuugggcuccgugaccaucacacugagcgagccucgcaacauccagcagaagcucccgcccgagaucaucacguugcacccacggaucgaggagggguucuucgaccugaugcacguccagaagguucucucagcgagcaccgugugcaagcugcagucaugcacccacggcgucccaggggaucuccaaguguaccacaucggaaaucuccugaagggagaccgcgucaacggacaccugauccacaagaucgagcagcaucuuaacaccuccuggauguccugggacggcugugaccucgacuacuacugcaauaugggggauuggcccagcugcacuuacaccggcgucacccagcacaaccacgcauccuucgugaaccugcucaacaucgagaccgacuacacgaagaccuuccacuuccacagcaagcgggugacugcccacggggauacgccgcaacuggauuugaaggcccgccccaccuacggcgcaggggaaaucaccguccuaguggagguggcggacauggagcugcacaccaagaagaucgagaucucaggccugaaguuugccucccucagcugcacgggcuguuacgccugcagcuccgggauuuccugcaagguccggauccacguagacgagccggacgagcugacggugcaugucaaguccgacgaccccgacgugguggcggccagcaguucgcugauggcucgcaagcucgagaguggcaccgacuccaccuucaaggccuucagcgccaugcccaagaccucccugugcuucuacaucgucgagcgggaauacugcaaggggugcagcaaagaagacacgcagaagugcgugaauacuaagcuggagcagccccaguccauccucaucgagcacaagggcaccaucaucgggaagcagaacaauacgugcacagccaaggccagcugcuggcuggaauccgugaaguccuucuucuacggccugaagaacaugcugucuggcaucuucgggaacgucuuccucggcaucuucagcuuccuggcgccguucgugcugcuaauccuguuuuucauguuuggguggcgcauccuguucuguuucaaguguugccgccggacccggggccucuucaaguaccggcaccuaaaggacgaugaggagaccggcuaccgcaagaucaucgagcgguuaaacaacaagaaagggaagaacaagcuccuggacggcgaacgccucgccgaucgaaagaucgcugagcuguucucgaccaagacccacaucggguga

SEQ ID NO: 15281 - RNA, 5055 nt, Artificial Sequence
  derived and/or modified CDS sequence (opt11) from CCHFV(NIV 112143)__JN572085.1__GP
augcacaccagccugaucuacgugguucucugccugcagcuuugcucccucggcaagacccacggaagccacaacggcacggagcacaacaagaccgacgugaugaccacccccggagacaaccaguccccggagccccugguaagcacggcccugcccgucacccccgacccgucaaccaucacccccacggcccccgcgagcggccucgagggguccggcgagguguacaccagcuccagcaucaccaccaagggccugucccuccccaaggccacgagcgaacuccuggccaccaccgggaugguuaccuccagcgccuccgacaucgacccgagcacgcaggccgcgggcgacacccccaccccuaccguccgcacgagccugcccaacagcccguccacccccagcaccagccaggacacccaccaccccgugcggaaccuccuguccgugacgagccccaagccggaggagacccccacccccuccaagagcgacaaggacuccagcgccaccaacagcccccacccggccgccucccgccuguccaccccgcccaccaccgaccaggggcccaccgagaacaacaaccacaacagcacggagcagcucgagucccugacucgaagcgcaaccuccagcuccauggugagccugacccagacggugcucccccaguccgccaccagcaucgcgacccaggacacccaccccucccccaccaaccgcucgaagcggaaccuggagauggagaucauccugacgcucccucagggccugaagaaguacuacgggaagauccugaagcuacugcaccugacccucgaggaggacaccgagggccugcuggaguggugcaagcgcaaccucggccuggacugcgacgacaccuucuuccagaagcggaucgaggaguuuuucaucacgggggagggccacuucaacgaaguguugcaguuccgcgccccggggacccucagcaccaccgagcccacacaugccggcucccccaccgcggagccguucaagagcuacuucgccaagggcuuccuguccaucgacagcggguacuucuccgccaagugcuacagccggacauccaacagcggccugcagcucaucaacgucacccgccacuccacgcggaucgccgacacccccgggcccaagaucaccaaccugaagaccaucaacugcaucaaccugaaggcgagcguguucaaggagcaccgcgagguggagaucaacguccuccugccgcaggucgcggugaaccuguccaacugccacgucgccaucaagagccacgugugcgacuacucccucgacacggacggcgccauccggcugccgcacauccauuacgaggggaccuucauccccggcaccuacaagaucgugaucgacaagaagaacaagcugaacgaccgcugcacccucuucacgaacugcgucaucaagggccgggaggugcgcaaggggcagucagugcugcggcaguacaagaccgagauccgcaucggccgggccucuaccgggucacgccggcugcucuccgaggagagcggcgacgauugcaucagccgcacccagcugcugcgcacggagaccgccgagguccacggggacaacuacggcggccccggggacaagaucaccaucugcaacggcuccaccguugucgaccagcggcuggggagcgagcucggcugcuacacgaucaaccgcgugaaguccuucaaacuuugcgagaacagcgcgaccgggaaguccugcgaaauugacagcauccccgugaagugccggcagggcuacugccugaagauaacccaggagggucgcgggcacgucaagcucagucggggcagcgaggugguguuggacgccugcgacuccagcugcgaggucaugaucccgaaggggaccggcgauauccugguggacugcuccgguggccagcagcacuuccucaaggacaaccugaucgaccugggcugccccaagaucccccuccuggggaagauggccaucuacaucugccgcaugagcaaccaccccaagacgaccauggccuuccucuucugguucuccuucggcuacgugaucacgugcauccucugcaaggucaucuuuuaccugcugaucaucuucgggacccucggcaagcgguucaagcaguaccgcgagcugaagccgcagaccugcaccaucugcgagaccacccccgugaacgccaucgacgcggagaugcacgaccugaacugcagcuacaacaucugccccuacugcgccucccggcucaccagcgacggccuggcccgccacgugacgcagugccccaaacggaaggagaaggucgaggagaccgagcuguacuugaaccuggagcgcauaccguggguggugcggaagcugcuccaggucucugagagcaccgggaucgcccugaagcgcuccagcuggcugaucgugcuccuggugcuguucaccgucagcaucacgcccgugcaguccgcgcccaucggccacgggaagaccaucgaggccuaccgggcccgcgaggaguacaccagcaucugccucuucgugcugggcuccguccuguucguggugagcugccucaugaaggggcuggucgacuccguggguaacaucuucuuccccggccuguucauuugcaagaccuguagcaucggguccaucaauggcuucgagaucgagagccacaagugcuacugcucccucuucugcugccccuacugccggcacugcagcgcugaccgcgagauacaccagcugcaccuguccaucugcaagaagcggaagacggggagcaacgugaugcucgccgucugcaagcgcaugugcuuccgcgcgaccauggagguguccaacaaggcccuguucgugcggagcaucaucaacaccaccuucgugguguguauccugauccucgccaucugcguggucuccacgagcgccguggagauggagucccugcccgccggcaccugggagcgcgaagaggaccugaccaacuucugccaccaggagugccaggugaccgagacggagugccucugccccuacgaggcgcuggugcugcggcgcccccuuuuccuggacagcauagugaaggggaugaagaaccugcucaacuccaccagccuggagaccagccuguccaucgaggccccguggggcgccaucaacgugcagagcaccuacaagcccacggucuccgccgccaacaucgcgcucagcugguccagcguggagcaccggggcaacaagauccugguguccgggcgcagcgaguccaucaugaagcuggaggagcggaccgguaucagcugggacuuaggggucgaggacgccuccgagagcaagcuacugaccguguccgugauggaccucagccagauguacucccccgucuucgaguaccugagcggcgaccgccagguggaggaguggccgaaggcuaccugcacgggggacugccccgagcggugcggcugcaccuccagcacgugccugcacaaggaauggccccacucccgcaacuggcggugcaaccccaccuggugcuggggcguggggaccggcugcacgugcugcgggcucgacgucaaagaccuguucaccgacuacauguucgugaaguggaagguggaguacaucaagaccgaagccauugucugcguggagcugaccagccaggagcggcagugcagccucaucgaggccggcacccgguucaaccugggguccgucaccaucacccugagcgagccgcgcaacauccagcagaagcucccgcccgagaucaucacgcugcacccccggaucgaggaaggguucuucgaccugaugcacgugcagaaggugcuuuccgccagcaccgucugcaagcugcaguccugcacccacggcgugcccggggaccuccagguguaccacaucggcaaccuccugaagggggaucgcgucaacggccaccugauccacaagaucgagcagcaccucaacaccagcuggauguccugggacggcugugaccuggacuacuacugcaacaugggggacuggcccagcuguaccuacacgggcgugacccagcacaaccacgccuccuucguuaaccuccucaacaucgagaccgacuacacgaagaccuuccacuuccacaguaagcggguaaccgcccacggggacacgccccagcuggaccugaaggcccgccccaccuacggcgcgggggagaucaccgugcuaguggaggucgccgacauggagcugcacaccaagaagaucgagaucuccggucugaaguucgccagccucuccugcaccggcugcuaugccugcaguuccgggaucagcugcaaggugcggauucacguggacgagccggacgagcugaccguccacgugaaguccgacgaccccgacguggucgccgcgucguccucccugauggcccgcaagcucgaguucggcacggacagcacauucaaggccuucuccgccaugcccaagaccagccugugcuucuacaucguggaacgggaguacugcaaggggugcuccaaggaggacacccagaagugcgugaacacgaagcuggagcagccccagagcauccucaucgagcacaagggcaccauuaucgggaagcagaacaacacgugcaccgccaaggcguccugcuggcuggagagcgucaaguccuucuucuacggccugaagaacaugcugagcggcaucuucgggaacguguuccucggcaucuuuuccuuccuggccccguucgugcugcucauccuguucuucauguucggguggcgcauccuguucugcuucaagugcugccgccggacccgcggccucuucaaguaccggcaccugaaggacgacgaggagaccggcuaccgcaagaucaucgagcgucugaacaacaagaaggggaagaacaagcuccuggacggcgagcgccuggccgaccggaagaucgccgagcuguucagcacaaagacccacaucggguga

SEQ ID NO: 15282 - RNA, 5055 nt, Artificial Sequence
  derived and/or modified CDS sequence (opt11) from CCHFV(NIVA 118594)__JN572084.1__GP
augcacaccagccucaucuacgugguccucuguuugcagcugugcucccucggcaagacccacgggagccacaacgguacggagcacaacaagaccgacgugaugaccacccccggggauaaccagucgccggagccgcuggugagcacggcccugcccgucacccccgauccguccaccgugacccccacggcccccgcgagcggccucgagggguccggcgaaguguacaccagcaguagcauaacuaccaagggccugucccugcccaaggccacgagcgaacuccuggccaccaccgggauggucacaagcagcgccuccgacaucgacccgagcacgcaggccgcgggcgauacccccacgcccaccgugcgcacgucccugccaaauagcccguccacccccagcaccucacaggacacccaccaccccgugcgcaaucuccuguccgucacgagccccaagccggaggaaacccccacccccuccaagagugauaaggacuccagcgccaccaacagcccacacccggccgccagccgccuguccacgccgcccaccaccgaccaggggcccaccgagaacaacaaccacaacagcacggagcagcucgagucacugacccggucugcgaccuccagcuccaugguuagccuaacccagacggugcucccccaguccgccaccagcaucgccacccaggacacccaccccucccccaccaaccgcagcaagcggaaccuggagauggagaucauccugacgcucccccagggacugaagaaguauuacgggaagauccugaagcuccugcaccugacccucgaagaggauaccgagggccuguuggaguggugcaagcgcaaccucggccuggacugcgacgacacguucuuccagaagcggaucgaggaguucuucaucacgggggaaggucacuucaacgagguacugcaguuccgcgccccggggaccuuaagcaccaccgagcccacgcacgccggcucccccaccgcggagccguucaaaagcuacuucgccaagggcuuccuguccaucgacucuggguacuucuccgccaagugcuacagccggaccuccaacucuggccugcagcucaucaacgugacccgccauuccacgcggaucgccgacacaccaggacccaagaucaccaaucugaagaccaucaacugcaucaaccuaaaggccagcguguucaaggagcaccgcgaguucgagaucaacguccuccugccucagguagcggugaaccuguccaacugccacgucgccaucaagagccacgugugcgacuacucccucgacacggauggagccauccggcugccgcacauccacuacgaggggacauucauccccggcaccuacaagaucgugaucgacaagaagaacaagcugaacgaccgcugcacucuuuucacgaacugcgucaucaagggccgggaggugcgcaaggggcagagcgugcuacgacaguacaagaccgagauccggaucggccgggccuccaccgggagccgccggcugcucuccgaggagucgggcgacgacugcaucucacgcacccagcugcuacgcaccgagaccgccgaggugcacggggacaacuacggcggccccggggacaagaucaccauaugcaacggcuccaccgucgucgaccagcgguugggguccgagcucggcugcuacacgaucaaccgcgugaaguccuucaagcugugcgagaacagcgcgaccgggaaguccugcgagaucgacagcauccccgugaagugccggcagggguacugccucaagaucacccaggagggccgcggccacgucaagcucucccggggcagcgagguggugcuggaugcgugcgacuccagcugcgaggucaugaucccuaaggggaccggcgacauccuggucgacugcuccggcgggcagcagcacuucuugaaggauaaccugauagaccugggcugucccaagauaccccuccuggggaagauggccaucuacaucugccgcaugagcaaccaccccaagacgaccauggccuuccuguucugguucaguuucggcuacgucauaaccugcauccucugcaaggucaucuucuaccugcugaucaucuucgggacccucggcaagcgguucaagcaguaccgcgagcugaagccgcagaccugcaccaucugcgagaccacccccgugaacgccaucgacgccgagaugcacgaucucaacugcagcuacaacaucugccccuacugcgccucccggcucacaagcgacggccuggcccgccacgugacgcagugccccaagcggaaggagaaggucgaggagaccgagcuguaccugaaccuggagcgcauccccuggguggugcggaagcugcuccaggucuccgaguccaccgggaucgcucugaagcgcagcagcuggcugaucgugcuccuggugcuguucacugucagcaucacgcccgugcaguccgcgcccaucggccacgggaagaccaucgaagccuacagagcucgcgaggaguacaccagcaucugccucuucgugcugggcuccguacuguucguggugagcugucucaugaaggggcuggucgacuccgugggcaacaucuucuuccccggccuguucaucugcaagaccugcagcaucggguccaucaauggcuucgagauugagagccacaagugcuacugcucccucuucugcugcccguacugccgccacugcagcgccgaccgcgagauccaucagcugcaccuguccaucugcaagaagcggaagacggggucaaacguuaugcucgccgucuguaagcgcaugugcuuccgcaccaccauggagguguccaacaaggcgcuuuucgugcggucuaucaucaacaccacuuuugucgugugcauccugauccucgccgugugcgucguuucuaccagcgccguggagauggagucacugcccgccgggaccugggagcgggaggaggaccugaccaacuucugccaucaggagugccaggucacggagaccgagugccucugccccuacgaggcccuggugcugcggcgcccccucuuccuggacagcaucgugaaggggaugaaaaacuugcucaacucgaccagccuggagaccucgcugagcaucgaggcgccguggggcgccaucaacguccagagcaccuacaagcccaccgucuccgccgcaaacaucgcccucagcugguccagcgucgagcaccggggcaacaagauccugguauccgggcgcagcgaauccauaaugaagcuggaggagcggaccggcauaagcugggaccucgggguggaggacgcauccgagagcaagcugcugaccguauccguuauggaccucagccagauguacagccccguguucgaguacuugagcggcgaccgccagguggaggaauggcccaaagcaacgugcaccggcgacugccccgagcggugcggcugcaccuccucuaccugccugcacaaagaguggccacacuccaggaacuggcggugcaaccccaccuggugcuggggcgucgggaccggcugcacgugcugcgggcucgacgugaaggaucuguucaccgauuacauguucgugaaguggaaggucgaguacaucaagaccgaggccaucgugugcguugagcugaccagccaagagcgccagugcagccuuaucgaggccggcacccgguucaaccugggcucggugaccaucacccugucugagccgcgcaacauucaacagaagcucccgccggagaucaucacccuacacccccggauugaggagggguucuucgaccugaugcacguccagaaaguccucuccgcgagcaccgugugcaagcugcaguccugcacccacggcgugcccggagaccugcaggucuaccacaucggcaaccuccugaagggggaccgcgugaacggccaccugauccacaagaucgagcagcacuugaacaccagcuggaugucaugggacggcugcgaccuggacuacuacugcaacaugggggacuggcccagcugcacguacaccggugugacccagcacaaccaugccuccuucgucaaucugcucaacaucgagaccgacuacacaaagaccuuccacuuucacagcaagcgggugaccgcccauggugacacgccccagcuggaccugaaggcccgccccaccuacggcgccggggagaucaccgugcucguagagguggcggacauggagcugcacaccaagaagaucgagaucuccggccugaaguucgccagccucuccugcaccggcuguuaugcaugcagcuccgggauaagcugcaaggugcggauccaugucgacgagccggacgaacucacggugcacgugaaguccgacgaccccgacgucgucgccgccagcucuagccugauggcgcgcaagcucgagagcggcaccgauuccaccuucaaggccuucagcgccaugcccaagaccucccugugcuucuacaucguggagcgcgaguacugcaaggggugcagcaaagaggacacgcaaaagugcgucaacaccaagcucgagcagccccaguccauccucaucgagcacaaggggaccaucaucgggaagcagaacaacacgugcaccgccaaggccagcugcuggcuggagucugugaaguccuuuuucuacggccugaagaacaugcuguccggcaucuucgggaacguguuccucggcaucuucagcuuccuggcgccguucguccugcucauccucuucuucauguucggguggaggauccuguucugcuucaagugcugucgccguacccgcggccuuuucaaguaccggcaccugaaggacgacgaggaaaccggcuaccgcaagaucaucgagcggcuaaacaacaagaagggcaagaacaaguugcuugacggcgagcgccuggccgaccggaagaucgccgagcuguucuccaccaagacgcacaucggguga

SEQ ID NO: 15283 - RNA, 5055 nt, Artificial Sequence
  derived and/or modified CDS sequence (opt11) from CCHFV(UCCR4448)__KY484042.1__GP
augcacaucucgcuaauguaugccgugcucugucugcagcugugcggccuaggggagacccacggcucccacaacgagaccgggcauaacaagacggaugucaugaccacccccggcgacaaccugagcucugagcagccggugagcaccgcucuaaguaucacgcccgaccccagcacugugaccccaaccacacccgcguccggacucgagggcucgggcgagguauacaccuccccgcccaucaucaccgagagccuaucccugcccgagaccacacccgagcucagcgccaccgccgggaucgacaccuccagcgccuccgacguugacucauccacccaagccgcgcgcggcacgagcgcccugaccgugcgaaccucccugcccaacagccccagcacccccuccacgccccaggagacccaccacccgguccgcaaccuccugagcguaaccagcccccggcccgaggagaccagcacgccgucaggcagcggcaaggaguccagcgccacgucggggccccaucccgucagcaauaagcccccaacuccgcccgccaagacgcagggccccacggagaacaacucccacaacgcgaccgagcaccccgaaccccugacucagagugccacccucggccucaugaccucccccacccagaucguccacccccagagcgcuaccuccaucaccguacaggacacguacccgagccccacgaaccguuccaagcggaaccuggagauggagaucaucuuaacccugucacaggggcugaaaaaguacuacggcaaaaucuuaagacuguugcggcucaccuuagaggaggauaccgaaggccugcucgaguggugcaaacgcaaccuuggccuggacugugacgacacguucuuucaaaagcggaucgaggaguucuucaucaccggcgaagggcacuucaaugaggugcuucaguuuaagacucccgggacccuuagcacgaccgaaagcaccccggccgagcugccaacugccgagcccuucaagagcuacuucgcgaagggguuccucuccauagacagcggcuauuacuccgccaagugcuacagcggcacguccaacagcggccugcagcugauuaacaucacccgccacuccgcucggaucgucgauaccccaggcccgaaggucacaaacuugaagacuaucaacugcaucaaccugaaggccagcauuuucaaggagcaccgcgagguugagaucaacguccugcucccccagguggcgguuaaccuguccaacugccaugucaucaucaaaucccacguaugugacuacucccuggacaucgacgggaccgugcggcucccucacaucuaccacgagggcgucuucauccccgggaccuacaagauugugauugauaagaaagacaagcugaacgaccgcugcacccuguucacggacugcgugaucaagggccgugagguccgcaaggggcagagcguccuccggcaguacaagaccgagaucagaaucggcaaagcguccacagggagccggcgccuacugagugaggagaccagcgaugacugcaucucccggacgcagcucuuacggaccgagaccgcugagauccauggggacaauuauggcgggccgggcgacaagauaaccaucuguaacgggagcacgaucgucgaccaacgccugggcucagagcugggcuguuacaccauuaaccgagugaagucauuuaaacucugcgagaacagcgccaccgggaaguccugcgagaucgacucugugcccgucaaaugucgccagggcuacugccugcggaucacccaggaggggcgcggccacgugaagcugagucggggcagcgaggucguccucgacgccugcgacacgucuugugagaucaugauccccaaggggaccggcgacauccuagucgacugcagcgggggccaacagcacuuccugaaggacaauuugaucgaucuggggugccccaagaucccucuacucggcaagauggcaauuuacaucugccgcaugucgaaucauccuaagaccacaauggccuuccuguucugguucaguuucggcuacgugaucacguguauacugugcaaggccaucuuuuaucuccugauuauuaucgggacgcugggcaagcgguucaaacaguaucgcgagcucaagccccaaaccugcaccaucugcgagacgacacccgucaacgccaucgaugcggagaugcacgaccugaauugcuccuauaacaucugcccguacugcgccagccggcugaccuccgacggguuggcgcgccacguaacgcaguguccaaagcggaaggagaagguggaggagacugagcuguaccugaaucucgagcgcaucccaugggucgugagaaagcugcuucaggugagcgaguccacuggcgucgcucuaaagcgcagcuccuggcugauagugcuacuggugcuguucaccaucagccugagcccuguccaaagcgccccaauaucccacggcaagaccaucgaggccuaccgggcgcgcgagggguacaccuccaucugucucuucgugcugggcucaauccuguucauaguaucuuacuugaugaagggacugguagauuccgugggcaacuccuucuuccccgggcugaguauuugcaagacgugcucuaccagcuccaucaacgguuucgagaucgagagccacaagugcuacugcucucucuucugcugcccuuacugccggcacugcagcgccgacaaggagauacacaaguuacaccuguccaucuguaagaagcgcaagaccgggagcaacguuaugcuagcugucuguaagcggauguguuuccgcgccaccauggagguguccaaccgcgcccuguucauacggagcaucauaaauacgaccuuugugcuauguauccucauccuagcgguuugcgugguguccaccagcgcuguagagauggagaaccugccggccggcaccugggagcgcgaggaagaccucacgaauuucugccaccaggagugucaggucaccgagaccgagugccuaugcccguacgaggccuugguuuuacguaagccccuguuucuggacuccauugucaagggaaugaaaaaccuccugaauagcaccagccuggagacgucccugagcaucgaggcacccuggggcgcgauuaacguacaguccaccuacaagccgaccgugucuaccgcuaacaucgcccugucuuggucauccgucgagcaccgcgggaacaaaaucuuagugagugggcgauccgagagcaucaugaaacucgaggagaaaacgggcaucuccugggaccuggggguggaggacgccucugaguccaaauuacucaccgucagcgugauggaucugucccagauguacucacccguguucgaauaccuguccggcgaccgccagguagaggaauggcccaaggccacaugcaccggcgacugccccgaacggugcgggugcacgagcuccacgugccuccacaaagaguggccgcauagccgcaacuggaggugcaaccccaccuggugcuggggcguggggaccggcuguaccugcugcggccucgacgugaaggaccuguucaccgacuauauguucgucaaauggaagguggaauauaucaagaccgaggcgaucgugugcgucgagcucaccucccaagagagacagugcucccuaaucgaagccgggacucgguucaaccugggcccugugaccaucacccucucagaaccgcgcaacauccagcagaagcugccgcccgagaucaucacccuccacccucggaucgaggagggguucuucgaccucaugcacguucagaagguccugucggccaguacgguaugcaagcugcagucuugcacccacggcguuccaggggaccuccaggucuaccacauagguaaccugcugaagggcgacaaagugaacgggcaccucauccacaagaucgagccgcacuucaacaccagcuggauguccugggacggcugcgaccuggacuacuacugcaacaugggugauuggcccagcuguaccuacaccggcgucacgcagcacaaccacgccuccuuugugaaccugcucaacaucgagacggacuacaccaagaauuuucauuuccacagcaagcgggugaccgcacauggggacacgccccaguuggaucugaaggcacggcccaccuacggcgccggcgagaucacugugcucguggaaguugccgacauggaacugcacacgaagaagaucgagaucuccgggcugaaauucgcauccuugacuugcacaggauguuacgcgugcuccagcggcaucuccugcaagguccgcauccacgucgaugagccagaugagcugaccgugcacgucaagagcgaugacccggacgugguggcugccagcagcucccugauggcccggaagcucgaauuugggaccgacucaacguucaaggccuucagcgcgaugcccaagaccucccuguguuucuacaucgucgagcgggagcacugcaaguccugcuccgaagaggacaccaagaaaugcgucaacaccaagcuggaacagccccaauccauccucaucgagcauaaggggacgaucaucggaaaacagaauaguaccugcaccgccaaagccagcuguuggcucgaguccgucaagagcuucuucuacgguuugaagaacaugcuguccgggaucuuuggcaauguguucaucgggaucuuccucuucuuggccccguucauucugcucauccuguucuuuauguucggcuggaagauccuguucugcuucaagugcugccggcgcacucggggacucuucaaguaccgccaccugaaggaugacgaggagacggguuaccgucggaucaucgagcgccuuaauaacaagaagggcaagaacaagcugcuggacggggagauccuggcugaccggcgcaucgcagagcuuuucuccaccaagacacacaucggcuga

SEQ ID NO: 15284 - RNA, 5055 nt, Artificial Sequence
  derived and/or modified CDS sequence (opt11) from CCHFV(UCCR4401)__KY484035.1__GP
augcacaucagccugauguacgccauccugugccugcagcuuugcggccucggggagacucacggcucccacaacgagacccgccacaacaagacggacaccaugaccacccccggggacaacccgagcuccgagccgcccgugagcacggcccugaguaucacccuugaccccaguaccgucacccccacgacccccgcguccggccucgaggggagcggcgagguauacaccuccccgccaaucaccacgggcagccugccccuguccgagaccacccccgagcuccccgugaccacgggcaccgacacccugagcgccggcgacgucgaccccuccacccagacggccgggggcaccagcgccccgaccgugcggaccagccugcccaacuccccguccacgcccagcaccccgcaggauacccaccaccccgugcgcaaccuccucagugucacuagcccagggcccgacgagacgagcaccccguccggcaccggcaaggagagcagcgccacaagcagcccccaccccgugucaaaccggcccccgacgccgcccgcgaccgcccaggggcccaccgaaaacgacucccacaacagcaccgagcaccccgagucccugacacagagcgccacccccggccucaugaccucccccacccagaucgugcacccccagagcgccacccccaucacgguccaggacacccaccccuccccuaccaaccgcagcaagcggaaccuaaagauggagaucauccugacccucucccaggggcugaagaaguacuacggcaagauacugcgccuccugcagcugacgcucgaggaggacaccgagggccuacuggaguggugcaagcggaaccucgggcucgacugugaugacaccuucuuccagaagcgcaucgaggaguucuucaucaccggcgaggggcacuucaacgaggugcugcaguuccggacgccaggcacccucagcacaaccgaguccacacccgcggggcugcccaccgcggagcccuucaaaagcuacuucgccaagggcuuccuguccaucgacagcggcuacuacucugccaagugcuauuccgggaccagcaacuccggccuccagcugaucaacaucacccgccacagcacgcggaucguggacacgccggggcccaaaaucaccaaccugaagaccaucaacugcauaaaucucaaggccuccaucuucaaggagcaccgagaggucgagaucaacgugcuucugccccagguggcggucaaccucagcaauugccacguggugaucaagucccacgucugcgacuacagccuggacaucgacggcgccgugcggcucccccacaucuaccacgaggggguguucaucccgggcaccuacaagaucguaaucgacaagaagaauaagcucaacgaccgcugcacacuguucaccgacugcgugaucaagggucgggagguucggaaagggcaguccguccugcggcaguacaagaccgagauccgcaucggcaaagccucuacggggucccggcggcuccugagcgaggagcccuccgacgacugcaucagccggacccaacugcuccgaaccgaaaccgccgagauccacggcgacaacuacgggggcccaggcgacaagaucacgaucugcaacgguuccaccaucguggaccagcgcuugggcucagagcuggguugcuacacuaucaaccggguccgcuccuucaagcugugcgagaacagcgccaccggcaagaacugcgagaucgacagcgugcccgugaagugccggcaaggcuacugccucaggaucacucaggagggacggggccacgucaagcugucccgggggagcgagguggugcuggacgcgugcgacaccuccugcgagaucaugaucccgaaggggaccggugacauccucgucgacugcagcggaggccagcagcacuuccugaaagacaaccugaucgacuuagggugcccgaagaucccccuguugggcaagauggccaucuacauaugccggauguccaaccaccccaagaccacgauggccuuccucuuuugguucagcuucggguacgucaucacuugcauccugugcaaagccaucuucuaccuguugaucaucgugggcacccuggggaagcgccuuaagcaguacagagagcucaagccgcagaccugcaccaucugcgagaccacccccgucaacgccaucgacgcggagaugcacgaccuaaacugcuccuacaacaucugccccuacugcgccagccgccugaccuccgacggccucgcccggcacgugauccagugccccaagcgcaaggagaagguugaggagaccgagcuguaccugaaccucgagcggaucccgugggucgugcguaagcugcuccaggugagcgagucgacgggcguagcccugaagcggagcuccuggcugaucgugcugcuugugcuguucaccgucagccugucccccguccagagcgcccccauagggcagggcaagaccaucgaggcguaccgcgcccgggagggguacaccuccauuugccucuucgugcugggcagcauccuguucaucgucuccugccucaugaaggggcugguggacagcguggggaacagcuucuucccgggccugucuaucugcaagacgugcagcaucuccagcaucaacggguucgagauugaaucccacaagugcuacugcagccucuucugcugccccuacugccgccacugcuccaccgacaaggagauacacaagcugcaccuguccaucuguaaaaagaggaagaccggcagcaacgucaugcuugccgugugcaagcugaugugcuuccgcgccaccauggaggugagcaaccgcgcgcuguucauccggagcaucauaaacacgaccuucguccuuugcauccugaucuuagccgugugcguagucagcaccuccgccguggagauggagaaccuccccgccgggaccugggagcgcgaggaggaccugacgaacuucugccaccaggagugccaggugaccgagaccgagugccugugccccuacgaggcccucgugcugcggaagccgcuguuccucgacagcaccgcgaagggcaugaagaaccugcugaacuccaccagucucgagaccucccuuagcaucgaggcccccuggggcgccaucaacgugcaguccaccuacaagcccaccgugagcacggcgaacaucgcccugagcugguccagcgucgagcaccgcgggaacaagauccucguuuccggccgcucugaguccaucaugaagcuggaggagcgcaccgggaucagcugggaucugggcguggaggacgcguccgagagcaagcuccuaacggucuccgugauggaccugucgcagauguacucccccguguucgaguaccucagcggagaccggcaggucgaggaauggccgaaggcgaccugcacgggcgacugccccgagcgcugcggcugcaccuccagcacgugccugcacaaggaguggccccacucacggaacuggaggugcaaccccaccuggugcuggggcguggggaccggguguacgugcugcggccuggacgugaaggaccucuucaccgacuacauguucgucaaguggaagguggaguacaucaagaccgaggccaucgugugcgucgagcugaccagccaggagcggcagugcucccugaucgaagcagguacccgauucaaccucggcccugugaccaucacacugucugagccccggaacauccagcagaagcugccgcccgagaucaucacccuccacccccgcaucgaggagggguucuucgaccucaugcacgugcagaagguccuguccgcuagcacggugugcaagcuccaguccugcacccacgggguccccggugacuugcaaguguaccacaucgggaacuugcugaaaggcgacaaggugaacgggcaccugauccacaagaucgagccccacuuuaacacuuccuggaugagcugggacggcugcgaccuggacuacuacugcaacaugggcgacuggcccuccugcaccuacacgggcgucacccagcacaaccacgccagcuucguaaaccuccugaacaucgagaccgacuacaccaagaacuuccacuuccacuccaagcgcgugacggcccacggcgacaccccgcagcuggaccucaaggcccgccccacuuacggugccggugagaucaccguccucguggaggucgcggacauggagcugcacacgaagaagauagagauaagcgggcugaaguuugccucccuggccuguacgggcugcuacgccugcagcuccggcauaagcugcaagguccgaauccacguggacgagcccgacgagcugaccgugcacguuaaguccgacgaccccgacgugguugccgcgagcuccagccucauggcccgcaaacuggaguuugggaccgacuccacguucaaggccuucagcgccaugccgaaaaccucccuuugcuucuacaucgucgagcgggagcacugcaagaguugcuccgaagaggacaccaagaagugcgugaacaccaagcucgaacagccccagagcauccuaauugagcacaagggcacgauaaucgggaagcagaacagcacgugcacggccaaggcguccugcuggcuggaguccgugaaguccuucuucuacgggcucaagaacaugcucagcggcaucuucgggaacgucuuuaugggcaucuuccuguucuuggcccccuucauccuccuuauccuguucuucauguucggauggcgcauccucuucugcuucaaguguugccggcgcacccgcggccuguucaaguaccggcaccugaaggaugacgaggagaccggguacagacggaucaucgagaagcucaacaauaagaagggcaagaacaaguuacuggacggcgagcgcuuagccgaucggcgcaucgccgagcuauucagcacaaagacucacaucggguga

SEQ ID NO: 15285 - RNA, 5055 nt, Artificial Sequence
  derived and/or modified CDS sequence (opt11) from CCHFV(IbAn7620)__KX013451.1__GP
augcacaucagccugaucuaugccauucucugccugcagcugugcggacucggggagaccuacggcucccacaacgagacccgccacaacaagacggauaccaugaccacccccggggacaaccugagcuccgagccgcccgugagcacggcccuguucaucacccccgaccccuccaccgucaccccgacgacccccgcgagcggccucgagggguccggcgaagucuacaccagcccucccaucaccacgggcucccugccgcugcccgagaccacccccgaacuccccgccaccacggggaccgauaccagcuccgccagcgacguggacuucuccacccagacggccggcgggaccagcgcccugaccguccguaccggccugccggacucccccagcacgcccuccacaccccaggacacccaccacccgaugcgcaaucuccugagcgugaccucccccgggcccgacgagacgagcacgcccagcggcaccggacgggaguccagcgcgaccaguagcccgcaccccguauccaaccgcccgcccacgccgcccgccaccgcccaggggcccaccgagaacgacagccacaacgccaccgagcaccccgagucucugacgcagagcgcgacucccggccugaugaccucccccacccagaccauccacccccagagcgccacgccgaucaccguccaggacaagcagcccucccccaccaaccggagcaagcgcaaccuggagauggagaucauccugacccucucccaggggcugaagaaguacuacggaaagauucugcggcuccugcaccugacgcucgaggaggacaccgagggccugcuggaguggugcaagcgcaacuuagggcuggacugcgacgacaacuucuuccagaagcggaucgaggaguucuucaucaccggcgaggggcacuucaacgagguccugcaguuccgcacccccggaacgcucaguaccaccgaguccaccccagccgggcugcccacggccgagcccuucaagagcuacuucgccaagggcuuccuauccaucgacagcggcuauuacuccgcgaagugcuacagcgggaccagcaacucaggccuucagcugaucaacaucacccggcacagcacccgcaucguggacacgcccgggccgaagaucaccaaccugaagaccaucaacugcaucaaccucaaggccuccaucuucaaggagcaccgggaggucgagaucaacgugcugcugccccagguggccgucaaccucagcaacugccacgugguuaucaagucccacgucugcgacuacagccuggacaucgacggcgccgugcgccugccccacaucuaccacgagggggucuucauccccggcaccuacaagauugucaucgacaagaagaacaagcucaacgaccggugcacgcuguucaccgacugcgugaucaagggccgcgaggugcggaaggggcaguccguccugcgccaguacaagaccgagauccggaucggcaaggccagcaccgggucccgccggcuccugagcgaggagccguccgacgacugcaucagccgcacgcagcugcuccgcacggagaccgcggagauccacggcgacaacuacgggggccccggcgacaagaucaccaucugcaacggguccacgaucguggaccagcggcugggcagcgaguuggggugcuacaccaucaaccgcgugaaguccuucaagcugugcgagaacagcgccaccggcaagaacugcgagaucgacuccguccccgugaagugccggcagggcuacugccuccguauaacccaggaagggcggggccacgucaagcugagccgcgggagcgagaucgugcuggacgccugcgacacgagcugcgagaucaugauccccaagggcaccggggacauccucguggauugcagcggcggccagcagcacuuccugaaggacaaccugaucgaccucgggugcccgaagaucccccugcugggcaagauggccaucuacaucugccggauguccaaccaccccaagaccaccauggccuuccucuucugguucagcuucggguacgucaucacgugcauccugugcaaggcgaucuucuaccugcucaucaucaucggcacccuggggaagcgccugaagcaguaccgggagcucaagccccagaccugcaccaucugcgagaccacgccggugaacgccaucgacgccgagaugcacgaccugaacugcuccuacaacaucugccccuacugcgccagccgccugaccuccgacggccucgcccggcacgugauccagugccccaagcgcaaggagaaggucgaggagaccgagcuguaccugaaccucgagcggaucccguggguggugcgcaagcugcugcaggucagcgaguccaccggcguggcgcucaagcggagcuccuggcugaucgugcuguuaguccuguucacgguaagccuguccccggugcagucagcccccaucgggcagggcaagaccaccgaggccuaccgcgcccgggagggguacacauccaucugccucuucguccugggcagcauccuguucaucguguccugccucaugaaggggcugguggacagcgucggcaauuccuucuuucccggccugagcaucugcaagacgugcagcaucuccagcaucaacggguucgagaucgagucacacaagugcuacuguagccucuucugcugcccguacugccgccacugcuccaccgacaaggagauccacaagcugcaccugagcaucuguaagaagcggaagacgggcuccaacgugaugcuggcggugugcaagcgcaugugcuuccgcgccacgauggaggucagcaaccgggccuuauucauccgcuccaucaucaacacgaccuucgugcugugcauccucauccuggccgugugcgucgugagcaccucggcaguggagauggagaaccugcccgcggggaccugggagcgggaggaagaccucacuaacuucugccaccaggagugucaggucaccgagaccgagugccugugccccuaugaggcccuggugcuccgcaagccccuguuccuggacagcaucgccaagggcaugaagaacccguuaaacuccaccagccuggagacgucccugaguaucgaggcccccuggggcgccaucgacgugcaguccaccuauaagcccaccgucagcaccgcaaacauagcccucuccuggagcagcguggaacacagggggaacaagauucugguguccggccgcucagaguccaucaugaagcuggaggaaaggacggggaucagcugggaccucggggucgaggaugccuccgagagcaagcugcugacagucuccgugauggaccucagccagauguacucccccgucuucgaguaccugagcggggaccgccagguggaggaguggccgaaggccaccuguaccggcgacugccccgagcggugcggcugcacgagcagcacgugccugcacaaggaauggccccacucccgcaacuggcggugcaaccccaccuggugcuggggcguggggaccggcuguaccugcugcggccucgacgucaaggaccuguucaccgacuacauguucgugaaauggaagguggaguacaucaagaccgaggccaucgucugcguggagcugaccagccaggagcgccagugcucccucaucgaggcagggacgcgguucaaccugggcccggugacuaucacccugagcgagccgcgcaacauccagcagaagcucccgcccgagaucaucacacugcacccccggaucgaggagggcuucuucgaccugaugcauguccagaaggugcucuccgccagcaccgugugcaagcugcaaucaugcacgcacgggguccccggcgaccuccagguguaucacaucgggaaccuguugaagggcgacaaggugaacgggcaccugauccacaagaucgagccccacuucaacaccagcuggaugagcugggacggcugcgaccucgacuacuacugcaacaugggcgacuggcccuccugcaccuauaccggggucacgcagcacaaccacgccagcuucgugaaccugcugaacaucgagaccgacuacaccaagaacuuccacuuccacaguaagcgcgucaccgcccacggcgacacuccgcagcucgaccugaaggcgcggccgaccuacggggccggcgagaucaccgugcugguggaggucgccaacauggaacuccacaccaagaagaucgagaucagcgggcucaaguucgccucccugacgugcaccggcugcuacgccugcagcuccggcaucagcugcaaggugcgcauccacguggacgagcccgacgagcucaccguccacgugaaguccgacgaccccgacguggucgcggccagcuccagccugauggcccggaagcuggaguucgggaccgacuccacguucaaggccuucagcgccaugccgaagaccucccucugcuucuacaucguggagcgcgagcacugcaagagcugcuccgaggaggacaccaagaagugcgugaacaccaagcuggagcagccccagagcauccugaucgagcacaagggcacgaucauugggaaacagaacuccacgugcaccgcgaaggccagcugcuggcucgagagcgucaaauccuucuucuacggccugaagaacaugcugagcggcaucuucgggaacguguucaugggcaucuuccucuuccucgcccccuucauccugcugauccucuucuucauguucggguggcggauccuguucugcuucaagugcugccgccgcacacggggccuguuuaaguaccgccaccucaaggacgacgaggagacgggguaccggcgcaucaucgagcggcugaacaacaagaagggcaagaacaagcugcucgacggcgagcgccuggccgaucggcgcaucgccgagcuguucuccaccaagacucacauuggguga

SEQ ID NO: 15286 - RNA, 5055 nt, Artificial Sequence
  derived and/or modified CDS sequence (opt11) from CCHFV(Zahedan 2007)__KC867273.1__GP
augcacaucagccugauguacgcuguguucugccuccagcuguguggccuggggaagaccaacggcccccacaacgggaccgagcacaacaacacgcaugucaugaccaccccagacgacucccagagccccgagccgcccguguccaccgcgcuccccgugacgcccgaccccaguaccgucaccccauccaccccggcgagcggccuggaaggguccggcgaggugcacacgagcucccccaucaccaccaaaggucugucacuccccgaggccaccuccgagccgccgucuacgaccuccgucgucaccagcuccgccagcgacacggacuccagcacccaggccgccggggacacccccacccccaccgugaggacgucccugcccagcagcccguccacccccagcacuucccaaggcacccauuaccccgucaggagcuugcucuccguaacggggcccaagccggaggagacccccacccccagcaagucgggcaaagacaaccuggcgaccaacagcccccauccggcgacgucccgccccaccacccccagcaccaucgcccagaagcccacggaaaacaacucccacaacaccaccgagcagcuggagagccucacccaucuggccacgcuugguuccaagaucucuccgacccagaccgugcucccccaguccgugaccagcaucgcgauccaggacauccacaccucccccacgaaccggucgaagcgcaaccuggacauggagaucauccugacccucucccagggccugaagaaguacuacggcaagauccugaagcuccugcggcugacccucgaggaggacacugaggggcuccuggaguggugcaagcgcaaccuaggccuggacugcgacgacaccuucuuccagaagaggaucgaagaguucuucaucaccggggagggucacuucaacgagguccugcaguuccgaacccucggcacccugagcaccaccgagagcacccacgccggguccccgacuguggagccuuucaagagcuacuucgccaagggcuuccugagcaucgacagcggguacuucuccgccaagugcuacagccggaccuccaacagcggacuccaacugaucaacgugacccgccacucuaccaggaucgccgacacccccggacccaagaucacgaaccugaagaccaucaacugcaucaaccucaaggcgagcgucuucaaggagcaccgcgagguggagaucaacgugcugcugccgcaggucgccgugaaccucuccaacugucacguggccaucaagagccacaucugcgacuauucccuugacaccgacggcgccauccggcugccccagauccaccacgagggcaccuucauccccgggacguacaagaucgucaucgacaagaaaagcaagcucaacgaccgcugcacccuguucaccaacugcgugaucaagggccgggaggugagaaaggggcagagcguccugcggcaguacaagaccgagaucagaaucggccgggccagcacggggucgcgccggcuccugagcgaggagagcggcgacgacugcaucucccgcacccagcuccuccgcacugagaccgcggaggugcacggcgacaacuacgggggccccggagacaagauaacuaucugcaacggcagcaccgucguugaccagagacugggguccgagcuggguugcuacaccaucaaccgagugcggagcuucaaauugugcgagaacuccgccaccggcaagucaugcgagaucgacuccauaccggucaaguguaagcagggguuuugccucaagauaacgcaggagggccgcgggcaugugaagcugagccggggcuccgaggugguccuggacgugugcgacucaucuugcgaggugaugauccccaagggcaccggggacauccucgucgacugcucaggcgggcagcagcacuuccugaaggacaaccugguggaccucggcugccccaagauuccccugcuggggaagauggccaucuauauuugccgcauguccaaccacccgaaaacaaccauggccuuccucuucugguucagcuuuggauacgugaucacgugcauccugugcaaggcgaucuucuuccugcucaucaucuucggcacccugggaaagcgcuucaagcaguaccgcgagcugaagccccagaccugcaccaucugcgagaccacgccagugaacgcgaucgacgccgagaugcacgaccuaaacugcuccuacaacaucugccccuacugcgccucccgucugaccuccgacggucuggcccgccacgugacccagugcccgcggcgcaaggagaagguggaggagaccgagcucuaccugaaccuggagcggauccccugggucgugcgcaagcuccuccaggugagcgaguccacggggaccguccugaagagaucgagcuggcuuaucgugcugcuggugcuguucacugucucacugagccccgugcaguccgcccccaucggccacgggaagacuaucgagacguaccgcgugcgcgaggaguacaccaguaucugccuguucguucucggcuccauccuauucaucgugagcuuucugaugaagggccucguggacggugucggaaacaucuucuucccggggcugucggugugcaagaccugcagcaucggcuccaucaacgguuucgagaucgagagccaucgcugcuacugcucccuguucugcugccccuacugcagacacugcagcgcggacggcgagauccaccagcuccaccuguccaucugcaagaagcgcaagaccggcagcaacgucaugcuggccgucugcaagcguaugugcuuccgggccacgauggagguguccaacaaggugcuguucauccguagcaucaucaacacaaccuucgucguguguauccugauccuggccgugugcgucguuuccaccagcgcgguggagauggagucccuccccgccgggacgugggagcgggaagaggaccugaccaacuucugccaccaggagugccagguuaccgagaccgagugccugugcccuuacgaggcccucgugcugcgccggccgcuguuccuggacagcaucgugaaggacaugaagaaccugcugaacuccacgucccucgagaccagccuguccaucgaagcucccuggggcgccaucaacguccagagcaccuacaagcccaccguguccacggcgaacaucgcacugagcugguccagcguggagcaccgcggcaacaagguccucguguccggccgcagcgaauccauuaugaagcuggaggagcgcaccgggaucagcugggaccugggcguggaggacgcuuccgagagcaagcuccucaccguauccgugauggaccugagccagauguacuccccgguguuugaguaccucagcggcgaccggcagguugaggaguggcccaaggcgaccugcacgggggacugccccgaacgcugcggcugcaccuccagcacgugccugcauaaggaguggccccacagccggaacuggcgcugcaacccgaccuggugcugggguguggggaccggcugcacgugcugcgggcuugacgucaaggaccucuucaccgacuauauguucgugaaguggaagguggaguacaucaagaccgaggccaucgucugcguggagcugacaagccaggagcggcagugcucgcugaucgaggccggcacccgcuucaaccucgguuccgugacaaucacccugucagagccccggaauauccagcagaagcucccgcccgagauaaucacauuacaccccaaaaucgaggagggcuucuucgaccugaugcacguccagaaggugcugucugccagcacgguauguaagcuccaguccugcacacaugggguccccggagaccuccagguguaccacaucggcaaccugcucaagggugaccgcgugaacggccaccugauccacaagaucgagcagcacuucaacaccagcuggauguccugggacgggugcgaccuggacuacuacugcaacaugggggacuggcccagcuguacguacaccggggucacccagcauaaccacgccuccuucgugaaccuccugaacaucgagacggacuacaccaagacguuccacuuccacagcaagcgggugacugcccacggcgacacgccccagcuggaccucaaggcccgcccgaccuacggcgccggugagaucaccguccugguggagguggcagacauggagcugcacaccaagaagaucgagaucuccggccucaaguucgccgggcugacgugcaccggcugcuacgccugcagcuccgggauuagcugcaagguucggauccacguggacgagcccgacgagcugacggugcacgucaagucugacgaccccgacgugguggcggccucuuccagccucauggcccgcaagcuggaguucgguaccgacagcaccuucaaggccuucuccgccaugccaaagaccagccugugcuucuacaucgucgaacgggaguauugcaaguccugcucgaaggaggacacgcaaaagugcgugaacaccaaacuagagcagccacaguccauccugaucgagcacaagggcaccaucaucgggaagcagaacaacacgugcaccgcgaaggccucuugcuggcuggaguccgucaagagcuucuucuacggccucaagaacaugcucgggggcaucuucggcaacgucuuuaucgggaucuucaccuuccugacccccuucauucugcugaucuucuucuucauguucggcuggcgcauccuguucugcuucaagugcugcagacggacccggggacuauucaaguaccggcacuuaaaggacgacgaggagacgggcuaccgcaagauuaucgagcggcugaacaauaagaagggcaagaaccgccugcucgacggagagcggcuggccgaccgcaagaucgccgagcuguuuuccacaaagacccacaucggcuaa

SEQ ID NO: 15287 - RNA, 5055 nt, Artificial Sequence
  derived and/or modified CDS sequence (opt11) from CCHFV(Afg09-2990)__HM452306.1__GP
augcauaucagccuaauguaugcgguguucugccuccagcuuugcgggcuugggaagacuaauggcccccacaacgggaccgagcauaacaacacgcacgucaugacuaccccggacgauagccagagccccgagccgcccguguccacggcccuccccgugacgcccgaccccuccaccguuaccccuuccaccccggcgagcggccuggagggguccggcgagguuuauacuagcucccccaucaccaccaagggccugagccuccccgaggccaccuccgagcccccggccacgacgagcguggucaccaguagcgccuccgacaccgacuccuccacgcaggccgccggggacaccccuacccccaccgugcgcacuagccugccguccagccccagcacccccuccacuucccaggggacccacuaccccgugcggucauuacucagcgucacgucccccaagccugaggaaaccccuacccccagcaaguccgguaaggacaaccuggcaaccaacagcccucacccggccacgucccgcccaaccacgcccccgaccaccgcacagaaaccgacagagaacaacagccauaacaccaccgaacagcuggagucccucacgcaccuggcgacccuggggagcaugaucucccccacccagaccgugcucccccagucggugaccuccauagcaauccaggauauccacaacuccccgacgaaccggagcaagcgcaacuuggacauggaaaucauccucacccucagccaggggcugaagaaauacuacggcaaaauccugaagcuccugcacuugacucucgaggaggacaccgagggccugcuugaguggugcaagcggaaccucgggcuagauugcgacgacacguucuuccagaagcgcaucgaggaauuuuucaucaccggcgaagggcacuucaacgaggucuugcaguuucgaacccucggcacccuguccacgaccgaaagcacacacgcgggaagccccaccguggagcccuucaaguccuacuucgccaaaggguuucugagcaucgacucgggcuacuucucugccaaaugcuacucccgcacgucgaacuccgggcuccagcugaucaacgugacccggcauagcacacgcauagcggacacccccggcccaaagaucacgaaccugaagaccaucaacugcaugaaccucaaggccuccgucuucaaggagcaucgggagguggagaucaacgugcugcuuccccaggucgccgugaaucucagcaacugucacguggccaucaagucccacaucugcgacuacagccuggacacugacggagccauccgccuaccacagauacaccacgagggcaccuucaucccuggcacguauaagaucgucaucgauaagaaauccaagcucaacgaccggugcacccuguucaccaacugcgugauaaaggggcgcgaggucagaaagggucagucuguccugcgacaauacaagacugagauccggaucgggcgagcguccgccggcucgcggcgccuccuguccgaggagagcggcgacgacuguauuagccggacgcagcugcuccgcacugagaccgccgaggugcacggcgacaacuacggcgggccgggggauaagauuacuaucuguaacgggaguacggucguggaccagcgccuggggagcgagcugggguguuacaccauuaaccgggugcgcuccuucaaacucugugagaacagcgccaccggcaaguccugcgagauagauagcaucccggucaagugcaagcagggauauugccucaagaucacccaggagggccguggccacgugaaguugagccgcggguccgaggucguccuggacgugugcgacuccagcugcgaagugaugauccccaaggggacgggcgacauucucgucgacugcuccggcggccagcagcacuaccugaaagacaaccugguggaccucgggugccccaagaucccgcugcugggcaagauggccaucuacaucugccggauguccaaccacccuaagacaacaauggcuuuccucuucugguucuccuuuggauacgucauuaccugcauccucugcaaggccaucuuuuuccugcuaaucauuuucggcacgcuggguaagcgcuucaagcaguaccgggagcugaagccccagacaugcacuauuugcgagacaacccccgucaaugccaucgacgccgagaugcacgaccucaacugcagcuacaacauuugcccguacugcgccucccgcuuaaccagcgacgggcuggcccggcaugugacccaaugcccccgccggaaggagaagguggaggagaccgagcucuaccugaaccuggaacgcauccccugggucgugcgaaaacuccugcaggucuccgagagcaccggcacgguacugaaacgcuccagcuggcucaucgugcugcugguccuuuucaccgucagcuugucacccgugcaaagugccccgaucgggcacggcaagaccaucgagaccuaccgggugcgugaggaguacacguccaucugccuguucguccucggcagcauccuuuucauagugucguuccugaugaagggccucguggauggcgucgguaacaucuucuuucccggccugagcguuugcaagaccugcuccaucgggagcaucaacggcuucgagaucgagucccacaagugcuacugcucgcuguucugcugccccuacugcagacauugcuccgccgacggugagauccaccagcuccaccugagcaucugcaagaagaggaaaaccggaagcaacgugaugcuggccguauguaaacgaaugugcuucagggcgacaauggaggugucgaacaaagcccuauucauccgguccaucaucaacacgaccuucguggucugcauacugauucuggccguguguguggugagcaccuccgccguggagauggagagccuccccgccggcaccugggagcgggaggaggaccuaacgaauuucugccaccaggagugccaggugacagagaccgagugccugugcccguacgaagcguuaguccugcgcagaccccuguuccuagacuccauuguaaaggggaugaagaaccugcugaacagcaccagccucgagacuucccugagcaucgaggcccccuggggagccauaaacgugcaauccaccuacaagccgaccgucagcacggcgaacaucgcccucagcuggagcuccgucgagcaccgagggaacaaggugcucgucagcggccgguccgagagcaucaugaagcuggaggagcgcacgggaaucaguugggaccucggcguggaagaugcuagcgaauccaagcuccuuaccgugagcgucauggaccugucccagauguacucgcccguguucgaguaccucagcggcgaccggcaaguggaggaauggccgaaggcuaccugcaccggggacugccccgagagaugcggcugcacgagcucuaccugccuacauaaggaguggccgcacagccggaacuggcgcuguaaccccacuugguguuggggcgucgggaccggcugcacgugcugcgggcuggacguaaaggaccucuucacagacuacauguucgucaaguggaagguggaguacaucaagacggaggccaucgucugcgucgagcugaccagccaggagcggcagugcucccugaucgaggccggcacgcgcuucaaccuaggaagcgugacaaucacucuguccgagccgcggaauauacagcagaaacugccaccggagaucaucacccuccacccgaagaucgaagagggcuucuucgaccugaugcauguccagaagguccugucugccuccacggucugcaagcuccagagcugcacgcauggggugcccggcgaucugcaggucuaccacaucggcaaccugcucaagggggacagggugaacggccaucugauccauaaaauagagcagcacuucaacaccaguuggaugucaugggacgggugcgaccuggacuacuacugcaacaugggcgacuggccauccugcaccuacaccgguguaacgcaacacaaccacgcgagcuuugucaaccugcugaacauagaaacagacuacaccaaaacuuuccacuuccacuccaagcgggugaccgcccacggugacaccccgcagcuggaccucaaggcacgccccaccuacggcgccggggagaucaccgugcucgucgagguggcggacauggagcuacacacgaagaagauagagaucagcggccucaaauucgccggccugaccugcaccggcugcuacgccugcuccagcgggaucaguugcaaggugcggauccacgucgaugagcccgacgaguuaacggugcauguuaagagcgaugaccccgacgugguggccgccuccagcucccucauggcgcggaagcuggaguucggcacggauagcaccuucaaggccuuuagcgccaugccgaagaccuccuuaugcuucuacaucguggagcgggaguauugcaagagcugcaguaaggaggacacccagaagugcgucaacacgaagcucgagcagccgcagagcauccugaucgagcacaagggcaccauuaucggaaagcaaaacaauaccugcaccgccaaggccuccugcuggcuggagagcguuaaguccuucuucuacggccucaagaacaugcuugggggaaucuucggcaacguguucaucgggaucuucacguuccugacccccuucauccugcucauucuguucuuuauguuuggcuggaggauccuguucugcuuuaagugcugccggcggacacgcggccucuucaaauacaggcaccugaaggacgaugaggaaaccggguaccgcaagaucaucgagcggcugaacaacaagaaggggaagaaccgccuccuggacggggagcgguuggcugaucgcaaaaucgccgagcuauucagcacgaagacgcacaucggcuga

SEQ ID NO: 15288 - RNA, 5055 nt, Artificial Sequence
  derived and/or modified CDS sequence (opt11) from CCHFV(SPU41/84)__AY900142.1__GP
augcacaucucacugauguacgcggugcugugccugcagcugugcggacuaggcgagacccacggcagccacaacgggacccgguacaacaauaccgacgcgacaacgacgcccggcgacucucagagccccgagccgcccgugagcaccgcguccagcaucacccacaacccguccaccgugaccagcaccacccccaccuccgggagcgaaggcuccggcgagguuuauacuagcucccccaucacgaccgaaggacuguccccacccgggaccacgcccgaacugcccgcaacgaccgggaucgacaccuccggcgccagcgacgcgaacccguccacccaggccgcgcgggggacuagcgccuuaacugugcauaccucccuucccagcagcccguccaccccgccaaucagccaggacacgcaccaccccgugcgcaaccugcucuccgugaccagccccaugcccgaggagacgaccgcgccauccggcaguggcaaggaguccagcgccacguccagcccccaccccgcgucggaccggccgcccacgccacccgccaccgcccaggggcugaccgagagcaacucccauaaugccacggagcaccuggagagccucacccaauccgccacccccggccuggucacuagccccgcgcaaacggugcacccccacucugcaacaucuauagcugcccccgacacacaucccaaccccaccaaucgcuccaagagaaaccuggaaauggagaucauccuuacucugagccaggggcugaagaaguacuacggcaagaucuuacguuugcugcaccucacccuggaggaggacaccgagggccugcucgaguggugcaaaaggaaucugggccuggacugcgacgacaccuucuuccagaaacgcaucgaggaguucuucaucacaggcgaggggcacuucaacgagguccuccaguuccggacaccgggcacagucuccacgaccgagucaacccacgcugggccgcccaccgccgagcccuucaagagcuacuucgcuaaggggucccugagcaucgacuccggcuacuacagcgcaaagugcuacuccgggacuagcaacuccggccugcagcucaucaacaucacgcgccacagcacgaagaucgccgacacccccggacccaaaaucacgaaccugaagaccaucaacugcaucaaccuaaaggcccucacuuucaaggagcaccgggagguggagaucaacgugcugcugccccaggucgcggugaaccucucgaacugccacguggugaucaagucucacgugugcgacuacucccuggacaucgacggaaccguucgccugccccacauccaccacgagggcaucuucaucccggguaccuacaagauaguaaucgacaagaagaacaagaugaacgaccggugcacccucuucacgaacugcgugaucaagggccgcgaggugcgcaagggccagagcguccugaagcaguacaagaccgagauccgaaucggcaaggccuccaccgggagccggcgccugcucuccgaggagucaagcgaugacugcaucucccggacccagcuccugcgcaccgagaccgccgagauccacggcgacaacuacgggggccccggcgauaagaucaccaucugcaacgggagcaccgugguggaccagcggcucggcucggaacuggggugcuacacuauaaaucgagucaagaccuucaaacugugcgagaacagcgcuacuggcaagucuugcgagauugacagcgugcccgucaagugccgacagggcuacugccucaaaaucacccaggaagggcggggccacgucaaacugucacgcggaagcgaggugguccuggacgccugcgacacguccugcgaagugaugauccccaagggcaccggggacauccugguggacugcucaggcggccagcagcacuuuuuaaaggacaaccugaucgaccuggggugcccuaagaucccccucuuggggaagauggccauuuacaucugccgcaugucgaaucaccccaagaccaccauggccuucuuauuuugguucagcuucggguacgucaucacgugcaucaucugcaaagugauuuucuaccugcuuauaaucguuggcacccuggggaagcgcuucaagcaguaccgggagcucaagccccagaccugcaccaucugugaaacuacgccggucaaugccaucgaugcugaaaugcacgacuugaacugcuccuacaacaucugccccuauugcgcgagccgccugaccuccgacggcuuggcucggcacgugacccagugccccaagcgcaaggagaagguggaggagacagagcuguaccugaaccucgagcggaucccauggguagugcgaaagcugcuccaggugagcgaguccacaggcgucgcccugaagagaagcucaugguuggugguacugcucguccuguuaaccguuagcuuaucgcccguccaauccgcccccaucagccauggaaagaccgucgaggccuaccgcgcgcgggagggcuacaccucgaugugccuguucguacugggaagcguccuauuccucgucucgugccugaugaagggccucguggacagcguggggaacacauucuuccccggccuguccaucugcaagaccugcagcaucuccagcaucaacggcuucgagaucgaaagucacaggugcuacugcagccuguucugcugccccuauugccgucacugcagcgccaauaaggagauccaccaguuacaccugagcauuugcaagaagagaaaggccggcucgaacgucaugcuggccguaugcaaacggaugugcuuccgcgccacuauggaggugagcaacagagcccucuuuauccgcuccaucauaaacaccacauucguccugugcaucuuaauccucgccgccugcguggugucgaccuccgccguggaaauggagagccugccugccggaaccugggaacgcgaagaggacuuaacuaacuucugucaucaggagugccagguggcggacacagaaugccucugcccuuacgaggcgcugguucuccggcgaccccucuuccuggacagcauugugaaggggaugaagaaccuacucaacuccacuucgcucgagaccucucugagcaucgaggccccguggggagccaucaacguacaguccaccuacaagcccacggugaguacugcgaacaucgcccuuuccuggagcuccgucgagcauagagguaacaagauccuggugagcggccgcagugaaagcaucaugaagcuggaggagcggaccggcaucaguugggaccucggaguugaagacgcuagugaguccaagcugcucaccgucagcgugauggaccucucccagauguauucacccguguucgaguaccuguccggcgaccgucaggucgaggaguggcccaaggccacgugcacuggggacugcccagagcggugcgguugcaccagcuccacgugccuccacaaggaauggccccacuccaggaacuggcggugcaaccccaccuggugcuggggcguggggacuggcugcacgugcugcgggcucgacguuaaggaccuguucaccgauuauauguucgucaaauggaaggucgaguacaucaagacggaagccaucguaugcgucgagcugacgagccaggagcgccagugcucccucaucgaggcgggcacccgguuuaaccuggggcccgugaccaucacgcugucagagccgcgcaacauccagcagaaacuuccacccgaaaucaucacgcugcacccccgaaucgaggagggcuucuucgaucugaugcauguccagaaggugcucuccgcgagcaccgugugcaagcugcaguccugcacccacggcgucccgggagaccuccagguguaccacaucggaaaccuccugaagggggacaaggugaacggccaucugguccacaagaucgagccccacuucaacaccucauggauguccugggacgggugugaccucgacuacuauugcaauaugggcgacuggcccagcugcacguacaccggcgucacccagcauaaccaugccuccuuuguuaacaugcugaacauugagaccgacuacacgaagaacuuccacuuucacagcaagcguguaacagcccacggggacaccccgcagcuggaucucaaggcccgaccgaccuacggcgcgggugagaucaccgugcugguggaggucgcagacauggaguuacacaccaagaaaaucgagauuuccggacugaaguucacaagucugaccuguacggggugcuacgccuguuccagcggaaucuccugcaaggugcggauccacguggacgaaccugacgagcugaccguccacguuaagucggaagacccggacguggucgccgccucgagcagccugauggcgcggaagcuggaguuuggcaccgacuccaccuucaaggccuucagcgccaugcccaaaacgucccugugcuucuauauuguggagcgugaguacugcaagagcugcagcgaggaggacacccagaagugcgugaacaccaagcucgagcagccacaaagcauuuugaucgagcggaagggaaccauuaucggcaagcagaacaacacguguaaggcaaaggccgggugcuggcuggaguccgucaagagcuucuucuacggccucaaaaacaugcucuccggcaucuucgggaaugucuuuaucgggauauuccuguuuuuagcccccuucauccuacuaauccuguucuucauguucggguggcgcauccucuucugcuucaaaugcugccggcgcacucgcggccuauucaaguaccggcaccugaaggacgacgaagagaccggguaucgcaaaaucauugagcgguuaaacaacaagaaaggcaaaaacaagcugcucgacggagagcgccucgcggaucgccgcauagccgagcuguuuagcaccaaaacgcacaucggguaa

SEQ ID NO: 15289 - RNA, 5055 nt, Artificial Sequence
  derived and/or modified CDS sequence (opt11) from CCHFV(SPU103/87)__DQ211634.1__GP
augcacaucagccucauguacgccgugcucugccugcagcugugcggccucgggggcgcccaugggucccacaacggcacccgcuacaacaacaccggggcgcucacgacacugggcgacggccaguccuccgagccuccggucucaaccgcccccuccaccacgcauaacccuagcacagugacuucgaccacgcccgccagcggguccgagggcagcggggagguguauaccgccucgccagugaccaccgagggccucucuccgcccgggacgacccccgagcugcccgccaccaccggcaucgacacgucaggugcauccgacgccgaccccucuacccaggcagccggggacacauccgcgcugaccgugcggaccucccucccaagcucccccagcacccugccgaccagccaggauacacaccaccccguucgcaaccugcucuccgucaccucgccccggcccgaggaaacaacagccccguccggcucagggaucgaguccagcgccaccuccagcccacacccggccuccgaccgucccccgacgccgcccgcagcggcccagggccccaccgagagcaacucccacaacgccaccgagcaccuggagucucugacccagagugccacgcccgaccucgugaccagucccgcccagacagugcacccccaguccgcgaccagcaucgccgcccccgacacgcauccuucccccaccaaccgcagcaaacgcaaccuggaagucgagaucauacugacccucucccagggccugaagaaauauuacgggaagauccugcgccuucugcacuugacccucgaggaggacaccgaaggccugcuggaguggugcaagaggaaccucgggcuggacugugaugacacguucuuccagaagcguauagaggaguucuucaucaccggcgaggggcacuucaacgaggugcugcaguuccgcaccccaggcaccgugagcacgaccgaaagcacccacgcgggcccgcccaccgccgaacccuucaaaagcuacuucgcgaagggcuuccuaagcaucgacuccggauacuacagcgccaagugcuacuccgggacgucaaacaguggccugcagcugauuaacauaacuagacacagcacccgcaucgccgacacccccgggcccaagaucacgaacuuaaagaccauuaacugcaucaaccugaaggcccuuaccuucaaggagcacagagaaguugagauaaacguucuccuuccccaaguggccguaaacuuauccaacugccacguggugaucaagagccaugucugcgacuacucccucgacaucgacgggaccguacgccugccucacauccaccacgagggcaucuucauccccgggacguacaagaucgucaucgacaagaagaacaaacuuaacgaccggugcacccucuucaccgacugcgucaucaagggcagggaggugcggaaggggcaaagcguucucaagcaguacaagaccgagauccggauuggcaaggcguccacggggagccggcgccugcucuccgaagagucguccgacgauugcaucagccggacccaguugcugcgcaccgagaccgccgagauucacggcgacaacuacggcgggccgggcgacaagaucacgaucugcaacgggagcaccaucgucgaccaacgccucggcuccgagcugggcuguuacaccaucaaccgcgugaagaccuucaagcugugugagaauagcgccacgggaaaguccugugagaucgacagcgucccugugaagugcaggcagggcuacugccugaagaucacucaagaggggcggggccacgugaagcuaucccgcgggagcgaggucgugcuggacgccugcgacaccuccugcgaggugaugauccccaagggaaccggcgauauccugguggacuguagcgggggccagcagcauuuccucaaggacaaccugaucgaccuggguugccccaagaucccccuccuaggcaagauggcaaucuauaucugucggauguccaaccaccccaagacgaccauggccuuucuguucugguucagcuucggguacgugauuacgugcgugcucugcaaggccaucuucuaccugcugaucaucguuggcacccucggcaaacgccugaagcaauaccgggaacugaagccgcagacgugcaccaucugcgaaaccacccccgugaacgccaucgacgcugagaugcacgaccucaacugcuccuacaacaucugcccguacugcgcgagccgccugaccuccgacgggcuagcgcggcacgugacgcagugccccaagcgcaaggagaaggucgaagagaccgaacucuaucugaaccuggagcggauccccuggguggugcgccggcuccugcaggucagcgaauccacgggcguugcccugaagcggagcuccuggcuuaucguucugcugguccucuucaccgugagccugucccccgugcagagugcaccgaucagccacggcaaaacggucgaggccuaccaggcgcgcgaggguuacaccgguaugugccuguucgugcuaggcagcauccuguuccuggugagcugcuugaugaaaggccuggucgacuccguggggaacaccuucuuccccggacugagcaucuguaagacuugcuccaucagcuccaucaacggguucgagaucgagucgcaucgcugcuauugcucccuuuucugcugccccuacugccggcacugcagcgccaacaaggagauccaucagcugcaccuuucaaucugcaagaagagaaagacgggcagcaacguaaugcucgccgucugcaagcggauguguuuccgugccaccauggagguguccaaccgcgcccuguucauccggaguaucauaaacaccaccuucgugcugugcaucuuaauccuggcggucuguguggugucgacgagcgccgucgagauggagucccugcccgccgggaccugggagcgcgaagaggaucucaccaacuuuugucaccaggagugccaggugaccgacacggagugccuguguccguacgaggcccuggugcuacggcgcccccuguuccuggacaacaucguuaaaggcaugaagaaccuccugaacagcacgucccuggaaaccagccucagcaucgaagcgcccuggggcgccaucaacgugcaguccacauacaaaccgacggugucaaccgccaacaucgcucugagcuggagcuccgucgagcaccgggggaauaagauccuggugagcggccgcuccgagagcaucaugaagcucgaggagcggaccgggauuuccugggaccugggcguagaggacgcuagcgaguccaagcugcucaccgucagcgugauggaccuaucccagauguacagccccguguucgaauaccuguccggcgaccgccaggucgaggaguggccgaaggcaacgugcaccggggacugccccgagcggugcggcugcaccucuuccacgugucuacacaaagaauggccgcacucucgcaacuggcggugcaaccccaccuggugcuggggcguggggaccgggugcacgugcugcgggcuggacguuaaggaccuguucaccgacuacauguucgucaaguggaagaucgaguacaucaaaaccgaagccauaguguguguggagcucaccagccaagagcgccagugcagccuuaucgaggcuggcaccagauucaaucuggggcccgucaccaucacgcucagcgagccccgcaacauacagcagaaacugccguccgagaucaucacccugcacccccggaucgaggagggguucuuugaccucaugcacgugcagaagguccugucagccuccaccguguguaagcugcagagcuguacccacggggugcccggugaccuccaggucuaccacaucgguaaccugcugaagggggacaaggugaacggccaccucgugcacaagaucgagccgcacuuuaacacauccuggaugucaugggaugggugcgaccuggacuacuacugcaacaugggcgacuggccgaguugcacguacaccggggucacccagcacaaccacgccucauucgugaaccuacucaacaucgagaccgacuacacgaagaacuuccauuuccacuccaagcgcgugaccgcgcacggcgauacgccccagcuggaccugaaggcccggcccaccuacggugccggcgagaucaccguccucguggaaguggccgacauggagcugcacaccaagaagaucgagaucagcggccugaaguucaccucccugaccugcacggggugcuacgccugcucguccggcaucagcugcaagguccggauccauguggacgagcccgacgaguuaaccgugcacgucaaguccgacgaccccgacgugguggcggccucguccagccugauggcccggaagcuagaguuugggaccgacucaacuuucaaggccuucuccgcgaugcccaagacgagccugugcuucuacaucgucgagcgcgaguauugcaaauccuguagugaggaagacacucagaagugcgugaacaccaagcuggagcagccccaguccauccucaucgaacacaagggcaccaucauuggcaaacagaacaauacuugcaaagcccgagccgggugcuggcucgagagcgugaaguccuucuucuacggccugaagaacaugcugagcgggauauucggcaacguuuucaucgggauauuucucuuccuggccccguuuauccugcuaauccuguuuuucauguuuggcuggcgcaucuuauucugcuucaagugcugccgccggacccgcggccuuuucaaauaccggcaccuuaaggacgacgaggagaccggguaccgcaagauuaucgagcggcugaacaacaagaagggcaagaacaagcuccuugacggggagcgccuugccgaccgccguaucgcggagcuuuucuccaccaagacgcacaucggauga

SEQ ID NO: 15290 - RNA, 5055 nt, Artificial Sequence
  derived and/or modified CDS sequence (opt11) from CCHFV(Iran-53)__DQ446216.1__GP
augcacaucagucugauguacgccguguucugucuccagcugugcggccuggggaagaccaacggcccccacaacgggaccgagcacaacaacacgcacgucaugaccaccccggacgacucccagagccccgagccgccagugagcaccgcccuccccgugacgcccgaucccagcaccgucacccccuccaccccggcgagcggucuggagggaagcggcgagguguacacgagcucccccaucaccaccaaggggcuaucucuccccgaggcuaccuccgagcccccggccacgaccagcguggucaccuccagcgccuccgacaccgacagcuccacacaggccgccgggggcacccccacccccaccguucggacgucucugcccuccagcccaagcacccccuccaccagccaggggacccacuaccccgugcggucccugcucagcgucacgucccccaagccggaggagacccccacccccuccaaguccggcaaggacaaucuggccaccaacagcccccacccggccacgucccgccccaccgccccgcccaccaccgcccagaagcccacggagaacaacucccacaacaccaccgagcagcuggagucccucacccaccuggccacgcuggggucgaugaucucccccacccagacagugcucccccagucugugaccuccaucgccauccaagacauccacacaagcccgacgaaucgguccaagcgcaaccuggacgucgagaucauccugacccucucccagggccugaagaaguacuacggcaagaucuugaaguuacugcaccugacucucgaggaggacaccgagggccugcuggaguggugcaagcggaaucucggccuggacugcgacgauacguucuuccagaagcgcaucgaggaguucuucaucaccggggaaggccacuucaacgagguguuacaguuccgcacccucggcacccuguccacgaccgagagcacccacgccgggagccccaccguggagcccuucaagaguuacuucgccaagggcuuccugagcaucgacuccggguacuucagcgcgaaaugcuacucccgcacgagcaacuccggccuccaguugaucaacgugaccagacacagcacccgcaucgccgacacccccgggccgaagaucacgaaccugaaaaccaucaacugcaucaaccucaaggccuccguuuucaaggagcaccgggagguggagaucaacgugcugcugccccagguggcagugaaccucagcaacugucacgucgccaucaagucccacaucugcgacuacagcuuggacaccgacggcgcgauccgccugccccagauccaccacgagggcaccuucauccccgggacguacaagaucgugauagacaagaaguccaagcucaacgaccggugcacccucuucaccaacugcgugaucaaggggcgcgagguccggaaggggcaaagcgugcugcgccaauacaagaccgagauccgcaucggccgcgccuccacggggagccggaggcucuuauccgaggagagcggcgaugacugcaucagccggacccaacuucuccgcaccgagaccgccgagguccacggcgacaacuacgggggcccuggggacaagaucacgaucuguaacggcuccaccgugguggaccagcgccuggggagcgagcugggcugcuacaccaucaaccggguccgcucauucaagcugugcgagaacucugccaccggcaaguccugcgagaucgacagcauacccgugaagugcaagcagggguacugccucaagaucacgcaggagggcagagggcacgugaagcugucccgcggcagcgagguagugcuggacgucugcgacuccagcugcgaggucaugauccccaagggcaccggggacauccucguggacugcuccggcgggcagcagcacuuccugaaggauaaucugguggaccucgggugccccaagaucccgcugcuggggaagauggccaucuacaucugccggaugagcaaccaccccaagaccacuauggcguuccucuuuugguucuccuucggcuacgucaucacgugcauccugugcaaggccaucuucuuccugcucaucaucuuuggcacccuggggaagcgcuucaagcaguaccgggagcugaaaccccagaccugcaccaucugcgagaccacgcccgugaacgccaucgacgccgagaugcacgaccucaacugcagcuacaacaucugcccguacugcgccucccgccugacuagcgacggccuggcgcggcacgugacacagugcccccgccggaaggagaaggucgaggagaccgaacucuaccugaaccuggagcgcauccccuggguggugcggaagcuccugcaggucuccgagagcacgggaacugugcugaagcgauccagcuggcucaucgugcuacucguccucuucaccgugagccugucccccgugcagagcgccccuaucggccacgggaaaaccaucgaaaccuaucggguccgcgaagaguacaccuccaucugccuguucgugcucggcagcauccuguucaucguguccuuccugaugaagggccucgucgacgggguuggcaacaucuucuuucccgggcugagcgugugcaagaccugcuccaucggcagcaucaacggguucgagaucgaaucacacaaguguuacugcagcuuguucugcugccccuacugccggcauugcuccgccgauggcgagauccaccagcuccaccugucaauaugcaagaagcgcaagaccggcuccaacgucaugcuggccgugugcaagcggaugugcuucagggcgacgauggaggugucgaauaaggcccucuucauccgcuccaucauuaacaccaccuucgucguguguauccugauccuggccgugugcgucgucagcaccuccgccguggagauggaaagccucccggccgggacgugggagcgggaggaggaccugaccaacuuuugccaccaggaaugccaggucacggagaccgaaugccugugcccauacgaggcgcucguucugcgacggccccuguuccucgacuccauugugaagggcaugaagaaccugcugaacucuacgucucuggagacaucccugagcaucgaggccccuuggggcgccauuaacguccaguccaccuacaagccgaccgugagcacggccaacaucgcccuguccuggagcuccguggaacaccgcgggaacaagguccucgugagugggcgguccgagagcaucaugaagcuggaggagcgcacaggcaucuccugggaccugggcguggaggacgcgagcgaguccaaguugcugacagucagcgugauggaccugucucagauguacucacccguguucgaguaccucuccggugaccggcaagucgaggaguggcccaaggcgacaugcacgggcgacugccccgaacgaugugguugcaccagcagcacgugccugcacaaggaguggccgcacagccggaacuggcgcugcaaccccaccugguguuggggcguggguaccggguguacgugcugcggccuggacgucaaggaccucuuuaccgacuacauguucgugaaguggaagguggaguacauaaagaccgaggccaucgucuguguggagcugaccagccaggagcggcaaugcagucugaucgaggccgggacccgcuucaaccucggcagcgugaccaucacccuguccgaaccccggaacauacagcagaagcugcccccggagaucaucacccuccaccccaagauugaggaaggguuuuucgaccugaugcacguccagaaggugcugagcgcauccacggugugcaagcuccagagcugcacacacggcguccccggcgaccuccagguguaccacaucgggaaccugcucaagggcgaccgcgugaacgggcaccugauccacaagaucgagcagcacuucaacaccuccuggaugagcugggacggcugcgaccuggacuacuacuguaacaugggggauuggcccucgugcaccuacacgggcguaacccagcacaaccacgcgagcuucgugaaccuccugaacaucgagaccgacuacaccaaaacuuuccacuuccacuccaagcgggugaccgcccacggcgacaccccgcagcuggaccucaaggcccgccccaccuacggggccggcgaggucacggugcugguggaggucgcugacauggagcugcacaccaagaagaucgagaucuccgggcucaaguucgcgggccugaccugcaccgggugcuacgcaugcucgagcggcaucagcugcaaggugcggauccacguggaugagcccgacgagcugacgguccacgucaagagcgacgaccccgaugugguggccgccuccagcucccucauggcgcgcaagcuggaguucggcaccgacagcaccuucaaggcauucagcgccaugccaaagaccucccugugcuucuacaucguggagcgggaguacugcaagagcugcuccaaggaggacacgcagaagugcgugaacaccaagcucgagcagccccaguccauccugaucgagcacaaggggaccaucauaggcaagcagaacaacacgugcaccgcaaaggccagcugcuggcuggagagcgucaaguccuucuucuacggguugaaaaacauguuaggcgggaucuucgggaacguguucauaggcaucuucaccuuccugacccccuuuaucuuacucaucuuauucuucauguucgguuggcgcaucuuauucugcuucaagugcugccggcgcacccgcggccucuucaaguaccggcaccuaaaggacgaugaggagacgggauaccgcaagaucaucgagcggcugaacaacaagaagggcaagaaccgccuccuggacggcgagcggcuggcggaccgcaaaaucgccgagcuguucagcaccaagacccacaucggguga

SEQ ID NO: 15291 - RNA, 5055 nt, Artificial Sequence
  derived and/or modified CDS sequence (opt11) from CCHFV(Iran-52)__DQ446215.1__GP
augcacaucagccugauguacgccguguucugccuccagcuguguggccuggguaaaaccaacggcccacacaacgggaccgagcacaacaacacgcacguuaugacuaccccggaugacucacagagccccgagccgccaguuuccacugcccuccccgucacucccgaccccagcacagucaccccaucuacccccgcgucgggccuggagggguccggcgagguguauacgagcucccccaucaccaccaaaggccugagccugcccgaggccaccucagagccgccggcaacgaccagcgugguuaccuccagcgccuccgacacugacagcuccacgcaagccgcgggcgacacccccaccccaaccgugcgcacgagccugccauccucaccguccacgccauccaccagccaggggacccacuaccccgugcggagucugcucagcgucacguccccuaagccggaggagacgcccaccccgagcaaaucgggaaaagacgaccucgcuacaaacagcccgcauccggccacgagucgccccacaaccccacccaccacggcacagaagccaaccgaaaacaacagccacaacaccaccgagcagcuagagucccucacgcaccuggcgacccugggccucaugaucagccccacgcagaccgugcugccucagucugugaccuccaucgcaauccaggacauccacaacuccccgacaaaccgaucuaagcguaaccuggacauggagauaauacucacccugucccagggguuaaagaaguacuacggcaaaauccucaagcugcugcaccucacccuggaggaagacaccgagggccugcucgaguggugcaaacggaaucuggggcuagacugcgacgacacguucuuucagaagcggaucgaagaguucuuuauuaccggagagggucauuucaaugaggugcuccaauuucggacccuggguacccuguccacgaccgagucuacccacgccggaagccccaccguggagcccuucaaguccuauuucgccaagggguuccucagcaucgacaguggauauuucuccgcuaagugcuauagccgcacgaguaacagcggccuccaauugaucaacguuacccgacacuccacccgcaucgcggacacucccggcccgaagaucacgaaccucaagaccaucaacugcaugaaccugaaagccagugucuucaaagagcaccgggagguggagaucaacgugcugcucccgcaggucgccgugaaucuuuccaacugucauguggccaucaaaagccacauuugcgacuacucccuggacacggacggugcgauccgacucccccagauccaccacgagggcacauuuauccccggcaccuauaagaucgucaucgacaagaaguccaagcugaacgaccggugcacccuguucaccaauugcgugaucaaggggcgcgaggugcggaaggggcagagcguccuccgccaguacaagaccgagauccggaucgggcgcgcuagcacgggcucccgacgguuacugagcgaggaguccggggacgauugcaucucccggacccagcuccugcgcaccgagaccgccgaagugcacggcgacaacuauggcggcccgggcgacaagaucacaaucugcaacgguagcaccguaguggaccagcgccugggcuccgagcuggggugcuacaccauuaaccgggugcgcagcuucaagcucugcgagaacucugcaaccggcaagucuugcgagauugauuccauacccgucaagugcaaacaaggcuacugccugaagaucacgcaggaagggcggggacacguaaagcugagcagaggguccgaggucguucucgacgugugcgauagcuccugcgaggucaugauccccaagggcaccggggauauccuugucgacugcagcgggggccagcagcacuuucuuaaggacaauuuaguggacuuagguugccccaaaaucccucugcuugguaagauggccaucuauaucugccggaugaguaaccaccccaagaccaccauggccuuccuguucugguucucguucggguacguuauuaccugcauccugugcaaggcuaucuucuuccuccugaucauuuucggcacccugggcaagcgcuuuaagcaguaccgagagcuaaagccccagaccugcaccaucugcgagaccaccccugucaaugccauugaugccgagaugcacgaccugaacugcuccuacaacaucugcccguacugugccucgcgccuaaccuccgacggacucgcacggcacguaacccagugcccaaggcggaaggagaagguagaggagaccgagcuguaucugaaccuugagcgcauucccugggucgugcggaaacugcuccaggugagcgaguccacgggcacgguccucaagcguagcucuuggcuaaucguacugcucgugcuguucacagucagccugagcccggugcaguccgcgccgaucggccacggaaagacaaucgaaacguaccgggugcgcgaggaguacaccucaaucugcuuguucguccugggcucgauccuguucauugugagcuuccuuaugaaaggccugguggacggagucgggaauaucuucuuccccggccuguccgugugcaagaccugcagcaucgggucaaucaacggcuucgagaucgagagccauaaauguuauuguucgcucuuuugcugcccguacugccggcacugcagcgcugacggagaaauacaccagcugcaccuguccaucugcaaaaagcgcaaaacaggcuccaacguaaugcuggccgucugcaagcggaugugcuuccgcgccacgauggagguauccaacaaggcgcuguuuauccgcaguaucaucaacaccaccuucguaguaugcauccucauacucgccgugugcguggucuccacaagcgccguggagauggaaucccuccccgccgggacgugggagcgggaagaggacuuaaccaacuucugccaccaggagugccagguuaccgaaaccgagugcuuaugcccguacgaggcccugguccuccgccggccgcucuuucuagacagcaucgugaaggggaugaagaaccugcucaauuccacgucgcuagagacaagccuguccaucgaggcgcccuggggcgccaucaacgugcagucuaccuacaagccgacugucuccacagccaacaucgcccucagcugguccagcguggaacaccgcgggaacaaagugcuagucucaggccggagcgaguccaucaugaagcuggaggaacgaaccggcaucucuugggaccucgggguagaggacgccuccgagagcaagcugcugaccguguccgucauggaucucagucagauguacucccccguguucgaguaucuuagcggcgaccgacagguggaggaguggccuaaggcgacgugcacgggggacugccccgagcgcugcggcugcaccuccagcacgugccuacacaaggaguggccgcacucgcgcaacuggcgcuguaaccccacguggugcuggggcgucgggacaggguguacgugcugcggccucgaugugaaggaccuguucaccgacuacauguucgucaaguggaagguggaguauaucaagaccgaggccauagugugcgucgagcugaccagccaggagcggcaaugcucccucaucgaggccggcacccgcuucaaccugggcuccgugaccaucacccugagcgagccccggaacauccagcagaaguugcccccggagauaaucacccugcaccccaagaucgaggaaggcuucuucgaccugaugcacguucagaagguacucuccgccagcacgguguguaagcugcaguccugcacccacggggugcccggagaccugcagguuuaccacaucggcaaucuccugaaaggggaccgcguuaacggccaccucauccauaaaaucgaacagcauuucaacaccagcuggauguccugggacgggugcgaccucgacuacuacugcaauaugggcgacuggcccagcugcaccuacacggguguaacccagcacaaccacgccuccuucgucaaucugcugaacaucgagaccgacuacaccaagacuuuccauuuccacagcaagcgggugaccgcgcacggcgauaccccgcagcucgaucuaaaggcccgccccaccuauggcgcgggggagaucacaguccuggucgagguggcggauauggagcuccacaccaagaaaaucgagaucuccgggcugaaauucgcgggucugaccugcaccggcugcuacgccuguagcucuggaaucuccugcaaggugcggauccauguugaggagcccgacgagcucacggugcacguuaagucugacgaccccgacguaguggccgccuccuccagccugauggcccgcaaauuggaguuugggaccgauuccaccuuuaaggcguucagcgccaugccgaagaccagccucuguuuuuacaucguggagcgggaguacugcaagucgugcagcaaggaggauacgcagaagugcgucaacaccaaacuagagcagccccaguccauacugaucgaacacaagggcacgauaauaggaaagcagaacaauacgugcacggccaaagccagcuguuggcucgaaucagucaagagcuucuucuacggccugaagaauaugcucgguggcaucuuuggcaacgucuucaucgguaucuucaccuuccugacccccuuuauccugcugauccuguucuuuauguucggcuggcgcauacucuucugcuucaagugcugccggcguacucgcgggcuuuucaaguaccgucaccuaaaggaugacgaggagacgggcuaccgcaagaucaucgagcggcucaacaacaagaaggggaagaaccgccugcuggacggagagcggcucgcagaccgaaagaucgcggaguuguucuccaccaagacgcacauaggauga

SEQ ID NO: 15292 - RNA, 5055 nt, Artificial Sequence
  derived and/or modified CDS sequence (opt11) from CCHFV(75024)__AB069671.1__GP
augcacaucagccucaugugcgccgugcucugccugcaguuguacgggcugggggagacccacgggucgagcaacgagaccgagcacaacaaaacaaauguagucaccaccccgggcgacucccagagcccggagccgcugguguccacuaccuuacccguuaccuuggauuccuccaccguaacccccaccacccccgccucgggccccgagggguccggagagguguacaccuccccgcccaucaccaccgagggccuuuccccgucggaggccaccuccgaguuacccgcgaccaccgggaucggcaucagcuccgccucugacgucgacuccucgacacaagcggccggggacacguccacccccacagugagaaccucgccacccaacagcuccagcacgccgcccaccucccaggacacccaccauccgaugcggaaccuccugagcgugaccucccugaagcccgaggagaccagcgcucccuccaagagcggcaaggagucccccgcugccagcagcccccacccaguagccucccggccacccaccccacccaccacugcgcaggggcccauugagaacaacucccacaacaccaccggccagcuggaaucugugacccaguccgcuacgcuaggucccauggcaucucccacccagaccgugcugucacagaacgucaccaguaucgccauccaggacacccaccccucccccaccaaccggaguaagcgcaaccucgagauggagaucaucuuaacccugccccaggggcucaagaaguacuacggaaagguucuacggcugcuccagcugacccuggaggaggacacugaggggcuucuggaguggugcaagcgcaaccugggccuggacugcgacgacacuuucuuccagaaacggaucgaagaauuuuucaucaccggcgaggggcacuucaacgaggugcugcaguuccgcacccccggcacgcugaguacgacugaguccacccaugccgagucacccaccgcggagcccuucaagucuuacuuugccaagggguuuuugagcaucgacuccggcuacuuuagcgccaaguguuauucgcggacaagcaacucagggcugcagcugauaaacgucacccgacacuccacccggaucgccgacacccccgguccgaagaucacgaaccuaaagaccauuucuugcaucaaccugaaggccagcguguucaaggagcaccgagagguggaaauuaauguccugcucccccaaguugcggugaaccuguccaacugccacguuaccaucaagagccacgugugugacuacucccuggacaucgacggcaccguccgccuaccccacauccaccacgagggcaccuucaucccuggaaccuacaagaucgucaucgacaagaaaaacaaacuuaacgaccggugcacccuguucaccaacugcgugauaaaggggcgugagguccgcaagggucagagcgugcuccggcaguacaagacggaaauccgcaucgggaaggccuccaccggcagccgucgccugcugagcgaggaaucuggcgacgacugcaucagccggacccagcucuuacgcaccgagacggcugagauccacggagacaacuacggcgggccgggcgacaagaucaccaucugcaacggguccaccauuguugaccaacgccugggcagcgagauggguugcuacaccaucaaccgggucaagucuuucaaacucugcgagaacagcgccacgggcaaguccugcgagaucgacagcaucccggucaaaugccgccaggguuacugccugaaaaucacccaggaggggcggggccaugugaaauugucccgcggcagcgaggucguucuggacgccugcgacucaagcugcgaggugaugauccccaaagggacaggcgacauccucgucgacugcuccgggggccagcagcacuuccugaaggacaaccugaucgaucucgggugcccuagcaucccgcuacugggcaagauggcgauauacaucugucggauguccaaccaccccaagaccacgauggccuuccuguucugguucagcuucggauacgucaucacgugcauccuaugcaaggccaucuuuuaccugcucauuauuguggggaccuuaggcaagcgauucaagcaguaccgggaguuaaagccccagaccuguacgauuugcgaaaccacccccgccaacgccaucgacgcggagaugcacgaucucaacugcuccuacaacaucugcccguacugcgcaagccgccugaccuccgacgggcuggcccggcacgucacccagugcccaaaacgcaaggagaagguggaggagacggagcucuaccugaaccuggagcgaauccccugggugguccgcaagcuccuacaagugagcgagaguaccggcguggcccugaagcgguccagcuggcucaucguccuucuaguucucuucgccauuucucugucacccgugcagagcgccccgaucgggcacggaaaaacgauagagacuuaccaggcccgcgaggaguauacgucuaucugucuguucguccucggcucgauccuguucaucgugagcugucugaugaaggggcucguggacuccaucggcaacaucuucuuucccgggcugagcauaugcaagacgugcuccauuggcagcaucaacggguucgaaaucgaaucccacaagugcuacuguagcuugcucuguugcccguacugccggcacugcuccgccgaccgcgagauccaucagcugcaccugagcauauguaagaagcggaagaccggcuccaacguuaugcucgccguaugcaagcgcaugugcuuccgggcgaccauggaggugucaaacaaggcccugcuaauccgcuccaucaucaacacgaccuucgucguuugcauccucauccuagccguguguguagugagcaccagugcuguggagauggagucccugcccgccgguaccugggagcgcgaggaggaccucacgaacuucugccaccaggagugccaggucaccgagaccgagugccuuugcccguacgaggcacuggugcuucgcagaccacuguuccuugacagcauagugcgggggaugaagaaccagcucaauucgaccucccuggagacgucccucagcaucgaggcccccuggggcgccaucaacguccaguccaccuacaagccgacggugaguacagcuaacaucgccuuaaguuggagcuccgucgagcacagaggcaacaagauucugguuagcggccgcucggagagcaucaugaagcuggaggaacgcacggggauauccugggaccucggcguggaggacgcgagcgaguccaagcugcugaccguguccgucauggaucucucccagauguacucacccgucuucgaguaccugagcggcgaccgccagguggaggaguggcccaaggcgaccugcacaggggacugcccugagagaugcggcugcacgaccagcacgugccugcacaaagaguggccgcacucccggaacuggcgcugcaauccgacguggugcuggggcgucggcaccggcugcacuugcugcggacucgaugugaaagaucuguucaccgacuacaugaucgugaaguggaaagucgaguacaucaagaccgaggccaucguuugcguggagcugacgucccaggagcggcaguguagucucaucgaagccgggacccgcuucaaccugggaagugucacuaucacgcugagcgagccacggaacauucagcagaagcucccgcccgagaucaucacacugcacccucgcauagaagagggcuucuuugaucugaugcaugugcagaagguccucuccgcgagcaccguaugcaaauugcaaucuugcacgcacggcgugcccggggaccugcaagucuaccacgugggcaaccuauuaaagggggacaaggugaauggccaccugauccacaagaucgagccucaccuaaacaccucguggaugucgugggacgggugcgaccuggacuauuauugcaacaugggcgacuggcccagcugcacauacacgggggucacccagcacaaccacgccucguucgugaaccugcugaacaucgagaccgacuacaccaagucguuccacuuccacuccaagcgggugacugcccacggcgacacgccccagcucgaccugaaggcccgccccaccuacggcgccggggaaauaaccguccucguggagguagccgacauggaguucacccccaaaaagaucgagaucagcggccuuaaauucgccuccuugacgugcaccgggugcuacgccugcagcuccgguaucagcuguaaaguacgcauccacguggacgagccggaugagcucaccguacacgucaagagcgacgacccagaugugguggcggccuccagcucccugauggcgcgcaaguuggaauuugggacggacagcacauucaaggccuucucagcgaugcccaagaccucauuaugcuucuacaucguagagcgggaguacugcaagagcugcaguaaggaggacacccaaaagugcgugaauacgaagcuggagcagccccagucaauucugaucgagcacaagggcaccaucauaggcaagcagaacaacacgugcaccgccaaggccagcugcugguuggaguccgucaagagcuucuucuacgggcuuaagaacaugcucuccggcaucuucgggaacuuguucaugggcaucuuccuguuccucgcgccguucauccuucucauauuguuuuucauguuuggcuggcgcauccuguucugcuucaaaugcugccggcgcacgcguggucuauucaaguaccggcauuugaaggacgacgaagaaaccggcuaccggcggaucaucgagcgccugaacaacaagaaagggaaaaacaagcucuuagacggcgagcggcuggccgacaggcggaucgccgaacuguucaguaccaaaacccacaucggguga

SEQ ID NO: 15293 - RNA, 5055 nt, Artificial Sequence
  derived and/or modified CDS sequence (opt11) from CCHFV(7803)__AB069672.1__GP
augcacaucagucugaugugcgccguguuaugucuucagcuguacggguugggggagacgcauggcucgagcaacgagaccgagcacaauaagaccaacguggugaccacccccggagacucccagagcccggagccccuaguguccaccacacugcccgucacucuugacagcuccaccguuacccccaccacgccggccagcgaacccgagggcuccggggaagucuacacuuccccgcccaucaccacugaaggccuguccccgagcgaggcuaccuccgagcugccggucaccaccggcaucgggaucagcuccgcgagcgacguggacuccagcacccaggccgccggcgacaccuccacccccaccgugcgcacgagcccgccuaacagccccuccacaccacccaccagccaggacacccaccaccccaugcggaaccuucuauccgucacgagcuuaaagucugaggagaccagcgcccccucuaaaagcgggaaggagucgcccgcagcgagcagcccccacccgguggccagccggccgcccacccaccccaucaccgcccagggaccgacggaaaacaacucccacaacaccaccgggcagcucgagagcgugacccagucggcgacgcugggccccauggcuagccccacgcaaaccguccugucccagaacgugaccagcaucgcuauucaagauacgcaccccaguccgaccaacagaagcaagcgcaacuuggagauggagaucauccugacgcugccacagggccucaagaaguauuacgguaaggugcuucggcugcuccagcugacccuggaggaggacaccgagggccuucuggagugguguaagagaaaccuggggcucgacugcgacgacacguucuuccagaagagaaucgaggaguucuucaucacgggcgagggccacuucaacgaaguccugcaauucaggaccccagggacccugagcacgaccgaguccacccacgccgagagcccgaccgcggaacccuucaaauccuacuucgcgaagggcuuccucagcaucgacuccggguacuucucugccaagugcuacucccggacgagcgacuccggacuccagcugaucaacgugacuagacacagcacccggaucgccgacaccccagggcccaagaucacaaaccucaagacgaucuccugcaucaaucugaaggcuagcguguucaaggagcaccgcgaggucgagaucaacguauuacucccccaaguggccgucaaucuguccaacugccacgugaccaucaagagccacgugugcgacuacuccuuagauaucgacggcaccguccggcucccccacauccaccacgaggggacuuucauccccgggaccuacaagaucgucauugacaagaaaaacaaguugaacgauaggugcacgcuguucaccaacugcgucaucaagggacgugaaguucguaaggggcaaagcgugcuccgacaguacaagacggagauccgcauagggaaggcguccaccgggagccggcggcugcugagcgaggagagcggcgacgacugcaucagcagaacccagcuccugcgcaccgagacggccgagauccacggcgacaacuaugggggcccuggggacaagaucaccaucugcaauggcucgaccaucgucgaccagcgccuggggagcgaaaugggcugcuauacuauuaaccgggugaaguccuucaagcucugcgagaacagcgccacgggcaaguccugugagaucgacucuaucccggugaagugccgccagggguauugccugaagaucacccaggaaggccgggggcacgucaagcugucccgcggcagcgaggugauucuggacgccugcgacucgagcugcgaggugaugauccccaagggaaccggggacauccucgucgacugcuccggagggcagcagcacuuucugaaggacaaucugaucgaccuagggugccccuccauaccccuccuggggaagauggccaucuacaucugccggauguccaaccacccgaagaccacuauggcguuucucuucugguucagcuucggcuacgugaucacgugcauccugugcaaggcgaucuucuaccuguugaucauagugggcacgcuggggaagcgauucaaacaguaccgcgaacugaagccccagaccugcacgaucugcgagaccacccccgcgaacgccaucgacgccgagaugcacgaccucaacugcuccuacaacaucugccccuacugcgcgagccgccugaccagcgacggccuggcccggcacgucacccagugccccaagcgcaaagaaaagguggaggagacggagcucuaccugaaccucgagcggauccccugggugguuagaaagcuccuucaggugagcgagagcaccgggguggcccugaagcgguccucauggcucaucguccugcucguccuguucgccaucucccugagccccguccagagcgcgcccaucagccacggcaagaccaucgagaccuaccaagcccgcgaggaguacacguccaucugccuguuuguccucggcagcauccuuuucauaguguccugccugaugaagggccucguggacucuaucggcaacaucuucuucccggggcuguccaucugcaagaccugcagcaucggcagcaucaacggguucgaaaucgagagccacaaauguuacugcucgcugcucugcugcccauacugccggcacugcagugccgacagggagauccaccagcugcaucugaguaucugcaagaaacggaagaccggaucuaacgucaugcucgcagccugcaagcgcaugugcuuuagagcgaccauggaggucucgaacaaggccuuacugauccgcagcaucaucaauacgaccuucguggucuauauccuaauccuugccguaugcguggucagcaccucggccguggagauggaguccuugcccgccgggaccugggagcgcgaggaggaccucacaaauuucugucaccaggagugccaagugacggagaccgagugccugugcccauacgaggcgcuggugcuccgucgcccgcuuuuccuggacuccauugugcggggcaugaagaacccccucaacucaaccuccuuggaaacgagccuauccaucgaggcccccuggggcgccaucaacgugcaguccaccuacaagccgacugucucaaccgcgaacaucgcucucagcuggucuucaguggagcaccgugggaacaagauccugguuuccggccggagcgagagcaucaugaagcuggaggagcgcacggggaucagcugggaccuuggcguagaggacgcguccgagagcaagcugcugaccguguccguaauggaccucagccagauguacagccccgucuucgaguacuuaaguggggaccgccaaguggaggaguggcccaaggcgaccugcaccggcgauugccccgagcgcugcggcugcacgaccucuacgugucugcacaaggaguggccgcacucgcggaacuggagaugcaaccccaccuggugcuggggcgugggcacggggugcacgugcuguggccucgacgucaaggaucuguucaccgacuacaugaucguaaaauggaagguggaguacaucaagacccggggcaucguaugcgucgagcugaccucacaggagcgccagugcucccucaucgaggccgggacacgguucaacuuaggcagcgugacgaucacucuguccgagccccguaacauccagcagaagcugccgccagagaucaucacgcugcauccccguaucgaagagggguucuucgaccugaugcacguccagaagguguuaagcgccuccaccgucugcaaacugcagagcugcacccacggcgugcccggggaccuccagguguaccauguaggcaaccuccugaagggcgacaaggugaacggacaccugauccacaagaucgagccccaccugaauaccuccuggaugucaugggacggcugcgaccuggacuacuacugcaacaugggggacuggcccucuugcaccuauacgggcgugacccagcacaaccacgcgagcuuugucaacuuacucaacauagagaccgacuacacuaaguccuuccacuuccacagcaagcgcgugacugcccacggggacacgccccagcuggacuuaaaggcccggcccaccuacggcgccggcgagauuaccgugcucguggagguggccgacauggaguucacgcccaagaagaucgagaucucuggacuuaaguucgcgucgcugaccugcaccggcugcuacgcgugcagcagcgggauuucauguaagguucgcauccacgucgacgagccggacgagcuuaccgugcaugugaaguccgacgaucccgacguuguggcugcaagcuccagccugauggcccggaagcuggaguucggcacggacuccaccuucaaagcauucagcgccaugcccaagaccucccucuguuuuuacauuguggagcgcgaguacugcaagagcugcuccaaggaggauacccagaagugcgucaacacgaagcuggagcagccccagagcaucuugaucgagcacaagggaaccaucaucggcaagcagaacaacacguguaccgccaaggccuccugcuggcucgaaucggugaagucauucuucuacggacugaagaacaugcugaguggcaucuucggcaacuucuucauggggaucuuccuuuuccuggccccguucauccugcugauccucuucuucauguucggcuggcggauccuuuucugcuucaagugcugccgccgcacgcggggccuguucaaguacagacaccucaaggacgacgaagagaccggguaccggcgcaucaucgagcggcuaaacaacaagaagggaaagaacaaacugcucgacggugagcgccuggcggaccggcgcaucgccgagcuguucuccaccaaaacacacaucggauga

SEQ ID NO: 15294 - RNA, 5055 nt, Artificial Sequence
  derived and/or modified CDS sequence (opt11) from CCHFV(Hodzha)__AY223476.1__GP
augcacauccugcucaugugcgcggugcugugccugcagcaguacggccucggggagacccaccgccccaacaacggcacagagcacaacaagacuaacguccugaccacccccggggauaagcugucccccgagcuacccguguccaccgcccuguccgugacccccgacuccagcaccgucacacccaccacccccguguccggccuggaggggucgggcgauguguacaccagcccgcccgucaccaccaaaggacucagcccguccaaggccaccagcgagcugcccgccuccucggggauugacacauccagcgccuccgacguggauagcuccacucaggccgcccgugacaccagcacgcugaccgugcgcaccucacccccuagcucgccgucaacgccgcccacgucccaggacacguaccaccucguccggaaccugcuguccgugaccagccccuggccggaagagaccacggcgcccuccaaaucugguaaggagucccccguggccaacagcccccacccggucaccucccgccccagcaguccgcccaucacggugcaggggcccaccgagaacagcucccacaacacgaccggccagcucgagucuauggcccaguccacaacccugguacccauggccagccccacgcagacuguccuaucccagagcgugaccucccucgcggugcaagacgcccaccccagcccgaccaaucggagcaagcgcaaccuggagauggucauuauccugacgcucccccaggggcugaagaaauacuacggcaagguguuacggcuccugcaguuaacccucgaagaggauaccgagggccugcuggaauggugcaagcgcaaccuggggcuggacugcgacgacaccuucuuccaaaagcggaucgaggaguucuucaucacaggcgaaggacacuucaacgaggugcugcaauucaagacgcccucaacccucagcaccaccgagucaacgcaugccgucagcccgacugccgagcccuucaaguccuacuucgccaaaggcuuccuuagcaucgacaguggcuacuucucggccaaguguuacuccaagaccagcaacuccgggcugcaacucaucaacgugacccgccacagcacgcggauugccgacacccccggccccaagaucaccaaucugaagaccaucuccugcaucaaccugaaggccuccguguucaaggagcaccgcgaggucgagaucaacgugcuccugccccagguagcugugaaccuguccaacugccacgugacgaucaagagucacgucugcgauuacucccucgacguggacgggaccguacggcugccccacauucaccacggcggaaccuucauccccggcacguacaagaucgucaucgacaagaagaacaagcugaacgaccgaugcacguuauacaccaacugcgugauaaagggccgggaggugcgcaaggggcaaagcauucugcggcaguauaaaaccgagauccgcaucgguaaggccagcaccggcucccgucgucugcuaagcgaggagaguggcgacgacuguaucucacggacacagcugcugcgcacugagaccgcugagauccauggggacgacuacggcggccccggggacaagaucaccaucugcaacggcuccacgauagucgaccagcgccugggguccgagcucggcugcuacaccauuaaccgggugaagucuuucaagcugugcaaaaacagcgccaccgggaaguccugcgagaucgauagcaccccugugaagugccgccagggcuacugccucaaaaucacgcaggagggccgggggcacgucaagcucucccgcgggagcgagguggugcuggacgccugcgacuccagcugcgaggugaugauccccaaggggacaggcgacauccuaguggauugcuccggcggucagcaacauuuccucaaggacaaccugaucgaccuaggcuguccccggaucccgcuccuggggaagauggccauuuacaucugcagaaugagcaaccauccgaaaaccaccauggcauuucuguucugguucuccuucggcuacgucaucacgugcauccucugcaaggcgaucuucuaccugcugauuaucgucgguacccuaggcaaaagauucaagcaguaccgcgagcugaagccccaaaccugcaccaucugcgagacgacccccgccaacgccaucgacgccgagaugcacgaccugaacuguagcuauaauaucugcccguauugugccucccggcucaccucggacggccuggcccgccacguuacccaaugcccaaagagaaaggagaagguggaggagaccgagcuguaccucaacuuggagcgcauccccuggaucgugcggaaguugcuccagguaagcgaguccacggggguggcacugaagcguagcuccuggcugaucgugcuccuggugcuguucgccgugucucucagucccguccagagcgcccccauaggccacgggaagaccaucgaaacguaucaggcgcgggaggacuacaccuccaucugucuguucgugcugggcagcauccucuucaucguguccugccugaugaaggggcuggucgauucgaucggaaacaucuuuuucccgggucucacgauaugcaagaccugcuccauuggcagcaucaacggcuucgagaucgagagucacaagugcuauugcagccugcugugcugccccuauugccgccacugcuccgccgaccgggagauccaucagcuccaccuaagcaucugcaagaagaggaagaccggguccaacgugaugcuggccgugugcaaacggaugugcuuccgcgccaccauggaggucagcaacaaggcccuccugauccgcuccaucaucaauacgaccuucguggugugcauccugauccucgcggucugcguggugagcaccagcgccgucgagauggaaagccugccagcuggcaccugggagcgggaggaggaccugacaaauuucugccaccaggagugccaggugaccgagaccgagugucucugucccuaugaggcccuuguacugcgccggccucuguuucuggacagcaucgucaaggggaccaagaaccuguuaaacuccacgucucuggagaccucccugagcauugaggcccccuggggcgcgaucaacgugcagaguaccuacaagcccaccguuuccaccgccaacaucgcccuaucauggagcucagucgagcaucgcggcaacaagauccuggugagcggacggagugagucgaucaugaaacuggaggagcgcaccgggauaucgugggaucucgggguggaggacgccagcgaguccaagcugcugaccgucagcgugauggaucucucccagauguacagcccggucuuugaauaccugagcggcgaucggcaggucgaggaguggcccaaagcgaccuguacgggggacugccccgagagaugcggguguaccuccagcacgugccugcacaaggaguggccacacucccggaauuggcgcugcaauccgaccuggugcuggggcguggggaccggcugcacgugcugcgggcucgacguaaaggaccuguuuaccgauuacauguucgugaaguggaagguggacuacaucaagaccgaggcuauagucuguguggagcugacgucgcaggaacggcagugcuccuuaguggaagccggcacccgcuucaaccugggccccgucaccauaacucugucugagccccggaacauccaacagaagcucccgccggagaucaucacgcugcacccgcgcaucgaggagggguucuucgaccugaugcacguacagaaggugcucuccgccagcacggucugcaagcugcaguccugcacccacggcgugccuggggaccuccagguguaccacaucgguaacuuacugaagggggacaaggucaacggccaccugauccacaagaucgagccacacuucaacacgagcuggauguccugggacggcugugaccucgacuacuauugcaacaugggagacuggcccucgugcaccuacaccggcgugacccagcacaaccaugccuccuucgugaaccugcugaacaucgagacugacuacaccaagaguuuccacuuccacuccaagcgggucacggcgcacggggacacuccccagcucgacuuaaaggccagacccacauacggcgccggggagaucaccgugcugguggagguagccgacauggagcuccacacgaagaagaucgagaucaccgggcugaaguucgccagccugaccugcaccggaugcuaugcgugcuccagcgggaucuccugcaaggugcggauccacguggacgaacccgaugagcucacgguccacguaaaauccgacgacccggacguggucgccgccagcuccucacugauggcacgcaaacuggaguuuggaacggacuccaccuucaaagccuucucagcgaugcccaagacaucccucugcuucuacaucguggagcgggaguacugcaagucuugcucgaaggaggauacgcaaaagugcgugaauaccaagcuggagcaaccccagagcauccugaucgaacgcaaggguaccaucaucggcaagcagaauaacacgugcacggccaaggccuccugcuggcuggagagcgucaaguccuucuucuaugggcucaagaacaugcugucgggcaucuucggcaacguguuugugggcaucuuccuguuccucgccccguuuauccuucugauccuguucuucauguucggguggcggauccuguucugcuucaagugcugccgccgcacccggggacuguucaaguacaagcaccucaaggacgaugaagagaccggcuaccgccggaucaucgagaggcugaauaacaagaagggcaagaacaagcugcucgacggggagcggcuggccgaccgccggaucgcggagcuguucuccaccaaaacgcacaucgguuga

SEQ ID NO: 15295 - RNA, 5055 nt, Artificial Sequence
  derived and/or modified CDS sequence (opt11) from CCHFV(Hodzha)__KX013448.1__GP
augcacauccuucucaugugcgcuguucugugccugcagcaguacggccucggggagacccaccgccccaacaacggcaccgagcacaacaagacgaauguauuaaccacccccagcgacaagcugucccccgagccgcccgugagcaccgccuuauccgugacgcccgacagcuccacagucacccccaccacgcccgucuccgggcuggaaggcuccggcgagguguacaccagcccgcccgucacgaccaagggccugucccccaguaaggcgacguccgagcuccccgcgaccacaggcaucgacaccagcuccgccagcgacguggacuccuccacgcaggccgcccgggacaccuccacccugaccguccgcacgagcccgcccuccagccccucaaccccacccaccucccaggacaccuaccaccugguccggaaccuccugagcgugacgagccccaggcccgaggagaccacggcccccuccaaguccgggaaggagagccccguggcgaacuccccgcaccccgucaccagccggcccuccagcccgccaaucacagugcagggucccaccgagaacuccagccacaacaccaccgggcagcuggaauccauggcccagagcacgacccucguacccauggccucccccacccagaccguacugagccaguccgugacgagccuggcggugcaggacgcccacccguccccuaccaaucgcagcaaacggaaccucgagauggagaucauccugacccugccccagggccucaagaaguacuacgggaagguccugcgcuugcuccagcugacccuggaggaggacaccgagggccuccuggaguggugcaagcggaaccuggggcucgacugcgacgacacguucuuccagaagcgcaucgaggaguucuucauaaccggggagggccacuucaacgagguguuacaauuuaagaccccgagcacccuguccaccaccgagagcacccacgccgugucccccacggccgagcccuucaagagcuacuuugcgaagggguuccucuccaucgacagcggcuacuucuccgcgaagugcuacaguaaaaccuccaacaguggccugcagcugaucaacgucacccggcacuccacccgcaucgccgacaccccagggccgaagaucacgaacuuaaaaaccaucagcugcaucaaccugaaggccuccguguucaaggagcaccgggagguggagaucaacguccugcucccccagguggccgucaaccugucgaacugccacguuaccaucaagucccacgugugcgauuacagccuggacgucgauggcaccgugcgccucccgcauauccaccacggcggcacguucauccccgggaccuacaagaucguuaucgacaagaagaacaagcuaaacgaccggugcacccuguacaccaacugugucaucaagggccgcgaggugcggaaaggccaguccauccuccgccaguauaagacggagauacggaucggaaaggcuagcaccggcagccgccgacugcuguccgaggagucuggggacgacugcaucucacgcacccagcuccugcgcaccgagacggcggagauccacggugacgacuacgggggcccgggcgacaaaauuaccaucugcaaugggagcaccaucguggaccagcggcugggcuccgaacuggggugcuacaccaucaaccgcgucaaguccuucaagcucugcgagaacuccgccacuggcaagucgugcgagaucgacuccacacccgugaagugccggcagggguauugccugaagaucacccaggagggccgcggccacgugaaguugagccggggguccgaggucgugcucgacgccugcgacagcuccugcgaggugaugauccccaagggcacaggugacauacuuguggacugcagcgggggccagcagcacuuucugaaagacaaccucaucgaucuggggugccccaggaucccacugcucggcaagauggccaucuacauuugcaggauguccaaccaccccgagacgaccauggccuucuuauucugguucagcuucggguacgugaucacgugcauccuguguaaggcgaucuucuaccuccugaucaucguaggcacccuggggaagcguuucaagcaguacagagagcucaagccccagaccuguaccaucugcgagaccaccccagccaacgccaucgacgccgagaugcacgacuuaaacugcuccuacaacaucugcccguacugcgccagccgccugaccuccgacggccucgcgcggcaugucacgcagugccccaagcgcaaggagaagguggaggagacggagcuguaucuaaaccucgagcgaauccccuggaucgugcguaagcuguugcaggucagcgagucgaccggcguggcccucaagcgguccagcuggcugaucgugcuguugguccuguuugccgugucccugagccccgugcaguccgccccgaucgggcacggcaagaccaucgagacguaccaagcgcgcgaggaguauaccagcaucugccucuucguccugggguccauccuguucaucgugucaugccucaugaagggccugguggacagcauagggaacaucuucuuccccggccugaccaucugcaagaccugcagcaucggguccauuaacggauucgagauagaaagccacaagugcuacugcucccuccuguguugccccuacugccggcauugccccgcggaccgcgagauccaccagcugcaccucagcauaugcaagaagaggaagacgggcuccaacgucaugcuagccgugugcaagagaaugugcuuccgcgccaccauggagguuagcaacaaggcccugcucauccggucgaucaucaacaccaccuucgucguuugcauccugauccuugcgguaugcgucgugucuacguccgccguggaaauggagagcuugccggccgggaccugggagcgcgaggaggaccugacgaauuucugccaccaggagugccaagucaccgagacggagugucugugccccuacgaggcccuugugcugcggcgcccccuguuccucgacagcaucgugaaaggcaagaagaaccugcugaacucuaccagucucgagaccucccugagcaucgaagccccguggggcgcgaucaacguucaguccaccuacaagcccacggugagcaccgccaacaucgcccuguccuggagcuccguggagcaccgugggaacaaaauccucgucagcggccgcuccgagagcaucaugaagcuggaggagcggaccgggaucuccugggaucugggcguggaggacgccagcgaguccaagcuccugaccguuucugucauggaccugucccagauguacagccccguguucgaguaccucuccggggaccgccagguggaggaguggcccaaggccacgugcaccggcgacugcagcgagcggugcggaugcaccagcuccacgugccugcacaaggaguggccccacagucgcaauuggcggugcaaccccaccuggugcuggggcgucggcaccgggugcacgugcugcggccuggacgugaaggaccucuucaccgacuacauguucgucaaguggaagguggacuacaucaagaccgaggcgaucgugugcgucgaacugaccucccaggagcgccagugcagccugguggaggcggggacccgguucaaccucggccccgugacaaucacgcuguccgagccgcgcaacauccagcagaagcugccgccugagaucauaacucuccacccccggaucgaggagggcuucuucgacuuaaugcacguccagaagguccugagcgccuccaccgugugcaagcuccagaguugcacccaugggguccccggcgaccuccagguguaccacaucgggaaccugcugaagggcgacaaggugaacggacaccugauccacaagaucgaaccgcacuucaacaccuccuggauguccugggauggcugugaccuggacuacuacugcaacaugggcgacuggcccuccugcacguacaccggggucacccagcacaaccacgccagcuucgugaaccuccugaauaucgagaccgacuacacgaaguccuuccacuuccacagcaagcgcgugaccgcucacggcgacacgccccagcucgaucucaaagcccggcccacuuacggggccggcgagaucaccgucuugguggagguggccgacauggagcugcacaccaagaagauagagaucaccgggcucaaguucgccucccugaccugcacgggcugcuacgcgugcagcuccggcauuaguugcaagguccgcauccacgucgacgagccggacgagcucaccgugcacgucaaguccgacgauccagacgugguggccgccagcagcucccucauggcgcggaaguuagaguucgggaccgacagcaccuucaaggccuucuccgcgaugcccaagacgagccugugcuucuauaucgucgagcgcgaguauugcaaguccugcagcaaggaggacacccagaagugcgugaacaccaagcucgagcagccccaauccauccuaauagagcagaagggcaccaucaucgggaagcagaacaauaccuguaccgccaaggccagcugcuggcuggaguccguaaagagcuucuucuacggccuuaagaacaugcucuccgggaucuucggcaacguauucgugggcaucuuccuguuccuggccccguucaucuugcugauccuguuuuucauguucggguggcggauucucuucugcuucaagugcugccgccgaacccggggccuguucaaguacaaacaucugaaggacgacgaggagaccggguaccgccggaucaucgaaagguugaacaacaagaagggcaagaacaagcugcuggacggagagcggcucgccgaccgccggaucgcggagcuguucagcacgaagacccacaucggguga

SEQ ID NO: 15296 - RNA, 5055 nt, Artificial Sequence
  derived and/or modified CDS sequence (opt11) from CCHFV(Baghdad 12)__AJ538197.2__GP
augcacaucagccugaucuacgcaguccucugccugcaacuguacggccucggggagacccacggcuccuccuccgggaccgagcacaaccgcacgaacgucguggccacccccggcgggagucaguccccggagccccuggugagcaccacgcugcccguuacgcucgauuccagcaccgugacccccgcgacccaggccuccggcccugagggcagcggggagguguacacgucucccccgaccaccaccgagggccugagccccuccgacgccacaagcgagcugccgaccaccaccggcauaggcauauccagcuccagcgacgucaacuccagcacgcaggcugccggggauaccagcacccccaccgcgcggacgucccucccagacagcccuuccaccccgcccacgagccaggacacccaccaccccaugcgcaacuugcuguccgugacgagccucaagcccgaggagacccccgcccccuccaagagcggcaaggagagucccgccgccucgagcccccacccgguggcgagcaggccgcccacccccuccaccacggcccagggucccaccgagaacaacagccgcaacacgaccguccaguuaaaguccgugacgcagagcgccacccuggggcccauggccagccccacucagaccgugcuccugcagagcgucacgucgaucgcuauccaggauacccaccccagcccgaccaaccggagccgccggaaccuggagauggagaucauccucacccugccccagggccugaagaaguacuacgggaaggugcuccgccugcugcagcuaacccuggaggaggauacagagggccugcucgaguggugcaagcggaaccugggucuggacugcgacgacaccuucuuccagaagcgcaucgaagaguucuucaucaccggggagggccacuucaacgagguucuacaguuccggacccccgggacacuguccaccaccgagagcacucacgcgggcucccccacgguagagcccuucaagagcuacuucgcuaagggguuccugcucaucgacuccggcuacuuuagcgccaagugcuacucccgcacgagcaacucuggccugcagcugaucaacgugacccggcacagcaccaagauugccgacacgcccgggcccaagaucaccaaccucaagaccaucagcugcaucaacuuaaaggcaagcaucuuuaaggagcaccgcgagaucgagaucaacgugcugcucccgcaagucgcggugaaccuguccaacugccacgugaccaucaagagccacgucugcgacuacucccugaacaucgacggcacggugaagcucccccacauccaccacgagggcaucuucauccccggcaccuauaagaucgugaucgacaagaaaaacaagcuaaacgaccggugcacccuguucaccaacugcgucaucaaggggcgcgaggugcggaagggccagagcguccuccgccaguacaagacggagauccggaucggcaaggccuccaccgggagccgccgguugcugagcgaggaguccggcgacgauugcaucagccgcacccgccuccugcggaccgagacggcagagauccauggagacuccuacggcgggcccggcgauaagaucaccaucugcaacggcagcaccauuguggaccaacgccuggggucagagaugggcuguuacaccauuaaccggguaaagagcuucaagcugugugaaaauuccgccacaggcaagagcugcaagauugacuccaucccggugaagugucgccagggguacugccucaagaucacccaagagggccgggggcacgugaaacugucccgcggcuccgaggugguacuggacgccugugacaguuccugcgaggugaugauccccaaggggacuggcgacauccucguggacugcagcgggggucagcagcacuuucugaaggacaaccugaucgaccucggcugccccaacauuccccugcuggggaagauggcgaucuacaucugccgcauguccaaccacccgaagaccacgauggccuuccucuucugguucaguuucggcuacgucauaaccugcauccugugcaaggccauauucuaccugcucaucauuguugggacccugggcaagcgcuuuaagcaguaucgcgagcugaaaccucagaccugcacgaucugcgagaccaccccugugaacgcaaucgaugccgagaugcacgaccucaacugcuccuacaacaucugccccuacugcgcgagccgccugaccuccgacgggcuggcccggcacguaacccagugcccgaagcgcaaggagaagguugaggagacugagcucuaccugaaccuggagcggauccccugggugguccgcaagcuccuccaggugagcgagagcaccggcguggcccuaaagcgguccagcuggcucaucguccugcugguacuccuggccguguccagcucccccguccagagcgcgcccaucggcuaugguaagaccaucgagaccuaccaggccagagagggcuacacguccaucugccuguucgugcucgggagcauccuguuuaucgucuccugccugaccaagggccucgucgauagcaucgggaacaucuuuuucccgggccuguccaucugcaagacaugcagcauaggcucgaucaacggguucgagguggagucccacaaaugcuacugcagccugcucuguugccccuacugccgccauugcagcgcagaccgcgagauccaccagcugcaucuguccaucugcaagaagaggaaaacaggcagcuccgugaugcucgccgucugcaagcgcaugugcuuccgcgcaacgauggaggugagcaacaaggcgcugcugauccggagcaucaucaacaccacuuucguggucugcauccucacccuggccgugugcguggucuccacgagcgccguggaaauggagucucugcccgccgggaccugggagcgcgaggaggaccucacuaauuucugccaccaggagugccagguuaccgagacggagugccugugucccuacgaagcccugguacuccggaaaccgcuguuccuggacagcauagugaagggcaccaagaaccugcucaacagcaccagccuggagaccuccuugagcaucgaggcgcccuggggcgccaucaacgugcagucaacguacaaacccaccgucagcaccgccaacauagcccuguccuggagcuccguggagcacagagggaacaagauccuggugagcggucgguccgagagcaucaugaagcucgaggagcgcaccgguaucucgugggaucugggcgucgaggacgccagcgaguccaagcugcucacggugagcgugauggaccugagccagauguacuccccggucuucgaguaccugagcggggaccgccagguggaggaguggcccaaagcgaccugcaccggcgacugccccgagcggugcggcugcaccacgucuaccugccuccacaaggaguggccccacucccguaacuggcgcugcaacccgaccuggugcuggggcgugggcaccgggugcacgugcugcggccuggacguaaaggaccuguucaccgacuacauguucgugaaguggaagguagaguacaucaagaccgaugccaucgucugcguggagcucaccucccaggagcggcagugcagccugaucgaggccgggacgcgcuucaaccugggcuccgucaccaucacccucucugagccccggaacauccagcagaagcugccgcccgagaucaucacccuucacccccgcaucgaggagggcuucuuugacuuaaugcacguccagaaggugcuguccgccagcacugucugcaagcuacaguccugcacgcacggggugccgggcgaccuccagguguaccacauagggaaucugcugaagggcgacaaggucaacgggcaccuaauccacaagauagagccccacuucaacaccagcuggauguccugggacggcugcgaccuggacuacuacugcaacaugggcgacuggcccagcugcaccuacacaggggugacgcagcacaaccacgcgucauucgugaaccugcucaacauugagaccgacuacaccaagagcuuccacuuccacuccaaaagaguaaccgcccacggcgacacgccgcagcuugaccugaaggugcgccccaccuacggggccggcgagaucacggugcuggucgagguggccgacauggagcugcacaccaagaagaucgagaucagcgggcugaaguucgccucccucacgugcaccggcugcuacgcgugcagcagcggcauauccugcaagguacggauacacgucgacgaacccgacgagcugaccgugcacgucaaaagcgacgaccccgacgucguggccgccaguagcucccugauggcccgcaagcuagaguucgggaccgacucgacguucaaggccuucuccgcuaugccgaagaccagccugugcuucuacaucguggagcgggaguacugcaaguccugcagcaaggaggacacccagaagugcgucaacaccaagcuggagcagccccaguccauccucaucgagcacaaaggcacaaucaucgggaagcagaacaauaccugcaccgccaagaccagcugcuggcuggagagcgugaagucuuucuucuacggccugaagaacaugcugaguggcaucuucgggaacuuuuucaugggcauauuccucuuccucgcccccuucauauugcucauccuguucuucauguucgguuggcgcauccuguucugcuucaagugcugcaggcgcacgcgaggccucuucaaguaccggcaccuaaaggacgaugaagagaccggguaccgccggaucaucgagagacugaacaacaagaagggcaagaacaagcuccuggacggcgagcggcuggccgaccgccggaucgccgagcuguucagcaccaagacccacaucggguga

SEQ ID NO: 15297 - RNA, 5055 nt, Artificial Sequence
  derived and/or modified CDS sequence (opt11) from CCHFV(TADJ/HU8966 )__AY179962.1__GP
augcacaugcugcucaugugcgccgugcucugcuuacagcucuauggacucgggggcacccugaggagcaacaacgggaccgagcacaacaagacgaacguccuuaccacccccggcgacaagcuguccccggagccaccuguaagcaccgcccugcccgugacuccggacuccagcacagugacuccgaccacgccggcguccgggcuggagggcucaggcgagguguacacauccccgcccaucaccaccaaagggcugucccccuccgaagcuacgagcgagccgccagccacaaccgguauggggauuuccagcgccucgggaguggacuuuucgacccaggcugcucgggacacguccacacuaaccguccucaccagcccgccgaacucccccaacacgcccccgaccagccaggacacccaccauccugugcguagccuacugagcguuacuucgccgcggcccgaagaaacgaccgccccguccaagucagggaaggagagccccgcagccaacagcucccaccccgugacaucccgccccuccagcccguuaaucacuguucggggccccacggagaacuccagccauaacaccaccggccagcuggagucuaugacccagagcacgaccuuagugcccauggccucccccacccaaaccguccucagccaguccgugacgagcauagccgugcaggaugcccacccgagcagcaccaaucgcuccaagcggaaccuggagauggagauuauccugacccucccgcaggggcugaagaaguacuacgguaagguccugcgccuccugcagcugacccucgaggaggacacagagggucuucuggaguggugcaaacggaaccucggccuggacugcgacgacaccuucuuccagaaacggauagaggaguucuucaucaccggcgaagggcacuucaacgaggugcugcaguuccguacccccggcacccucagcacaacggagagcacccacgcuggguccccuacggccgagccauuuaagaguuauuucgcaaagggguuccugucuauagacucuggguacuucuccgccaagugcuacagccgcacguccaacagcggccugcggcucaucaacgugacccgccacuccacccggaucgccgacaccccgggccccaagaucaccaaccuaaaaaccauaagcuguaucaaccugcgcgccuccauuuucaaagagcacagggaggucgagaucaauguccuccucccccagguggccgucaaccugagcaacugccacguagcgaucaagucgcacgugugugacuacagucucgacgucgaugggaccgugcgcuuaccccacauacaucacggcgggacuuuuaucccaggcacuuacaagaucgugauagacaagaagaacaaacugaacgacaggugcacgcuuuucaccaauugcguaauuaaagggcgcgaggugcguaagggccaguccauucugcgccaguacaaaaccgagauccgcauagggaaggccagcacggggagccggaggcugcucuccgaggaaagcggcgacgacugcaucucgcggacccaguugcugcgcacggagaccgcggagauacacggcgacgauuacggcgggcccggcgacaagaucacgauaugcaacgguuccaccaucgucgaccagcggcugggguccgaacucgggugcuacaccauaaaccgagucaagagcuucaagcugugcgagaacucagccaccgggaagaacugcgagauugacagcgugccagugaagugcaggcaaggcuacugccugaagauuacgcaagagggacgcggacaugucaagcucucgcgaggcagcgaggugguccuugaugccugugacuccucaugcgaggugaugauacccaaggggaccggcgacauauccguggauuguuccgggggccagcaacacuuccugaaggacaaccuaaucgacuugggcugccccaagauuccccugcucgggaaaauggcuaucuacaucugccguauguccaaccacccgaagaccacaauggccuuccuguucugguucagcuucggcuacgucaucacgcggauccugugcaaggccaucuucuaccuccuuaucaucguagggacccugggcaagcgcuucaaacaguacagagagcucaagccucagacaugcaccaucugugagacgacgcccgccaacgcaaucgacgcggagaugcacgaccugaacugcuccuauaacaucugccccuacugcgcgucucgccugaccuccgacgggcucgcccggcacgugacacagugcccgaagcggaaggagcgggucgaggagaccgagcuguaccugaaccucgaacgcauccccuggauagugcggaagcuccuccagguaagcgaguccacaggcgucgcccugaagcgcagcaguuggcugauagugcuguuaguccuguucaccguuucauuaagccccgugcaguccgcgccaaucgguuacgggaacaccauugagacuuaccaggcacgcgaggaauacaccagcaucugccucuucguucugggcuccauccuguucaucgucagcugcuuaaugaaaggauuaguugauuccauuggaaacauauucuuccccgggcugacaauaugcaagaccugcucgaucggcuccaucaacggcuucgagaucgaaagccacaagugcuacugcucccuccuguguugcccguacugccggcacuguagugccgaccgcgagauacaccaacuucaccucucuauaugcaaaaagcggaagaccgggagcaacguuaugcuggccguaugcaaacgcaugugcuuccgggccacgauggagguauccaacaaagcgcuccucauucggagcaucaucaacaccaccuucguggucugcauccugauccuggccgucugcaucguguccacuagcgccgucgagauggagagccuccccgccggcacgugggagcgggaggaggaccugacuaacuucugccaucaggagugucaggugaccgaaaccgagugcuuaugucccuaugaggcacucgugcuccgccggccguuguuccucgauucgaucgugaaagggaugaagaacccacugaacagcacgucacuggagaccucucucuccauugaggcuccuuggggcgcuaucaacgugcagagcaccuacaagccgaccguguccacggccaacaucgcccucaguugguccagcaucgagcaccgcgggaacaacauccuggucuccgguaggagcgaguccauaaugaagcuagaagaacgcaccggcauuagcggggaccugggcgucgaggacgccucugaguccaagcugcucaccgugucaguuauggaccugagccagauguacucccccguguucgaguaucuauccggggaccgccagguggaagaauggccgaaggcgaccugcacgggcgacugccccgagcgaugcggcugcaccucaucuacaugccuccacaaggaguggccccacagccguaacuggcgcugcaaccccaccugguguuggggcgucggcaccgggugcacguguugcggccuggacgugaaggaccuguuuaucgacuacauguucgucaaguggaaaguggacuacaucaagaccgaggccaucgugugcgucgagcucaccucccaagagcgacaguguucucuggucgaggccgggaccagguucaacuuagggccggugaccaucacccuauccgagccccgaaacauccagcagaagcucccucccgagaucauaacccugcacccccgcaucgaggagggguucuucgaccuaaugcacguccaaaagguguugagcgccuccacgguguguaagcugcaaagcuguacccacgggguacccggcgaccugcaggucuaccacaucgggaaccuccugaaaggcgauaaagagaacgggcaccucauccacaagaucgaaccgcacuucaauaccuccuggaugagcugggacggcugugacuuggacuacuacugcaacaugggagacuggccguccugcacauacacggggguaacucaacacaaccaugcgagcuucguaaaccuacuaaacaucgaaaccgacuacaccaaguccuuccacuuccacuccaagcgggugaccgcccacggcgacacgccccagcuggaccugaaggccaggcccacuuacggagccggagagaucaccgugcuuguugagguggccgacauggagcugcacacgaagaagaucgagaucacggggcuaaaguucgcgucucugaccugcaccggcugcuacgccugcagcuccggcaucaguugcaaggugcgcauccacguggaugagccagaugagcugaccgugcacgugaaguccgacgaccccgacgucgucgccgccagcuccagcuugauggcccggaagcucgaguucgggacggacagcaccuucaaggcguucuccgccaugcccaagaccucccugugcuucuacaucguggaacgcgaguaucggaaaucaugcucuaaggaggauacccagaagugcgucaacacgaagcuggaacagccgcaguccaucuuaaucgagcauaaggggaccaucaucggaaaacaaaacaacacgugcaccgcuaaggccagcugcugguuggaauccgucaaauccuuuuucuacggccugaagaauaugcucuccggcaucuucggcaacguguucgugggcauauuucuauuccuagcccccuucauccugcucauccuguucuucauguucggguggcguauccucagcugcuuuaagugcugucggcgcacacguggccuccugaagcacaggcaucugaaggacgaugaggagaccggcuaccgccgcaucaucgagcggcugaacaacaagaagggcaagaauaagcuccuugacggcgagcgccucgcagaucggcggaucgccgaacuguucuccacgaagacccacauagguuga

SEQ ID NO: 15298 - RNA, 5055 nt, Artificial Sequence
  derived and/or modified CDS sequence (opt11) from CCHFV(K168_40)__KX013457.1__GP
augcacaucagccugaugugcgcugugcucugccugcagcuguacggccuugggggcacccacgggcugcacaacggcacggagcacaacaagacgaacgccgucaccaccuccagcaacucccagagcuccgaaagccccgcgagaaccgccccgcccgugacgccagacuccccuaccgugaccccgacuacgcccgcgucggcccccgagggguccggcgaggcccacagcagcccgcccaacaacaccgagggccccucccugcccgaguccaccagcgagcccccugcugcuaccuccaccgggauccccagcgccuccgacgucaacagcuccacccaggccgcgcgcgauaccagcacccccacugugcgaaccucgcccccgaacucccccucuacaccgcccacgccccaggaaacccaucaccccguacggaaccuccugagugucacaagccauaagccagaggagaccuccgcccccagcgaguccggcaaggagagcccggccgccaacucuccccaccccguggccagccggcccccgacaccauccacgaccgcgcaggggcccaccgagaacaauaacuacaacacgacaggccagcuggaaucccucacccaguccaccacccuggggccgaugacgagccugacccagaccgaccucccccagucggugacaucaaucgccgugcaggacacgcacccuucccccaccaaccgcagcaagcgcaaccuggagauggagaucauccugacccucccgcagggacugaagaaguacuacggcaagguccugcggcuccugcagcugacccucgaggaggacaccgagggguuacuggaguggugcaagcgcaacuuaggccuggacugcgacgacacguucuuccagaagcggauagaggaguucuucaucaccggggaagggcacuucaacgaggugcugcaguuccgcacccccggcacccucuccacgaccgagagcacccacgcggggcugcccaccgccgagcccuucaagagcuacuucgccaagggcuuucuguccaucgacagcggguacuuuuccgcgaagugcuacagccggacguccaacagcggccuccagcugauuaacgucacccgccacuccacgcggaucgccgacaccccggggcccaagaucacgaaccugaagacgaucagcugcaucaaccucaaggccuccguguucaaggagcaccgggagguggagaucaacguccugcugccccagguggccgugaaccucagcaacugccacgucaccaucaagucccacgugugcgacuacagccuggacaucgauggcacggugagacugccccacauccaccaugacggcacguucauccccgggaccuacaagaucgucaucgaccgcaagaacaagcucaacgaccggugcacccuguucaccaacugcgucaucaagggccgcgaagugcggaaggggcaguccguccugcgccaauacaaaacggagauccggaucggcaaagccuccaccgggucccggcgccuccugagcgacgaguccggcgacgacugcaucucgcggacucagcugcuccgcaccgagacggcggagauccacggcgacaacuacgggggccccggcgacaagauaacuaucugcaauggcagcaccaucguggaccagcgccugggguccgagcugggcugcuacaccaucaaccgcgucaagagcuucaagcucugcgagaacuccgccacgggcaagagcugugaaguggacuccauccccgugaagugccggcagggguacugccugaagaucacccaagaggggcgcgggcacgucaagcugucgcguggcuccgaggugguacuggacgccugugacucauccugcgaggucaugauccccaagggcaccggggacauccucguggacugcagcggcgggcaacagcacuuccuuaaggacaaucuaaucgaucucgggugcccgaagaucccccugcuggggaagauggcuaucuacauaugccgcauguccaaccaccccaagaccacgauggccuuccucuucugguucagcuucggcuacgugaucacuugcaucgucuguaaggcgaucuucuaccugcugaucaucgugggcacccuugggaagcgguuuaagcaguaccgcgagcugaagccccagaccugcacgaucugcgagacaaccccgacaaacgccaucgacgccgagaugcacgaccugaacugcuccuacaacauuugccccuacugcgccagccggcucaccagugacggccuggcgcgucacgugacgcacugccccaagcggaaggagaaaguagaggagaccgagcuguaccucaaccuggagcgcauccccugggugguccgcaagcugcuccaagucucagaguccacggggguggcccugaagcgcagcuccuggcucaucgugcuccuuguacuguucgcgguaagccucagcccggugcaguccgcccccaucggccacgggaagaccaucgagacguaccagguccgugaggaguacaccagcaucugccuguucgugcuuggcuccauccucuucaucgugagcugccuaaugaagggccuggucaacuccguagggaacaucuucuuccccggccucagcaucugcaagaccugcucgaucgggucaaucaacggcuucgagaucgagucccacaagugcuacugcagccuguuaugcugcccguacugccgccacugcuccgcggaccgggagauccaccagcuccaucugagcaucugcaagaagcgcaagaccgggaguaacguaaugcuggcgguaugcaagcgcaugugcuucagagccacuguggagguaagcaacaaggcccuuuccauccgcagcaucaucaacaccacguucgucgugugcauccugauccuugccguuugcgugguguccaccagcgccguggagauggagucccuccccgcggggacgugggagcgggaggaggaccugaccaacuucugccaccaggagugccaggugaccgagaccgagugccugugccccuacgaggcccucgugcugcgccggccccuguuucucgacggcaucgugaaagggaugaagaaccugcugaacagcacgagccucgagaccucccugagcaucgaggccccguggggcgccaucaacguccaguccaccuacaagcccaccgugagcgccgcgaacaucgcccuguccuggagcuccguggagcaucgcgggaacaagauccucgucagcggcagguccgagagcaucaugaagcucgaggagcgcacggggaucuccugggaccugggcguugaggacgccagcgaguccaagcuccugaccgugucggucauggaccugucccagauguacucgcccguauucgaguaccucuccggugaccgucagguggaggaguggcccaaagcgaccugcaccggggacugcccggagcgcugcggcugcacgagcuccaccugucugcacaaggaguggccccacagccggaacuggcgcugcaaccccaccuggugcuggggagucggcaccggcugcacgugcugcgggcuggacgugaaggaccucuucaccgacuacauguucgugaaguggaaggucgaguacaucaaaaccgaagccaucguaugcgucgagcugaccucucaggagcggcagugcucccugaucgaggccggcacgcgcuucaaccucgggccggugaccaucacacugagcgagccucggaacauccagcagaagcugccacccgagaucaucacgcuccacccccgcaucgaggagggcuucuucgaccugaugcacgugcagaagguccugucagcaagcacggugugcaaacuccaguccugcacccacggggugcccggcgaucugcaggucuaccacaucggcaaccugcuuaagggggacaaggugaauggccaccugauccacaagauagagccccacuucaacaccagcuggauguccugggacgggugcgaccuggacuacuacugcaacaugggcgacuggcccagcugcaccuacaccggggugacacaacacaaccacgccuccuucaucaacuuacugaacaucgagacagacuacaccaagagcuuccacuuccacuccaagcgggucaccgcccacggcgacacuccacagcuggacuuaaaggcgcgcccgaacuacggcgccggagagaucaccgugcucgucgaggucgccgacauggagcugcacacaaagaagaucgagaucagcggccucaaguucgccucccugaccugcacggggugcuacgccugcagcuccggcaucagcugcaaggugcggauccacguggacgagcccgacgagcugaccguccacgugaaguccgacgaccccgacguggucgcggccagcuccagcuugauggcccgcaagcuggaguucgggaccgacagcaccuuuaaggccuuuuccgccaugcccaagacgucgcugugcuucuacaucguggagcgggaguacugcaaguccugcaguaaggaggacacccagaagugcgugaacaccaagcucgagcacccgcaguccauccugaucgagcauaagggcaccaucaucggaaagcagaacaacacgugcaccgcgaaaaccagcugcuggcuggaguccgucaagagcuucuucuacgggcucaagaacaugcuauccggcaucuuugggaacguguucguggguaucuuccuguuccuugcucccuucauucugcugauccuguucuucauguucggcuggcgcauccucuucuguuucaagugcugccgccggacccgcgggcuguuccgguacaagcaccuggaggacgacgaggagacgggcuaccgccggaucauagagcgccucaacaauaaaaaggggaagaacaaacuucuggacggcgaacggcucgccgacagacggauugccgagcuguucagcaccaagacccacaucggguga

SEQ ID NO: 15299 - RNA, 5055 nt, Artificial Sequence
  derived and/or modified CDS sequence (opt11) from CCHFV(K128_76)__KX013454.1__GP
augcacaucagcuugaugugugccgugcugugccugcaguuguacggccucgggggcacccacgggucccacaacgagacagagcacaacaagacaaacgccgucaccaccagcuccgacagccagucccccgagccgcccacccgcacgacccugcccgugacccccgauagcccgaccguaacgcccaccacgcccgcguccgcgcccgaaggcagcggggagguccacaccuccccgcccaacaccaccgagggccccucacugcccgagaguaccccggagccgcccaccgccacuagcacgggcauccccuccgccagcgacgugaacuccagcacccaggccgcacgggacaccuccaccccgaccgugcacaccucaccgcccaacucccccagcaccccucccacguugcaggagacucaccaccccaugcgcaaucugcugagcguaaccagccacaagcccgaggagaccucagccccguccgagucagggaaggagucccccgccgccaacagcccccaccccguagcugacagaccguccaccagcuccaccaccgcccaggggcccaccgagaacaacucuuauaacacgaccgagcagcucgagucccugacccagagcaccacuuuggggcccaugaccagucucacccaaaccgugcugagccaguccgucaccucuaucgccgugcaggacacgcaccuguccccgaccaaucgaagcaaacggaaccucgagauggagaucauucugacucugccccagggcuugaagaaguacuacggaaaggugcuccgccugcuccaguugacccuggaggaggacacggagggucuccuggagugguguaagcggaaccuggaccucgauugcgacgacacguucuuccagaagcgcaucgaggaguucuucauuacaggcgagggguacuucaacgagguccugcaauuccggacacccggcacgcuguccaccacugagagcacccacgccggguuacccacugccgagccguucaagucauacuucgcgaagggcuuccuguccaucgacucuggcuacuucuccgccaagugcuacagccgcaccuccaacagcgggcugcagcucaucaacgugacccggcacuccacccgcaucgccgacacgcccggccccaagaucacaaaccugaagaccaucagcugcaucaaccugaaggccuccguguucaaggagcaccgggaggucgagaucaacgugcuccucccccagguggccgucaaccugagcaacugccacgugaccaucaagucccaugugugcgacuacucucucgacaucgacgggacggucaagcugccgcacauccaccaugacggcaccuucauccccgggaccuacaagaucguaaucgaccgcaagaacaaguuaaacgaccggugcacccuauucacaaacugugugaucaagggccgcgaggucaggaagggccaguccguucugcgccaguacaagaccgagauccggaucgggaaggcguccaccggcucccgccgacugcucucggacgaguccggggacgacuguaucagccgcacccagcuacugcgcacggagacugccgagauacacggcgacaacuacgggggccccggcgacaagaucaccaucugcaacgggagcaccaucgucgaccaacggcucggcuccgagcuggggugcuacacgaucaaccgcgucaagagcuucaagcugugcgagaacagugccaccgguaagagcugcgagaucgacuccaucccggugaagugccggcagggguacugccugaagauaacccaggagggccgcggccacgugaagcucagccggggguccgagguggugcuggacgccugcgacagcuccugcgaggucaugauuccgaagggcacgggggacauccugguggacugcagcggcggccagcagcacuuccucaaggacaaccugaucgaucuggggugccccaagaucccacuccugggcaagauggccaucuacauuugccgcauguccaaccaccccaaaacgaccauggcguuccuguucugguucagcuucggguacgugaucacgugcaucgucugcaaggccaucuucuaccuccugaucaucgucggcacccuggggaagcgguucaagcaguaccgcgagcucaagccgcaaaccugcacgaucugcgagaccacccccaccaacgccaucgacgcagagaugcacgaccugaacugcuccuacaacaucugccccuacugcgccagucgguugacuuccgacggccucgcgcgccacguaacccacugccccaagcggaaggagaaggucgaggaaaccgagcuauaccugaaccucgagcgcaucccgugggucgugcggaagcugcugcaggucagcgaguccaccggcguggcccucaagcgcagcuccuggcugaucgugcuguugguccuguucgccgugagccugagccccgugcaguccgcccccaucucacacgggaagacgaucgagaccuaccagguccgggaggaguacaccuccaucugccucuucgugcuggggagcauccuguucaucguguccugccucaugaaggggcuggucaacagcgugggcaacaucuucuuccccgggcuguccaucuguaagaccugcagcaucggcuccaucaacggcuucgagaucgagagccacaagugcuacugcuccuuacugugcugcccguacugcaggcacugcucagcggaccgggagauacaccagcugcaccucuccauuugcaagaagcgcaagacggggagcaacgugaugcuggcagucuguaagcgaaugugcuuccgcgccaccauggagguguccaacaaggcccuguucauccgaagcaucaucaacacuaccuucguggucuguauucucauccuggccgugugcgugguuuccacgagcgcgguggagauggagucccugcccgccggcacgugggagcgggaggaggaccucaccaacuucugccaccaggagugccaggugaccgagacggagugccugugccccuacgaagcccugguccucagacggccgcuguuccaagacagcaucgugaaggggaugaagaaccugcuaaacagcaccuccuuagagaccagcuuguccaucgaggcccccuggggcgcgaucaacguccagagcaccuacaagccggcggucuccgccgccaacauugcccucagcugguccagcguagagcaccgcggguccaagauccuggugagcgggcgguccgagagcaucaugaagcuggaggagcgcacgggcaucuccugggacuugggggucgaggacgccagcgagagcaagcuguuaaccgugagcgugauggaccucucacagauguacagccccgucuucgaguaucuguccggugaccgccagguggaggaguggccgaaggcgacgugcaccggggacugccccgagcgcugcggcugcacgagcagcacgugccuucacaaggaguggccacacucccggaacuggcggugcaaccccaccuggugcugggguguggggaccggcugcaccuguugcgggcucgacgucaaggaccuguucaccgacuacauguucgugaaauggaagguggaguacauaaagacugaggcuaucgucugcguggagcugaccagccaggagcggcaguguucccucaucgaggccggcacgcgcuucaaccuggggccggucacgaucacccugagcgagccccguaacauccagcaaaagcucccgcccgaaauuaucacccugcaccccagaaucgaggagggcuucuucgaccuuaugcacgugcagaaggugcucuccgccagcaccgucugcaagcugcaguccugcacgcacggcgugcccggggaccuccagguguaccacaucgguaaccugcugaagggagaccgggucaacggucaccucauccacaagaucgagccccacuucaauaccagcuggauguccugggacgggugcgaucucgacuacuacugcaacaugggcgacuggcccagcugcacguacaccggcgugacgcaacacaaccacgcguccuucgugaaccugcuaaacauagagaccgacuacaccaagagcuuccacuuccacuccaaacgcgugaccgcccacggggacacgccgcagcucgaccugaaggcccggcccaacuacggcgccggggagaucaccgugcuaguggagguagccgauauggagcuccacaccaagaagauugagaucagcgggcugaaauucgcgucccugaccugcacggggugcuacgccugcucauccggcaucagcugcaaggugcgcauccacguggacgagcccgacgagcucaccguccacgugaaguccgacgacccagacgugguggccgccagcagcucacugauggcccggaagcuggaguucggcaccgacagcaccuucaaggcguucuccgccaugccgaagacgagccucugcuucuacaucguggagcgcgaguacuguaaguccugcagcaaggaggauacccagaagugcgugaacaccaagcuggagcagccccagucuauccugaucgagcacaaggggaccaucaucggcaagcagaacaacaccuguaccgccaagaccagcugcuggcucgaguccgucaagagcuucuucuacggucuaaagaauaugcuuuccggcaucuucgggaacguguucgucggcaucuuccucuuccuggcccccuucauccugcugauccucuucuucauguucggcuggcggauccuguucugcuucaaaugcugccgccgcacgcgggggcuguuccgcuacaagcaccuagagaacgacgaggagacgggcuacaggaggaucaucgagcggcugaacaacaagaaggggaagaacaaacuuuuggacggcgagcgccuggccgaccggcgcaucgcggagcuguucuccaccaagacccacaucggcuga

SEQ ID NO: 15300 - RNA, 5055 nt, Artificial Sequence
  derived and/or modified CDS sequence (opt11) from CCHFV(K168_125)__KX013460.1__GP
augcacaucucacugaugugcgccgugcucugccuucagcuguacggccucggcgggacccacggguugcacaacgggaccgagcacaacaagacgaacgcggucacuaccuccagcaacucccagagcuccgagagccccgcgcggaccgccccacccgugacaccggauucccccaccgugaccccgaccacgccugccuccgcccccgaggggaguggcgaggcucacagcuccccgcccaacaacaccgagggccccagccugcccgagucaacaagcgagcccccugcagccaccuccacggggauccccagcgcguccgacgucaacagcucgacccaagcggcgcgggacaccagcacccccacggugcggaccagcccaccgaacucccccucuacuccgcccaccccgcaggagacgcaccaccccgugcgaaaucuccuguccgucaccagccacaagccggaggagacaagugcccccucggaguccggcaaagagagcccggccgccaacagcccccaccccguggccagccggcccccgacccccuccacgaccgcgcagggcccaacggagaacaacaacuacaacaccacgggccagcuugagagccuaacacaguccaccacccuggguccaaugacaagccugacccagaccgaccucccccaguccgugaccagcauugccguccaggacacgcaccccucccccaccaaccgcucgaagcgcaaccuggagauggaaaucauccugacccucccacagggcuuaaagaaguacuacggcaagguguuacggcugcugcagcugacccucgaggaggacaccgaggggcugcuggaguggugcaagcgcaaccucggccuggacugcgacgacaccuucuuccagaagcggaucgaggaguuuuucaucaccggggagggccacuucaaugaggugcugcaguuccgcacccccgggacccuguccacuacagagagcacccaugccggccuucccaccgccgagcccuucaagagcuacuuugccaagggcuuccuguccaucgacagcggguacuucuccgcgaagugcuacagccggacguccaacagcggccuccagcugaucaacgucacccgccauuccacacggaucgccgacaccccggggcugaagaucacgaaccucaagaccaucagcugcaucaaccugaaggccuccguguucaaggagcaccgcgagguagagaucaacguccugcucccccagguggccgugaaccugagcaacugccaugucaccaucaagucccacgugugcgacuacagccuggacaucgacggcaccguacggcucccccacauccaccacgacggcacguucauccccgggaccuacaagaucgucaucgaccgcaagaacaagcugaacgaccggugcacccuguucacgaacugcgugaucaagggcagagaagugcggaaggggcagucuguccuccgucaguacaagacggagauccggaucggcaaggccuccaccgggucccgcaggcugcugagcgacgaguccggcgacgacugcaucucacggacccagcuacugcgcaccgagacggcggagauacacggcgacaacuacgggggcccgggggacaagaucacuaucugcaacggcagcaccaucguggaccagcggcugggguccgagcucgggugcuacaccaucaaccgcguaaaauccuucaagcugugcgagaacuccgccacuggcaaaaguugcgaaguggacuccauccccgugaagugccggcagggguacugccuuaagaucacccaggagggccgcgggcacgucaagcugagccggggcuccgagguggugcucgacgccugugacagcucaugcgaggucaugaucccaaagggcaccggggacauucugguggauugcagcggcgggcagcagcacuucuuaaaggacaaccucaucgacuuaggcugccccaaggugccgcugcucgggaagauggccauauacaucugccgcauguccaaucaccccaagaccacgauggcauuccuguucugguucucguucggcuacgucauaaccugcaucguuugcaaggcgaucuucuaccugcucaucaucguggguacccuggguaagcgguucaaacaguaccgcgagcugaagccccagaccugcacgauuugcgagaccacccccaccaacgccaucgacgccgagaugcacgaucucaacugcuccuacaacaucugcccguacugcgccagccggcugaccagcgacggccuggcgcgucacguuacgcacugccccaagcggaaggagaagguggaggagaccgagcucuaccugaaccuggagcggauccccuggguggugcggaagcuccuccaggugucagaguccaccgggguggcacugaagcgaagcuccuggcucaucguacuccuggugcuguucgccgugagucugagccccgugcaguccgccccgaucggccacgggaagaccaucgagacuuaucaggugcgugaggaguacacgagcaucugccuguucgugcucggcuccauccuguucaucgucagcugccugaugaagggccucgucaacuccguggggaacaucuucuuccccggcuuaagcaucugcaagaccugcuccaucgggagcaucaacggcuuugaaauagagucccacaagugcuacugcagccugcucugcugccccuacugccgccacugcuccgccgaccgggagauccaccagcugcaccugagcaucugcaagaaacgcaagaccggauccaacgucauguuggcggugugcaagcgcaugugcuuccgggccacgguggaggucuccaacaaggcccuguccauccgcagcaucaucaacaccaccuucgugguuugcauccugauccuggcaguaugcgugguguccaccagcgccgucgagauggagucccugccggcgggcacgugggagcgggaggaggaccugacuaacuucugucaccaggagugccaagugaccgagaccgagugccucugccccuacgaggcucuggugcugcgccggccccucuuccucgacagcaucgugaaggguaagaagaaccugcucaacagcacgucccuggagaccagccuguccaucgaggccccuuggggugccauaaacgugcagagcacguacaagccgaccgugagugcggcgaacaucgcccucagcugguccagcgucgaacaccgcgggaacaagauccuggucuccgggcggagcgaguccaucaugaagcuggaggagcgcaccggcauaagcugggaccucgggguggaggacgccuccgagagcaaacugcugaccgucuccgugauggaccucagccagauguauucccccguguucgaguaccugagcggcgacagacaggucgaggaguggcccaaggcgaccugcaccggcgacugccccgagcgcugcgggugcacuuccagcacaugccugcacaaggaguggccgcauagccggaauuggcgcugcaaccccaccuggugcuggggcguggggaccggcugcacgugcugcggccuugacgugaaggaccuguucaccgacuacauguucgucaaguggaagguggaguacauuaagaccgaggccaucgucugcgucgagcugaccucccaggagcggcagugcucgcucaucgaggccgggacccgcuuuaaccugggccccgugacaaucacccuguccgagccccggaacauccagcagaagcucccgcccgagaucaucacccugcacccccgcaucgaggagggguucuucgaccugaugcacguccagaaggugcucagcgccuccacggugugcaagcugcagagcuguacccacggcgucccuggagaucuccagguguaccacaucggcaaccugcugaagggcgacaaggugaacgggcaccucauccacaagaucgaaccgcacuucaacaccuccuggaugagcugggacggcugcgaccucgacuacuacugcaacaugggggacuggcccuccugcaccuacaccggcgucacgcagcacaaccacgcgagcuucaucaaccugcugaacaucgagaccgacuauaccaagagcuuccacuuucacagcaagcgggucaccgcccauggagacacaccccagcuggaccugaaagcucgccccaacuacggcgccggcgaaaucaccgugcuugucgagguggccgacauggagcuccacaccaagaagaucgagaucuccgggcugaaguucgccucgcugaccugcacgggcugcuacgccugcuccucugggaucuccugcaagguccggauccacgucgacgagccggacgaacucacggugcacgucaagagcgacgaccccgacgugguagcagccuccucaagccugauggcccgcaagcuggaguucggcaccgacuccaccuucaaggccuucagcgccaugcccaagacgucgcucugcuucuacaucguggagcgagaauacugcaagagcugcuccaaggaagacacccagaagugcguaaacaccaagcuggagcacccccagagcauccugaucgagcacaaggguacaaucaucggcaagcagaacaacacgugcaccgcaaagaccuccugcuggcucgagagcgugaaguccuucuucuacggccugaagaacaugcugagugguaucuucggcaacguguucgucgggaucuuccucuuccuggcccccuucauccugcugauccuuuucuucauguucggcuggcggauucuguucuguuucaaaugcugccgccggacccgcggacuguuccgguacaagcaccucgaggacgacgaggagacgggauaccgccggaucaucgagcgccugaacaacaagaagggcaagaacaagcugcucgauggagagcgguuagccgaccgccggaucgccgagcuguucuccaccaagacccacaucggcuga

SEQ ID NO: 15301 - RNA, 5052 nt, Artificial Sequence
  derived and/or modified CDS sequence (opt11) from CCHFV(Kosova Hoti)__EU037902.1__GP
augcacacccugcucgugugcuucauccuguaccugcagcuccuuggccucgggggcgcacacgggcaaagcaacgccacggagcacaacggcacgaacaccaccaccgcgcccgggacgucccagagcccgaagccgcccgccuccaccacccccagccacgcccccgagcccuccaccaucaagcucacgacccccacaagcgagaccgagggcuccggcgagacgacgccaccgaccaacaccacgcaggacagcccgccccuggagacgacccccgagcgcuccgcuaccacggccacaagcaccuccgggaccgacaauaugaacagcacgacccagaugaccgacaauacccccacguccaccgucagcaccucccugagcuccagccccuccaccccaagcacgagccaaggcaugcaccaccccgugcggucccuccugucugugucgagcccgaaaacagcgaccacccccacgcccaugucccccggggagaugagcuccgagaccagcucccagcacagcgccaugucccgcaccccgacgccccacaccgccacccaggucagcaccgagaaugccaaccgguccaccagccgccagucagagagcuccgcacagcccgccacccagagccccgugacguccccggcccagagcauccugcuuaugagcgccacccccaccacaauccagaacauccaccccucccccacuaaccguagcaagcgcaaccuagagauggagaucauccugacccucucccagggccugaagaaauacuacgguaagauccugaaacuucugcaccugacccucgaggaggacaccgagggucugcuggaguggugcaagcggaaccucggcagcaacugcgacgacgacuucuuccagaagcgcaucgaggaguucuucaucacgggggagggcuacuucaacgaggugcugcaguucaagacccuguccaccccguccuccaccgagccgagccacgcccgccuccccacggcggagccguucaaguccuacuucgccaagggguuccugagcaucgacagcggcuacuucagcgccaagugcuacccccgcuccagcaccuccggccugcagcucaucaacgucacccagcaccccgcccguaucgccgagacccccgggccgaagacgaccagccugaagaccaucaacugcaucaaccugcgcgcguccguguucaaggagcaccgggagguggagaucaacguccuccugccccagaucgccgugaaccugagcaacugucacguggucaucaacagccacgugugcgacuacucccucgacaccgacggccccgugagacugcccaggaucuaccacgaggggacguucaugccgggcaccuacaagauagucaucgaccgcaagaacaagcugaacgaccggugcacccucgugaccaacugcgugaucaaggggcgcgagguccggaagggccagagcgugcugcgccaguacaagacggagaucaagaucggcaaggcccccacugggucccggaagcugcucagcgaggagcccggcgacgacugcaucucccgcacccagcugcugcgcaccgagacggccgaaauccacgacgacaacuacgggggccccggggacaagaucaccauuugcaacggcagcaccaucguggaccagcggcucggcuccgagcuggggugcuacaccaucaaccgugucaagagcuucaagcugugcgagaacuccgccacgggcaagaccugcgagaucgacagcaccccggugaagugccggcagggguucugccucaagaucacccagaagggccgcgggcacgugaagcugucccggggcagcgaggucgugcuggacgccugcgacuccaacugcgaggucaugauccccaagggcaccggggacauccugguggacugcagcggcgggcagcagcacuuccucaaggauaaccugaucgaccugggcugcccccacaucccccuccugggcaagauggccaucuacaucugccgcauguccaaccauccgaagacaaccauggccuuccuguucugguucagcuucggguacgugauaaccugcaucuucugcaaggcccucuucuacucccugaucaucaucggcacccuggggaagaagaucaagcaguaccgggagcucaagccccagacgugcaccaucugcgagaccgcccccgugaacgcuaucgacgccgagaugcacgaccugaacugcagcuacaacaucugccccuacugcgccucccgccugaccagcgauggccucgcccggcacgugaagcagugcccgaagcgcaaggagaagguggaggagacggagcuguaccugaaccucgagcggauccccugggucgugcgcaagcugcugcagguaagcgaguccaccggggucgcgcucaagcggagcuccuggcugaucgugcugcucgugcugcugaccgucagccucucccccgugcagagcgccccugugggccacggcaagaccaucgagacguaccagacccgcgagggguucaccuccaucugccucuucaugcugggcagcauccucuucaucguauccugccuggugaagggguugguggacagcgucuccgacagcuucuucccgggccucuccgugugcaagaccugcagcaucggguccaucaacggcuucgagaucgagagccacaagugcuacugcucccuguucugcugccccuacugccggcacugcagcgccgaccgcgaaauccaccagcugcaccucaacaucugcaagaagcggaagacgggcuccaacgugaugcuggccgucugcaagcgcaugugcuuccgggccaccaucgaggcgagccgccgcgcccugcugauccggagcaucaucaacaccaccuucgugaucugcauccugacgcugaccaucugcguggucuccaccagcgccguggagauggagaaccuacccgccgggacuugggaacgcgaggaggaccugacgaacuucugucaccaggagugccaggugaccgagaccgagugccugugcccguaugaggcccucguccugagaaagccucuguuccucgacuccaucgugaagggcaugaagaaccugcugaacagcaccucccucgagacgagccugucgaucgaggcgcccuggggcgccaucaacgugcagagcaccuucaagcccaccgucuccaccgccaacaucgcccugagcugguccagcguggagcacagggggaacaagauccucgugacggggcguuccgagagcaucaugaaguuagaggagcgcaccggcaucuccugggaccugggcgucgaggacgccagcgaguccaagcuccugaccgugagcaucauggaccugucccagauguacagcccgguguucgaguaccucagcggggaccgccaggucgaggaguggcccaaggcgaccugcacgggcgacugcccccagcgcugcgggugcaccuccagcacgugccugcacaaggaguggccccacucccggaacuggcgcugcaacccgaccuggugcuggggcguggggaccggauguaccugcugcggcguggacguuaaggaccuguucaccgaccacauguucgugaaguggaagguggaguacaucaagaccgaggccaucgucugcguggagcucaccagccaggagcggcagugcucccugaucgaggccgggacgagauucaaccugggccccgucaccaucacccucagcgagccccggaacauccagcagaagcugcccccggagaucauaacccugcaccccaagaucgaggagggguucuucgaccucaugcacguccagaaggugcuauccgccagcacggugugcaagcugcagucgugcacccacggcauccccggugaccuccaggucuaccacauagggaaccugcugaagggcgaccgcgugaacgggcaccucauccacaagaucgagccccacuucaacaccagcuggaugucuugggacggcugcgaccuggacuacuacugcaacaugggggacuggccgagcugcaccuauacgggcgugacccagcacaaccacgcggccuucgucaaccugcucaacaucgagaccgacuacaccaagacguuccauuuccacuccaagcgggugaccgcccacggcgacacgccccagcuggaccugaaggcgcgcccaaccuacggggcgggcgagaucacgguccucguggaaguggcggacauggagcugcacaccaagaaggucgagauaagcgggcugaaguucgccucccucgccugcaccggcugcuacgccugcagcuccgggaucagcuguaaggugcggauacacguggacgagccagacgagcuaaccguccacgugaaguccagcgacccggacguggucgccgcgggcacgagccugauggcccgcaaacucgaguucggcaccgacuccaccuuuaaggccuucagcgccaugcccaagaccucccugugcuucuacaucguggagaaggaguacugcaaguccugcuccgaggacgacacgaagaagugcguggacaccaagcuggagcagccccagagcauccucaucgagcaccgggggaccaucaucggcaagcagaacgauaccugcacggccaaggcauccugcuggcuggagucggucaaguccuucuucuacgggcugaaaaacaugcucggcagcguguucgggaacuucuucaucggcauccugcuguuccucgcucccuucgugcugcugguccuguucuucauguucggcuggaagauccucuucugcuucaagugcugccgccggacccgcgggcuguucaaauaccgccaccugaaggacgacgaggagaccggcuaccggcgcaucaucgagcggcucaacaacaagaaggggaagaaccgccugcuggacggcgagcggcucgccgaccgcaagaucgccgaguuauucuccaccaagacgcacaucggcuga

SEQ ID NO: 15302 - RNA, 5049 nt, Artificial Sequence
  derived and/or modified CDS sequence (opt11) from CCHFV(Oman)__DQ211632.1__GP
augcacaccuuacucguguacgccgucuucugcuugcagcuauggucucccggcgggacccgcggccucucaaaugagacgcagcauaacgagacagggaucacccgggccccggagggcagccagggccccucccugccugugaguaccgcgagccccauaaugagcgacccguccaucacuacccccagcgccagcaccagcggccuggaaggaagcggggacacgacgccacccgccauuacccagggcccuaccccgcccgagaccacgcccgagcccagcaccaccaccggaacaaacgccuucuccaccgcaaucgccaacgucagcacccaaaccgucaaggacacgccaacccccacugugcagaccuccccgccgagcacgcccgacgcguccaccaucccccagggcacacaccacaccgcucgagggcuccuaagcgugaccgucaccaagcccgaagaggugccgaccccgaccggccccgagcaagccuccaucgagacgaacucgccccggcuggcgaccucuaagacuccgucccccagcccaacggcccaagugacgaccgagaacagcaaccccaacaccucucgccagcucguccuguccacccagccggccaccagcuccccaguuacgagcccggcccaguuaaucuucgugcagagugccaccaccgucgcggugcaggacgcgcacccgagccccacaaaccguuccaagcgcaaccucgaaauggagguaauacugacgcugucgcagggccuccggaaguacuacgggcgcauccuuaagcugcucgaccugacgcuugaagaggauaccgagggccuccuugaguggugcaagcgaaaccuggggcucacgugcgacgacaacuucuuccagaaacgcaucgaggaguucuuccugacgggcgagggccacuucaacgaaguccugcaguucaagacacccuccacccucucuuccaccgaaagcgccucagucgggcugcccacgguggagccguucaaaucuuacuucgccaaaggcuucuugucuaucgacagcggguacuucucagccaagugcuaccccagagcguccaacagcggucuccagcugaucaaugugacccagcacuccgcccgcaucgccgacacccccggucccaagaucaccaaccuuaagacgauaaacugcaucaaccuuaaggcccugguguucaaggaacaucgggagaucgagaucaacgucuuacucccccaagucgccgugaacuuaucuaacugccaugugcacaucaagucucacgucugcgauuacagccuggacauugauggcaccguccgacucccccggauccaccacgagggcaccuuuauccccgggaccuacaagaucgugaucgacaagaagaauaagcagaacgaccgcuguaaccuggugacgaacugcgugauuaagggcagggagguccgaaaggggcaauccguucugcgccaguaccgcaccgagauacggaucgggaaggccagcuccgggagccgcaggcugcuuagugaggagucaggcgaagacugcauuucacgaacccaacugcuccguaccgagacugccgagauccacggcgacaauuacggggguccuggggacaaaaucaccaucugcaacgguagcaccaucguggaccagcggcugggguccgagcugggcugcuacaccaucaaccgcgucaagagcuucaagcucugugagaacucagccacaggcaagucgugugagauugacaacaccccggugaagugcaagcaaggauucugccugaaaaucacccaggagggccgggggcacgucaagcugagccgcgacuccgagguagugcuggacgcgugcgacagcuccugcgagaucaugauuccaaaaggcaccggcgauauccucgucgacugcucgggaggccagcagcacuuccugaaggacaaccugaucgaccuaggcugccccaacauaccccugcuaggcaagauggccaucuacaucugccggaugaguaaccacccgaagacgaccauggcguuucucuucugguucuccuucggguacgucaucacgugcauccugugcaaagugaucuucuacuuacucaucguagucggcacccugggcaagaaguucaaacaguacagagaacugaagccccagaccugcacaaucugcgagacaacgcccgugaaugccaucgacgccgagaugcacgaccucaacugcaguuacaacauuugccccuacugugcuagccggcugaccuccgacggucuggcgcgccacgugaugcaguguccgaagcggaaggagaagaucgaggagacggagcucuaccuuaaccuagagcgcauccccugggucguuaggaagcuccuccaggugagcgaauccacuggaguagccuugaagcggagcuccuggcucaucguacuguuagugcuccugaccguuagccugagccccgugcaguccgccccaaucgggcacggcaagaccaucgagacuuaucagacacgggagggauacaccuccaucugccucuucgugcugggcuccauccuguucaucgucucacaccucaugaagggccugguggauucgguagggaacagcuucuucccgggucugaguaucugcaagaccuguaguaucggguccaucaacggcuucgagauugagagccacaaguguuuuugcucccucuucugcugcccuuauuguagacacugcagcgccgacaaggagauccacaagcugcaccugucaauuuguaagaagcggaaggcugggaguaacgucaugcucgcggugugcaagcgaaugugcuuccgggccacgauggagguguccaacaaagcccugcugauccgcagcgucaucaauaccacuuucguugugugcauccucauccuggcugucugcgucguguccacuagcgccgucgagauggagucccuccccgcgggcacgugggagcgcgaggaggaccucacgaacuuuugccaucaagagugccaggugaccgagaccgaaugccugugcccauacgaagcccugguacuccggaaaccccuguuccuggauagcauugccaaggguaugaagaaucuucuaaacuccacgucgcuggaaaccuccuuaagcaucgaggcccccuggggcgccauuaacguccagucaaccuucaagccgaccgugucgaccgccaacaucgcccugucauggucuagcguggaacacagagggaacaagauccuggucuccgggcggagcgaguccaucaugaagcucgaggagagaaccgguaucagcugggaucuggggguggaggacgccuccgagagcaaguugcuuaccguguccgucauggaucugagccagauguacuccccuguauucgaguaccuaagcggggaccgccagguagaggaguggccgaaggcgaccugcacaggagacugccccgagcggugcgggugcaccagcagcacgugccuccacaaggaguggccccacagccggaacuggcgguguaaccccaccuggugcuggggcgucgggaccggcugcacguguugcggccuggacgugaaggaccuguucacggacuacauguucgugaaguggaagguggaguauaucaagaccgaggccaucgugugcgucgagcucaccagccaggagcggcagugcuccuuaaucgaggccgggacccgcuuuaaccugggccccgugaccaucacccucagcgagccccgcaacauccagcagaagcugccaccggagaucgugacgcugcacccccgcaucgaggagggcuucuucgaccucaugcacguucagaagguguuguccgccuccaccguauguaagcugcagagcugcacccacggcguccccggggaccuccagguguaccauauuggcaaccugcugaagggcgauaaggugaacgggcacuuaauacauaagguugagccacacuucaacaccagcuggaugagcugggacggcugcgaucuggacuacuacugcaacaugggggacuggccgucuugcaccuacacgggcgugacccagcacaaccacgcugccuuugucaaccugcucaacaucgaaacagacuauacgaagaacuuucacuuccacagcaagcgggucacggcgcauggggacaccccucagcuggacuugaaggcacgccccaauuacggcgccggcgaagugacugugcucgucgagguggccgacauggagcuucacaccaagaaaaucgagaucucugggcugaaguucgcauccuuaacgugcaccggcugcuacgcaugcuccagcgggaucagcugcaagguacggauccacgucgacgaacccgaugagcuuaccguucacgucaaguccgaagaccccgacauaguggccgccuccagcucccugauggcgcgcaagcucgaguucggcaccgacagcacuuuuaaagccuucuccgcgaugcccaaaacuagccuuuguuucuacaucguggagcgcgaguacugcaaguccugcagcaaagaagacacccaaaagugcgugaaugccaagcuggagcgcccccagaguauacucauagagcauaaggggacgaucaucgguaagcaaaacgacacgugcaccgccaaagccagcugcuggcuggaaucggucaagagcuucuuuuacggccugaaaaacaugcucagcgggaucuuuggaaacguauucaucgggaucuuucuguuccuggcgcccuucauacugcugauccuguucuucauguucggguggcggauccuguucugcuucaagugcugucgacgcacccgaggucucuucaaguaccgccaccugaaggacgacgaggagaccggguaccgaaagaucaucgagcgccugaacaacaagaagggcaagaacaagcuccuggacggggagcgccuggccgaccgcaaaaucgcugagcuuuuuagcaccaaaacccacaucggcuga

SEQ ID NO: 15303 - RNA, 5049 nt, Artificial Sequence
  derived and/or modified CDS sequence (opt11) from CCHFV(Oman_812956)__KY362518.1__GP
augcacacccugcucguguacgccguguucugccugcagcuguggagccccggcgggacccgcggccuauccaacgagacgcagcacaacgagaccggcaucacccgggccccggagggcagccaggggcccucccugcccgugagcaccgcgucccccaucaugagcgacccguccaucacgacccugagcgccuccaccagcggccucgagggcuccggggacaccacuccacccgccaucacccagggccccacccugccggagaccacgcccgagcccagcaccaccaccgggacgaacgccuucuccaccgccaucgcgaacgugucgacccagaccgucaaggacacgcccaccccgaccgugcagaccuccccgcccagcacgcccgacgccuccaccaucccgcaagguacacaccacaccgcccgcgggcuccucagcgugacggucaccaagcccgaggaggugcccaccccaaccggcccggagcaggccuccaucgagacgaacagcccccggcuggcgaccagcaagacccccucccccagcccgaccgcccaggugacgaccgagaacuccaaccccaacaccagccgccagcugguccucuccacucagcccgccaccagcucccccgugacgagccccgcccagcugaacuucgugcagucggccacaaccaucgcgguccaggacgcccaccccagccccaccaaccgguccaagcgcaaccuggagauggaggugauucucacgcugagccagggccugcggaaguacuacgggcgcauacucaagcugcuggaccucacccuggaggaggacaccgagggccuguuggaguggugcaagcggaacuuagggcugaccugcgacgacaacuucuuccagaagcgcaucgaggaguucuuccucacgggcgagggucacuucaacgaggugcugcaguucaagaccccguccacccugagccccaccgaguccgccagcgucggucugcccacgguggagcccuucaaguccuacuucgccaagggcuuccugagcaucgauuccggguacuucagcgccaagugcuacccgcgggcgagcaauuccggccugcagcucaucaacgugacccagcacagcgcccgcaucgccgacacuccugggcccaagaucaccaaccugaagacgaucaacugcaucaaccugaaggcccucguguucaaggaacaccgggagaucgagaucaacgugcugcucccccagguggccgucaaccuuuccaacugccacgugcacaucaagagccacgugugcgauuacucccuggacaucgacggcaccguccgccugccgcggauccaccacgagggcaccuucauccccgggaccuacaagaucgugaucgacaagaagaacaagcagaacgaccgcuguaaccucgucacgaacugugugaucaagggccgggagguccgcaaggggcagagcguccugcggcaguaccgcacggagauccggaucggcaaggcguccagcgguucccgccgccugcucagcgaggaguccggcgaggacugcauuagccggacccagcugcugcggaccgagacggccgagauccacggcgacaacuacgggggccccggggacaagaucaccaucuguaacgguuccaccaucguggaccagcggcucggcucugagcugggcugcuacaccaucaaccgcgugaaauccuucaagcugugcgagaacagcgccacgggcaaguccugcgagaucgacaacacccccgucaagugcaagcagggguucugccugaagaucacccaggaaggccgggggcacgugaagcucagccgcgacagcgaggugguccuggacgccugcgacuccagcugcgagaucaugaucccaaagggcaccggcgacauccugguggacugcuccgggggccagcagcacuuccucaaggacaaccugaucgaccuggggugccccaacaucccccuccuagguaagauggccaucuacaucugccggaugagcaaccaccccaagacgaccauggcuuuccuguucugguucuccuucggguacgugaucacgugcauccucugcaaggucaucuucuaccugcugaucguggugggcacccuuggcaagaaguucaagcaguaccgcgaacugaagccgcagaccugcaccaucugcgagacaacccccgucaacgccaucgacgccgagaugcacgaccugaacugcagcuacaacaucugccccuacugcgcguccagacucacuagcgacgggcuggcgagacacgugaugcagugccccaagcggaaggagaagaucgaggagacggagcuguaccucaaucuggagcgcaucccgugggugguccggaaguuacuccagguguccgagagcaccggcguggcccugaagcgcuccagcuggcugaucguccuccuggugcugcucaccgugucccugucacccguccaguccgcacccaucgggcacggcaagaccaucgagacguaccagacccgggagggguacaccagcauuugccuguucgugcucggcucaauccuguucaucgugagccaccugaugaagggccucgucgacuccguggggaacagcuucuuccccggccugagcaucugcaagaccugcuccaucgguagcauaaacggcuucgagaucgagucccacaagugcuacugcagccuguucugcugcccguacugccgccacugcuccgccgacaaggagauccacaagcuccaccugagcaucugcaagaagcggaaggccggguccaacgugaugcuggcggucugcaagcgcaugugcuuccgggccacgauggaggugagcaacaaggcccuccugauccgcuccgugaucaacaccaccuucgucgugugcauccugauccucgccgugugcguagugagcacauccgccguggagauggagagccugcccgcgggcacgugggagcgcgaggaggaccugaccaacuucugccaccaggagugccaggucaccgagaccgagugccucugccccuacgaagcccuggugcugcggaagccccucuucuucgacuccaucgccaagggcaugaagaaccugcugaacagcaccucccucgagaccucgcucuccaucgaggcccccuggggcgccaucaacgugcagagcaccuucaagcccaccgucuccacggcgaacaucgcccugagcuggagcuccguggagcaccgcgggaacaagauccucgugagcgggcgguccgagagcaucaugaagcuggaggagcgcaccggcaucuccugggaccugggggucgaggacgccagcgaguccaagcuccugaccgugagcgugauggaccugucccagauguacagccccgucuucgaguaccucuccggcgaccgccagguggaggaguggccgaaggcgaccugcacgggcgacugccccgagcggugcgggugcaccagcuccaccugucugcacaaggaguggccccacagccggaacuggcgcugcaaccccaccuggugcuggggcguggggaccggcugcacgugcugcggccuggacgucaaggauuuguucaccgacuacauguucgugaaguggaaggucgaguacaucaagaccgaggccaucgugugcguggagcugaccucccaggaacggcagugcagccugaucgaagccgggacccgcuucaaccucggcccggucaccaucacccuguccgagccccggaacauccaacagaagcugccgcccgagaucgugacgcuccacccccgcaucgaagagggguucuucgaccugaugcacgugcagaagguccugagcgccuccacagugugcaagcuccagagcugcacccacggcgugcccggagaccugcaggucuaucacaucggcaaccugcucaagggcgacaaggugaacgggcaccugauccauaagguggagccccacuucaacaccagcuggauguccugggacggcugcgaccuggacuacuacugcaacaugggggacuggcccagcuguaccuacacgggcgucacccagcacaaccacgccgccuucgugaaucuccugaacaucgagaccgacuacaccaagaacuuucacuuccacuccaagcgggugacggcgcacggggacaccccgcagcuggaccucaaggcccgccccaacuacggcgccggcgagaucaccguccugguggagguggcggacauggagcugcacaccaagaagaucgaaauuagugggcucaaguucgccuccuuaacgugcaccggcugcuacgcgugcagcuccgggaucagcugcaagguccggauccacguggacgagcccgacgagcugaccgugcacgucaaguccgaggaccccgacaucguggccgccagcuccagccucauggcccgcaagcuggaguucggcaccgacuccacguuuaaggccuucagcgcgaugccgaagacaucccugugcuucuacaucguggagcgggaguacugcaagagcugcuccaaggaggauacccagaagugugucaacgccaagcucgagcgcccccagagcauccugauagagcacaaggggaccaucaucggcaagcagaacgacacgugcaccgccaaggccuccugcuggcuggagagcgucaagagcuucuucuacggccucaagaacaugcuguccgggaucuucggcaacguguucaucgggaucuuccuuuuccuggcgcccuucauccuccugauccuguucuucauguucggcuggcggauccucuucuguuucaagugcugccgccggacccgcggccuauucaaguaccgccaccugaaggacgacgaggagaccggguaccggaagaucaucgagcgccucaacaacaagaaaggcaagaacaagcuccuggacggggagcggcucgccgaccgcaagaucgccgagcuguucagcacgaagacccacaucggcuga

SEQ ID NO: 15304 - RNA, 5049 nt, Artificial Sequence
  derived and/or modified CDS sequence (opt11) from CCHFV(Oman-199809166)__KR864901.1__GP
augcacacacugcucguguacgccguauucugucugcagcucuggagccccggcgggacccgcggccucuccaacgagacgcagcacaacgaaaccgggaucacacgggcccccgagggcagucaggggccaucccugcccgugagcaccgcgagccccauaaugagcgauccuuccauuacgacccugucugcuuccacuucgggccucgagggcuccggcgacacaacgccgcccgccaucacccagggccccacucugccagagaccacacccgagcccagcaccaccaccgggacgaacgcguucuccacugccaucgcgaacgucagcacccaaaccgucaaggacacgcccaccccaaccgugcagaccuccccgcccagcacgcccgacgccuccaccauuccacagggcacgcaccacacagcccgcgggcugcucagcgugacggucaccaaacccgaggaggugcccacucccacuggcccggagcaggccuccaucgagacgaacagcagccggcuugcgaccuccaagacccccagccccuccccgaccgcccaagugacgaccgagaacuccaauccgaauacuucccgccaguuaguccucagcacccagcccgccacuuccagccccgugacgucccccgcacaguugaacuucgugcagucagccaccaccaucgcgguccaggacgcacacccgucccccacuaaccgaagcaaacgcaaccuggagauggaggucauacuaacgcugucccaaggccugagaaaguacuacgggcgcauccucaaacuucuggaccucacgcuggaggaggacaccgagggcuuacucgaguggugcaagcggaaccuggggcugaccugcgacgacaacuucuuccagaagcgcaucgaggaguucuuucucacgggcgagggccacuucaacgaggugcugcaguucaagacccccagcacgcugucuccgaccgaaagcgccuccgucgggcuccccacgguggagcccuucaagagcuacuucgccaagggcuuccuguccaucgacagcgguuacuucagcgccaagugcuauccgcgggcguccaacagcggccugcagcucaucaacgugacccagcacagugcccgcaucgccgacaccccggggcccaagaucaccaaccugaagacgaucaacugcauaaaccucaaggcccucgucuucaaggagcaccgggagauagagaucaacguucugcugccccagguggccgucaaccucagcaacugucacgugcacaucaagucccaugugugcgacuacagccuggacaucgacggcaccguccgacugccccggauccaccacgagggcaccuucaucccggggaccuacaaaaucgugaucgacaaaaagaacaagcagaacgaccgcugcaaccuagucacuaacugcgugaucaagggccgagaggugcgcaaggggcaguccguccugcggcaguaucgcaccgagauccggauuggcaaggcgagcuccgggagccgccgccuccucuccgaggagagcggggaggacugcaucucccggacccagcugcugaggaccgaaacggccgagauccacggggacaacuacgggggcccaggggacaagaucaccaucugcaacggcagcaccaucguggaccagcggcuaggguccgagcugggcuguuacaccauaaaccgcgucaaguccuuuaagcugugcgagaacuccgccacgggcaaguccugcgagaucgacaacacucccgugaagugcaaacagggguucugccugaagauuacccaggagggccgggggcacgugaagcucagccgcgacucugagguggucuuggacgcgugcgauagcuccugcgagauuaugauccccaagggcaccggcgacauccugguggacugcucugggggccagcagcacuuccuuaaggauaacuugaucgauuuaggaugccccaacauaccccuccugggcaagauggccaucuacaucugcagaauguccaaccaucccaagacgaccauggcguuccuauucugguucagcuucggguacgugaucacgugcauccucugcaaagucaucuuuuaccuucugaucguggugggcacccucggcaagaaguucaagcaguaccgggagcuuaagccccagacaugcaccaucugcgagaccaccccaguaaacgcuauagaugccgagaugcaugaccugaacugcuccuacaauaucugccccuacugcgccagccgguuaaccuccgaugggcuagcgcgccacgucaugcagugcccgaagcggaaggagaagaucgaggagacggagcuguaccucaaccuggagcgcauccccugggugguacggaagcugcuccagguaagcgaauccaccgguguagcccugaagcgcagcuccuggcugaucguacuacuugugcuguugaccgucagccuguccccgguacagagcgcccccaucgggcacgggaagacaaucgagacguaccaaacccgggagggauacacguccaucugucuguuugugcucggcagcauccuuuucaucgugucacaccugaugaagggcuuagucgacagcguggggaacagcuucuuccccggccuguccaucugcaagaccugcagcaucggguccaucaacggcuucgagaucgagagucacaagugcuacugcagcuuguucugcugccccuacugccgccacuguagcgccgacaaggagauccacaagcuccauuuguccaucugcaagaagcggaaggccgggagcaacgugaugcuggcggucugcaagcgcaugugcuucagagccacgauggaaguguccaacaaggcccuccugauucgcagcguaaucaacaccaccuuugucgugugcauccugaucuuggccgugugcgucgugagcaccagcgccguggagauggagucccucccggcgggcaccugggagcgcgaggaagaccuaaccaacuucugccaccaggaaugccaggucaccgagaccgagugccucugucccuacgaggccuuaguguugcgaaagccccuauuccuggacagcaucgcuaaggggaugaaaaaccugcucaauuccacgagcuuggagaccucccugagcaucgaggccccguggggcgccaucaaugugcaguccaccuucaaacccacagucagcacggcgaacaucgcgcucagcugguccagcguggagcaccgcgggaacaagauccuggugucugggcggagcgaguccaucaugaagcuagaggagcgcacgggcaucaguugggaccucggggucgaggacgccagcgaaagcaaacuucugaccguguccgugauggaccucagccaaauguacucccccgucuucgaguaccugagcggcgaccgccaaguggaggaguggcccaaggcgaccugcacgggagacugcccggaacggugcggaugcaccuccagcacgugccugcacaaggaguggccgcacucccggaacuggcgcugcaaccccaccugguguuggggaguggggaccggcugcacguguugcggccucgacgucaaggacuuguucaccgacuacauguucgugaaguggaaggucgaguacaucaagacagaggcaauugugugcguagagcugaccagccaagagcggcagugcucccucauagaggccgguacccgcuuuaaccugggcccugucaccaucacccuuagcgagccgcguaacauccagcagaagcucccgccggaaauugugacgcugcacccucgcaucgaggagggcuucuucgaccuaaugcacguucagaagguccucuccgccagcaccgugugcaagcugcagagcuguacccacggcgugcccggggaccugcaggucuaccacaucggcaacuuauugaagggcgacaaggugaaugggcaccugauucacaagguggagccacacuucaacacauccuggaugagcugggacggcugcgaccucgacuacuacugcaauaugggggacuggcccuccugcaccuacacgggcgucacccagcacaaccacgccgccuucgugaaccugcugaacaucgagacugacuacaccaagaacuuccacuuccauucgaagagagugacggcgcacggggacacgccccagcucgaccugaaggcccggccgaacuacggcgccggugagaucaccguccugguagaaguggccgacauggaguuacacaccaagaagauugagaucuccgggcugaaguucgccagccugacgugcaccgggugcuacgcgugcuccagcgggaucuccugcaaaguccggauccacgucgacgagcccgacgagcucaccgugcacguuaagagcgaggaccccgacaucgucgcggccuccagcaguuugauggcccgcaagcuggaguucggcaccgacuccacguuuaaggccuucagugcgaugcccaagaccagccuaugcuucuacaucguggagcgggaguacugcaaguccugcagcaaggaggauacccagaagugugugaacgccaagcuagagaggccgcaauccauucugaucgaacacaaggggacaaucauugguaagcagaacgauacuugcacugccaaggccucuugcuggcucgagagcgugaaguccuucuucuauggccugaaaaacaugcuaagcggaaucuucggcaacguguuuaucgggaucuuccuguuucuagcgccguucauccugcugauucucuucuucauguucggcuggcggauccuguuuugcuucaaaugcugccgccggacacgcggccuauuuaaguaccgccaccucaaggacgacgaggaaaccggauaccggaaaaucaucgagcggcugaacaacaagaagggcaagaacaagcuguuggauggggagcggcucgccgaccguaagaucgccgagcuguuuuccacgaagacgcacaucggguga

SEQ ID NO: 15305 - RNA, 5055 nt, Artificial Sequence
  derived and/or modified CDS sequence (opt11) from CCHFV(BA66019)__AF350448.1__GP
auguacacccugcucgugugcgccguccugugcccccagcuauggagccucgagggcacccacgugccacacaacgagacgaagcacaacgggaccggcaucacugccgcgcccggggagucccaaggccccaugagccccgccuccaccgccgugccgcugacgcccgagccgcccaacaccaagcccgccgccagcgcguccgagcuggagucauccggggagggccacaccagccuccuggccaccacgcagggccugacuucccccgaggccacccccgagcuccccaccacgaccgacaccggggucucgaguaccagcgugguggacaucggcacgcagauggccaaggacacgccgaccuccaccgcgcacacgagccugcccuccaaccccagcgcccccuccaccgcccagggaacccaccacaccauccgcggccugcucagcgucacguccaccaagccggaggaggccagcacccccaccgaccccgggaaggccggcgcggagacgggcagcccccggccggccaucucccgcaagccgacccugagccccaccgccgaggcccccacagagaucaacaacuccagcacgccgaagcagcccgagcccuccauccagcccgccaccccgagccuggugaucucccccgcgcagcccgccuucccgcaaagcgccaccuccaccgccgcccaggacaucuacagcucccccacgaaccggagcaagcgcaaucucaagauggagaucaucuugacccugucccaggggcucaagaaguacuacggcaagauccaaaagacccuggggcugacccucgaggaggacaccgagggccugcuggaguggugcaagcggaaccucggccugacgugcgacgauaacuucuuccaaaagaggaucgaggaguucuuccucaccggggagggcuacuucaacgaggugcuccaguucaagacccccagcacccccggguccacggagccgacccacgcggaggcccccaccgucaagcccuucaagagcuacuucgcccggggcuuccugaccaucaacucuggguacuucagcgccaagugcuacuccuggacgagcaacucgggccugcagcucaucaacgugacccagcaccccgcccgcaucgcggacaccccgggccccaagaucaccaaccugaaaacgaucaacugcaucaaccugaaggccuccguguucaaggagcaccgggagauagagaucaacguccuccugccccagguggccgugaaccugagcaacugccacguccucaucaagucccacgugugcgacuacagccuggacaucgacgguaccauccgccugccccggaucuaccacgagggcaccuucaucccggggaccuacaagauagugaucgacaagcgcgauaagcagaacgaucggugcacgcucgucacaaacugcgugaucaaaggccgcgaggugcggaaggggcaguccgcccugcgucaguaccggaccgagauccgcaucggcaaggcgagcgccggcucccggcgccugcucagcgaggaguccggggacgacugcaucucgcggacccagcugcugcgcacggagaccgccgagguccacggcgacaacuacgggggccccggggacaagaucaccaucugcaacggcuccaccaucguggaccagagacucggcagcgagcuggggugcuacacgaucaaccgggugaagucauucaagcugugugagaacagcggcaccgggaaguccugcaagaucgacaagcaccccgucaagugccgccagggcuucugccucaagaucacccaggagggccgggggcacgugaagcugagccgcggcuccgaggucgugcuggacgccugcgacagcagcugcgaaaucaugauccccaaggggaccggcgacauccugguggacugcuccgggggccagcagcacuuccucaaggacaaccuggucgaccucggcugcccgaacaucccccuccuggggaagauggccaucuacaucugccggaugagcaaccaccccaagacgaccauggcguuccuguucugguucuccuucggcuacgugaucacgugcaucuucugcaagaucaucuucuaccuccugaucgucgucgggacccugggcaagaaguucaaacaguaccgcgagcucaagccccagaccugcaccaucugcgaaaccaccccgacgaaugccaucgacgccgagaugcacgaccugaaaugcagcuacaacaucugccccuacugcgccucccggcugaccagcgacgggcucgcccgccacgugacccagugccccaagcggaaggagaagguggaggagaccgagcuguaucugaaccucgagcgcauccccuggaucguccggaaauuacuccagguguccgagagcaccggcguggcgcugaagcgcuccagcuggcugaucguccuccucgugcugcugacggugucccucagcccgguccaguccgcccccaucggccacgggaaaaccauagaggccuaccagacucgggagggcuacaccagcgugugccuguucaugcucgggggcauccuguucguggucuccugccugaugaaggggcugguggacucuguguccaacagcuucuuccccgggcucuccaucugcaagacgugcagcaucggcagcguaaacggguuugagaucgagucccacaagugcuacugcagccugcugugcugccucuacugccgccacugcucggccgaccgggagauucaccagcugcaccugagcaucugcaagaagcggcgggccggcgggaacgugaugcucgcggugugcaagcgcaugugccugagggccaccauggaggucuccaacaaggugcuguuuauucgcagcaucaucaacaccacauucgugaucugcauccucguccuggccguguguaucgugaguacgagcgccguugagauggagucccugccggcgggcaccugggagcgcgaggaggaccucaccaacuucugccaccaggagugccaggugaccgagacggaaugccucugccccuacgaggcccuggugcuccggaagccccuguucagcgacuccaucgucaaggggaugaagaaccugcucaacagcaccucccuggagaccagccuguccaucgaggcccccuggggcgcuaucaacgugcagagcaccuucaagccgacggugucuaccgccaacaucgcgcucagcugguccagcgucgagcaccgcggcaacaagauucuggugagcgggcgguccgagagcaucaugaagcuggaggagcgcaccggcaucuccugggaccucgggguggaggacgccagcgaguccaagcugcugaccgucucagugauggaucucucccagauguacagccccguguuugaguaccuguccggcgaccggcaggucgaggaguggcccaaggccacgugcaccggggacugccccgaccgcugcgggugcaccagcuccacgugccugcacaaggaguggccgcacagccggaacuggcgcugcaaccccacuuggugcuggggcguggggaccggcugcacaugcugcgggcucgacgugaaggaccuguucaccgacuacauguucgucaaguggaagguggaguacauuaagaccgaggccauugugugcguggagcugaacucacaggagcggcaguguagccucaucgaggccggcacccgcuucaaccugggccccgugaccaucacccuguccgagccccggaacauccagcaaaagcucccgcccgagaucaucacgcugcacccccgcaucgaggagggguucuucgaccugaugcacgugcagaagguccucagcgcguccaccgugugcaagcugcagagcuguacccacggcguccccggggaccugcagaucuaccacaucggcaaccuccugaagggggacagggugaacggccaccugauucacaagaucgagccgcacuucaauaccuccuggaugagcugggacggcugcgaccucgacuacuacugcaacaugggggacuggcccucuugcacguacaccggcgugacucagcacaaccacgccgccuucgucaaccuacugaacaucgagaccgacuacaccaagaacuuccacuuccacuccaagcgcgugacagcccacggggacacgccccagcucgaccucaaggcccggcccacauacggcgcgggggagaucacagugcuggucgagguggccgacauggagcuucacaccaagaaaaucgccaucagcggccugaaguucgccucccugaccugcaccggcugcuacgcgugcagcuccgggaucagcugcaaggugcgcauccacgucgacgagccggacgagcucaccgugcacguuaaguccgaggaccccgacaucgucgccgccagcuccagccucauggcccggaagcucgaguucggcacggacucuaccuucaaggccuucagcgcgaugcccaagacuucccucugcuucuacaucguggagcgcgaguacugcgagagcugcuccaaggaggacacccagaagugcgucaacacgaagcuggaacagccccagagcauacugaucgaacauaaggggaccaucaucggcaagcagaacgacacgugcaccgccaaggccuccugcuggcucgagagcgucaaguccuucuucuacggccugaagaacaugcugagcgggaucuucggcaacguguucaucgggaucuuccucuuccuggccccguucauccugcugauccucuucuucauguucggcuggcggauccuguucugcuucaagugcugccgcagaacccgcgggcuguucaaguacagguaccucaaagacgaugaggagagcggcuaccggcgcaucaucgagcgacugaacaacaagaagggcaagaacaagcugcucgacggggagcgccuggccgaccggcgcaucgcggaacuguucuccaccaagacccacaucggcuga

SEQ ID NO: 15306 - RNA, 5055 nt, Artificial Sequence
  derived and/or modified CDS sequence (opt11) from CCHFV(SPU 18/88)__KJ682810.1__GP
auguacacgcccuugcucugcgccauccuuugccugcaguuauggagccuggagggcaucuaugggcuguccaacaagacucagcacaacgacaccagcaccaucaaggugccggaagagucgcagaagaccagccuccccgcgaacaccgccucccccaucacgagcgaccccuccagcgcaaccuccaccgcgcuggccagcggaccagagggguccggcgacaccagcacgucucccagcgucaccacccagggucccacccugcucgagacgacccccgaaccgcacaccaccaucgacaucgaugaguccagcacggccaucgcggacaucuccacccagaccgugaaggacauucccacccccacgacccacaccagccugcccaguacaccgagcgcccccacgaucccccaggaggcccaccacacugcccgcggucugcucagcguaacuucaaccaagccaggcgaaacgagcacaccgaccucgccgggggaggcgucuaccgaagcguccucuccccagcccacuaucuccgaaaccccgagcccgccgcccacuacccaagcccccacggagauaaacaaccccaacaccucccgacagcccaugcccagcacccagccggccgcccccaacagugucacacccccggugcagccaaccuucagccaguccgaugugagcacugucgcgcaggacauccaccccucacccaccaaccgcagcaagcggaaccuagaaauggaaauaaucuuaacccucagucagggcuugaagaaguacuacgggaagguccuuaaacuuuuggaccugacccucgaggaggacacggagggccuguuagaguggugcaaacguaaccucgggcugacgugcgacgacaauuucuuccagaagcggaucgaggaguuuuuccugaccggcgagggccauuucaaugaggugcuccaguuuaagacgccuuccacgcugucccccaccgagcccgccagaguagagagcccuaccguagagccguucaaaagcuacuucgcuaagggguuucuguccauggacucgggcuacuuuuccgccaagugcuaccccaagagcuccaacagugggcuccagcuuaucaacgugacccagcacuccauucggaucacagacaccccaggccccaagauaaccagucugaagaccaucaacuguauaaacuugaaggcccugguauucaaggagcaccgcgagauugagaucaacgugcugcucccccaaguggcgguaaacuuaucgaacugccacgugcugaucaagagccacgccugcgacuacucccucgacaucgacggacccguccgguuaccccgcauccaccacgaggggacguuuaucccuggcaccuacaagaucgucaucgacaagaagaacaagcagaacgaccggugcacccuggugaccaacugcgugauuaaggggcgcgagauccggaagggucagaguguccuccgccaguaccggacggagaucaaaaucggaaaggccuccagcggcucccgccggcugcugagcgaggaaagcaacgacgacugccucagccguacccagcuccugcggaccgagaacgccgagauccacuccgacaacuacggcggaccgggcgacaagaucaccaucugcaacggguccacgaucguggaccagcgccucggcagcgaauuggggugcuacaccauuaaccgggucaaguccuucaagcugugcgagaacagcgccaccggcaaguccugcgagauagacagcacucccguuagauguaggcagggcuuuugccugaagaucacgcaggaggggcgaggccacgugaaacucagccgcgguagcgaggucgugcuggacgcaugcgacucuagcugcgagaucaugauccccaagggcaccggggacauccuggucgacugcuccggcggccagcagcauuuccucaaggacaaccuggucgaccugggguguccuaacaucccgcuccugggcaagauggcaaucuacaucugccggaugagcaaccaccccaagaccaccaugggguuccuguucugguucuccuucggcuacgugauaacaugcauccucugcaaaguaaucuucuaccugcugaucgucgugggaacccucgggaagaaguucaagcaguaccgcgagcugaagccccagaccuguacgaucugcgagacgaaccccgugaacgcaaucgaugcagagaugcacgaccucaauugcagcuacaacauaugcccguacugcgccuccagauuaaccucagacggccuggcgcgccacgucaugcagugcccgaagcggaaggagaagaucgaggaaaccgaguuauacuugaaucuggaacgcauccccuggguggugcggaaguuacuccaggucagcgagagcaccgggguggcccugaagcgcuccagcuggcucgugauccuccucguacugcucaccgugagccuguccccggugcagagcgcccccaucucccauggcgagacggucgagguguaccagacccgggagggauacaccagcaucugccuguucgugcucggcuccauccuauuccuggucagcugccucaugaagggccucguggacuccguggggaacagcuucucccccggccugagcaucuguaagaccugcuccaucggcagcauaaacggcuucgagaucgagucccacaagugcuacugcucccucuucugcugccccuacugcaggcacugcucggccgacaucgagauccacaagcugcaccugagcauuugcaagaagcggaagacgggguccaacgucaugcucgcggugugcaagcgcaugugcuuucgcgccaccguggaggugagcaacaaggcccuccugauccgcaacaucaucaacaccacguucguggugugcauccucauucuugccgucugcguggugucaacaagcgccgucgagauggaaaaccugccugcgggcaccugggagaaggaggaggaccucaccaacuucugccaccaggaaugccaggugaccgagacggagugccugugccccuacgaggcccucgugcuccggaagccccuguuccuggacucaaucgucaagggcaaaaagaaccuccugaacaguacgagccuggagaccucccucucuaucgaggcccccuggggcgccaucaacgugcaguccacguucaaaccgacggugucggccgcgaauaucgcccugucauggaguuccgucgagcaccgcgggaacaaaauccuggugagcgggcgguccgagaguaucaugaagcucgaggagcgaaccgggaucucaugggaccuggggguggaggacgccagcgaguccaagcugcucaccgugagcgugauggacuuaucccagauguacagccccguguucgaguaccuguccggggaccgccaggucgaagaguggcccaaggcgaccugcacgggcgacugccccgagcgcugcgggugcaccagcagcacgugccuccacaaggaguggccgcacucccgcaacuggcggugcaaccccaccuggugcuggggcguggggacgggaugcacgugcugcgggcuggacgugaaggaccuguucaccgacuacauguucgucaaguggaagguggacuauaucaagaccgaggccaucgugugcgucgaacuaacaucgcaggagcgacaaugcucccugauagaggccggcacccgguucaaccucggcccggugaccaucacucucucugagccgagaaacauccagcagaagcugccgcccgagauuguuacgcugcacccccggaucgaggaaggguucuucgaccucaugcacauccagaaggugcuguccgccagcaccgugugcaagcugcagucuugcacccacggcguccccggggacuuacagaucuaccacaucggcaaccugcugaaaggcgacaaggucaacggacaccucauucacaagaucgagccgcacuucaacaccagcuggaugucgugggacggcugugaccuggacuacuacugcaacaugggggacuggcccaguugcuccuacacgggcgugacucagcacaaccacgccgccuucgucaacaugcugaacaucgagaccgacuacaccaagaacuuucacuuccacagcaagcgcgugacugcccacggcgacacaccccagcucgaccugaaggcacggcccaccuacggggcuggcgagaucaccgugcuggucgagguggcggacauggagcuccacaccaagaaaaucgagaucuccggacugaaguucgccagccuaacgugcaccgggugcuacgcgugcuccagcgggaucuccugcaaggugcgcauccacguugacgagccggacgaacucaccguucacgucaagagcgaagaccccgacauuguggcugccuccucuagccugauggcccggaagcuggaguucggcacugacuccacauucaaggccuucagcgcgaugcccaaaaccucccucugcuucuacauaguggagcgcgaguacugcaagagcugcuccaaggaggacacccagaaaugcgugaacaccaagcuggagcagccccaaagcauccugaucgagcauaaggggacgaucaucggcaagcaaaacgacacgugcacuggcaaggccggaugcuggcucgaguccauaaagagcuucuucuacggccugaagaacaugcugaguggcaucuucgggaacgucuucaucgggaucuuccuguuccucgccccguucaucaugcugauccuguucuucauguuuggguggcggauccucuucugcuuuaagugcugccgccggacccgcggacuauucaaauaccggcaccugaaggaugacgaggaaaucggguauagaaaaaucaucgagcgucucaagaacaagaagggcaagaacaagcugcuggacggcgagcgccucgccgaccggaagaucgccgagcuguucagcaccaagacacacaucggcuga

SEQ ID NO: 15307 - RNA, 5055 nt, Artificial Sequence
  derived and/or modified CDS sequence (opt11) from CCHFV(66019)__AB069669.1__GP
auguacacccugcucgugugcgccguacugugcccgcagcuguggagccucgagggcacccacguaccgcacaacgagacgaaacacaacgggaccggcaucaccgccgcgcccggggaaucccagggccccaugagccccgcgucuaccgccgugccgcugacgcccgagccgcccaacaccaagcccgccgccagcgcguccgagcuggagagcuccggggagggccacaccagccuccuggccaccacgcagggccugaccaguccagaggccacccccgagcuccccaccacgaccgacaccggcgucagcuccaccagcgugguggacaucggcacgcagauggccaaggacacccccacaaguacggcucacacgagcuuacccuccaaccccagcgcccccuccaccgcccaggggacccaccacaccauacggggccugcucagcgucacguccaccaagccggaggaagccagcacccccacggaccccgggaaggccggcgcggagacuggcagcccccgaccggccaucucccgaaagccuacccugucacccaccgccgaagcccccaccgagaucaacaacuccagcacaccgaagcagcccgagcccuccauccagcccgccaccccgagccuggugaucucccccgcgcagcccgcauucccgcagagcgccaccucuaccgccgcccaggacaucuacagcucccccacgaaccggagcaagcgcaaccucaagauggagaucauccuuacccugucccaggggcucaagaaguacuacggcaagauccagaaaacccuggggcugacccucgaggaggacaccgagggccuucuggaguggugcaagcggaaccucggucugacgugcgacgacaacuuuuuccagaagcgcaucgaggaauuuuuccugacuggggagggcuacuucaacgaggugcuccaguucaagacccccagcacccccggguccacggaaccgacccacaccgaagcgcccaccgucaagcccuucaagagcuacuucgcccggggguuccugacgauugacagcggauacuucagcgccaagugcuacucccgcaccagcaacagcggccugcagcucauuaacgucacccaacaccccgcccggauagccgacaccccuggccccaagaucacgaaccugaagacaaucaacugcaucaaccugaaggcguccguuuucaaggagcaccgcgagaucgagauuaacguccuccucccccagguggccguuaaccugagcaacugccacguccucaucaagucccacgugugcgacuacucccuggauaucgacgguaccauucggcugccccgcaucuaccacgagggcacguucaucccggggacguacaagaucgugaucgacaagcgggacaagcaaaacgaccgcugcacgcucgucaccaacugcgugaucaaggggcgggaggugcgucgcgggcaguccgcccugcgccaguaccggaccgagauccgcaucggcaaggccagcgcgggcucccgacgccugcucagcgaggaguccggggaugacugcaucucccgcacacaguuauugcggaccgagaccgccgagguccacggcgacaacuacgggggccccggggacaagaucacuaucugcaacggauccacgaucguggaccagcgccucggcucugagcuggggugcuacaccaucaaccgggugaaguccuucaagcugugcgagaacagcggcaccgggaagucaugcaagauagacaacacccccgucaagugccgccaggguuuuugcuugaagaucacgcaggagggccgggggcacgugaagcugagcaggggguccgagguggugcuggacgccugcgacagcagcugcgagaucaugauccccaaggggaccggcgacauccugguugauuguagcgggggccagcagcacuucuuaaaggacaaccuggucgaccuggguugcccgaauauuccccuccucgguaagauggccaucuacaucugccggaugagcaaccaccccaagaccaccauggccuuccuguucugguucagcuucggcuacgugaucacgugcaucuucugcaagaucaucuucuaccuccugaucguggucggcacccugggcaagaaguucaagcaguaccgcgagcucaagccccagaccugcaccaucugcgagacgaccccgaccaacgcgauagacgccgagaugcacgaccugaagugcagcuacaacauaugccccuacugcgccucccggcugaccagcgacggguuggcccgccacgugacccaaugccccaagcgcaaggagaagguggaggagacggagcuguaccugaaccucgagcgcaucccauggaucguccggaagcugcuacagguguccgagagcaccggcguggcacucaaacgcuccagcuggcugaucguccuucuugugcuacugaccgugucccucagcccgguccaguccgcgcccaucggccacgggaagaccaucgaggccuaccagacgcgggagggcuacaccagcgugugccuguucaugcuugggggcauccucuuuguggucucgugcuugaugaaggggcugguggacagcguguccaacagcuucuuccccggccuguccaucugcaagaccugcagcaucgggagcguuaauggguucgagaucgagucccacaagugcuacugcagccugcugugcugucucuacugccgccacuguuccgccgaccgggagauccaccagcugcaucugagcaucugcaagaagcgccgggccggcgggaacgucaugcucgccgugugcaagcgaaugugccuacgugcaaccauggaggucagcaacaaggugcuguucauccggagcaucaucaacacgaccuucgugaucugcauccucguccuggccgugugcaucgugaguaccagcgccguggagauggagucccugcccgccggcaccugggagcgcgaggaggaccuuacgaacuucugccaccaggagugccaggugacagagacugaaugccugugccccuacgaggcgcugguucuucggaagccccuguucagcgacuccaucgucaaggggaugaagaaccugcucaacagcaccucccuggagacgagccuguccaucgaggcacccuggggcgccaucaacgugcagagcacuuucaagccgaccguuuccacugccaacaucgcccucagcuggaguagcgucgagcaccgcggcaacaagauccuggugagcggccgguccgagagcaucaugaagcuagaggagcgcacggggaucuccugggaccucgggguggaggacgccagcgaguccaaguuguugaccgucucggugauggaccucucccagauguacagccccguguucgaguaccuguccggcgaccggcagguugaggaguggcccaaggcgaccugcaccggcaacugccccgaccgcugcgggugcacgagcuccaccugucugcacaaggaguggccgcacagccggaacuggcgcugcaaccccaccuggugcuggggcguggggaccggcugcacgugcugcgggcucgacgugaaggaccuguucaccgacuacauguucgugaaguggaagguggaguacaucaagaccgaggccaucgucugugucgaacugaacucccaggaacggcaguguagccucaucgaggccggcacccgcuucaaccugggcccugugacgaucacccuguccgagccccggaacauccagcagaagcucccgagcgagaucaucacccuccacccccgcaucgaagagggguucuuugaccugaugcacgugcagaagguccucuccgccagcacggugugcaagcugcagucuugcacgcacggcguccccggggaccugcagaucuaccacaucggcaaccuccugaagggggaccgggugaacggccaccugauccacaagauagagccccacuucaacacuagcuggaugagcugggauggcugcgaccucgacuacuacugcaacaugggggauuggccguccugcaccuacaccggcgugacccagcacaaccacgcggcuuucgucaaccugcugaacaucgagacggacuacaccaaaaacuuccacuuccacucgaagcgcgugaccgcacacggggacaccccacagcucgaccugaaagcucggcccacguacggcgccggggagauuaccgugcugguugagguagccgacauggagcuccauaccaaaaagaucgcuaucuccggccugaaguucgccagccugaccugcacgggcugcuacgccugcucuagcggaaucuccugcaaggugcgcauccacgucgacgagcccgacgagcucaccgugcacguuaagagcgaggacccggacaucguggcggccuccagcucccugauggcccgcaagcuggaguucggcaccgacagcaccuucaaggccuucuccgccaugcccaagacgucacuuugcuucuacaucguggagcgcgaguacugcgaguccugcagcaaggaggacacccagaagugcgugaacaccaagcuggagcagccccaguccauccuaaucgagcacaaggguaccaucaucggcaaacagaacgacacgugcacagcuaaggcaagcugcuggcucgagaguguuaagagcuucuucuacggccugaagaacauguuaagcgggaucuucggcaacguguucaucggaaucuuccucuuccuggcccccuucauccugcugauccucuucuucauguucggcuggcggauccuguucugcuucaagugcugccgcagaacccgggggcuguucaaguaccgcuaucucaaggacgacgaggaguccggguaccggcgcaucaucgaacggcugaacaacaagaagggcaagaacaagcugcucgacggggaacggcuggccgaccgccgcaucgccgagcuguucagcaccaagacgcacaucggcuga

SEQ ID NO: 15308 - RNA, 5052 nt, Artificial Sequence
  derived and/or modified CDS sequence (opt11) from CCHFV(Gaib)__KX013445.1__GP
auguauaucccccugguguacgccgucauauaccuccagcuguacggccucgggggcgcccacgggcuccuuaacaagacugaacagaaugagacgggcaucacggcuacccacgggcgcguacagggcccgccaagcgccuccaucacucugcccgugacccccgacccgcucuccgccacguccgccgcuagcacauccggucccgaggggagcggcgagguccccaccucccccuccaccauaacgcagggguugaccuccagcgagaauaccccgcagcugcccaccgcgacggacaccggcaucuccaguaccuccaucaucgacgugaguacccagacggccggggacaccuccacccccaccgcccacacgucucuccccaauuccccgagcgcacccuucaccucccaggacacccggcacaccguucggggccugcugaccgucaccagcaccaagagcgacgaggcgaguacccucaccgaccccaaggaagcuagcaccgaggcccguaguccaagcccgucaaucagccgcacccccacccccucucccacgguccaggcaagcaccgagaacaacacccccuccacgccacggcaacccgagcccaccacccgcccagcccugcccagccccaccacgucccccacccaaccgagccugucccagagcgcgacgucggccgcgauccaggauaugcacccaagcccgaccaaccggucccggcggaaccucgaaauggagaucauucugacacugagccagggccucaagaaguacuacggcaaaauccugaaacugcucgaccugacccuggaggaagacacggagggccuccuggaguggugcaagcgcaaccuggaucuaaccugugacgagaacuucuuccuuaagcggaucgaggaguucuuccuguccggugagggccacuucaacgaagugcuccaguucaaggccccgagcacgaugucuucgaccgagcccacgcacgccggaccgcccaccgucgagcccuuuaagagcuacuucgcgaaaggguuccuguccaucgacagcggcuacuucuccgcuaaguguuacccccguaccagcaacuccgggcugcagcuaaucaacguaacccaacacacggcucgcaucgccgacacgcccggccccaagaucaccaacguuaagaccaucaacugcaucaaccugaaggcaagcguguucaagaaacacagagagguggagaucaacguucugcucccgcaaaucgcggucaaucuguccaacugccacgugcugaucaagagccacgugugugacuacucccucaacuucgacgggaugguuagauuaccccgcauccaccacgaaggcacguucauccccggcaccuauaagaucgugaucgaucggaagaacaagcagaacgaccgcugcacccuggugaccaauugcgucaucaagggccgugaggugcgcaaaggccagucugcccuccggcaguaccgcacggaaaucaaaaucggcgaggccuccaucggcagcaggcgguugcuguccgaagagagcuccgacgauugcauaagccggacccagcuccugcggacggagaccgccgagauccacaacgacaacuacgggggccccggggacaaaaucacgaucugcaacgggagcaccaucguggaccagcgucucggcuccgagcucgggugcuacaccaucaaccgggucaagucuuucaagcugugcgagaacuccgcgaccggcaagagcugcgaaauagacuccaucccgguaaagugccgccaaggcuucugccugaagauuacgcaagaggggcggggccacgucaagcugucacgcggcuccgagguggugcucgacgcgugcgacagcuccugcgagaucaugauccccaagggaacgggggacauccugguagacugcagcggcggccagcagcacuuccugaaggacaaccucaucgaccuggggugccccaacaucccccugcucggcaagauggccaucuacaucugcaggauguccaaccaccccaaaaccaccauggccuuccuguucugguucagcuucggguacgugaucacgugcaucuucugcaaggccaucuucuaccuucucaucaucguggggacgcuggggaagaaguucaaacaguaccgcgagcugaagccccagaccugcaccaucugugagacgacacccgucaacgcuaucgacgcagagaugcaugaccucaacugcuccuacaacaucugccccuacugcgccucucggcugaccuccgacggccuggcccgccacguagugcacugcccgaagcggaaagagaagaucgaggagaccgagcucuaccugaacuuagagaggguccccuggguggugcggaagcucuuacaagucagcgaguccaccggcguggcccugaagcgcagcuccuggcucaucguacugcugguccuccugacggugagccuaagccccgugcagagugcgcccaucgggcacggaaagaccaucgagacauaccagacccgggagggguacacgagcaucugccucuucguguuaggcgggauccuguucaucgugucaugccucaugaagggacugguggacagcgucgguaacaacuucuucccggggcugaccaucugcaaaaccugcagcaucagcuccaucaauggcuucgagaucgagagccacaagugcuacugcagccuccugugcugcccguacugccgccacugcagcgcugaccgggagauccaccaacugcaccucuccaucugcaagaagcgcaaaaccgggagcaaugugaugcuugcagugugcaagcgcaugugucugcgggucacgaccgaaguguccaauagagcccucuucauucggagcauaaucaauaccaccuuugugaucugcauccucauccuggcggucugcgugaucuccacgagcgcgguggagauggagaacuuacccgccggcaccugggagcgcgaggaggaucugaccaacuucugccaccaggaaugucaaguuaccgagacggaaugccugugcccguacgaggcccucgugcugcggaagccccucuucuccgauucaaucgugaaggggaugaaaaaccuccugaacuccaccagccuugagaccagcuuguccaucgaggcccccuggggcgccauaaacguccagucaaccuucaagccaacgguguccaccgcgaacaucgcgcugucuugguccagcaucgagcaccgcggcaacaagauccuggucuccgggaggagcgaguccaucaugaaacucgaggagcgcaccggcaucucuugggaccucggggucgaggacgccagcgagagccggcuguugaccguguccgugauggaccugagccagauguacuccccggucuucgaguaccugagcggcgaccgucaaguagaggaguggcccaaggccacgugcaccggagacugccccgagcgguguggcugcaccuccagcacgugccuccacaaggaguggccucacucccgcaacuggcggugcaacccgacuuggugcuggggcgugggcaccggcuguacguguugcgggcuagacgucaaggaccuguucaccgacuauauguucgugaaauggaagguggaguacauuaagaccgaggcuaucgucuguguggagcucaccagccaggagcgccagugcagccugaucgaggccggcacccgguucaaccugggccccgugaccauuacguuguccgagccccgcaauauccagcaaaagcugcccccggagauuaucacccuccauccgcggaucgaggagggguucuucgaccucaugcauguccagaaggugcugagcgccuccaccgugugcaaguuacaaaguugcacccacgguguccccggggauuuacagguguaccacaucggcaaccugcugaaaggggacaaggucaauggccaccucauccauaagaucgagccucacuucaacaccuccuggaugagcugggacggcugcgacuuggauuacuacugcaacaugggggacuggccgucuugcacguacaccggcgugacccaacacaaccacgccgccuucgucaaccuguuaaacaucgagaccgacuacacgaagaacuuccacuuccacucuaagcgcguuaccgcccacggggacacaccgcagcuggaccugaaggcccggcccacuuacggcgcuggggagauaaccgugcucguggagguugccgacauggagcugcacaccaagaagaucgaaaucagcgggcugaaguucgccagcuugacgugcaccggcugcuacgcguguuccagcgggaucuccugcaaggugcgcauccacguggacgagcccgacgagcuaacgguccaugucaagagcgaggacccggacaucgucgccgcguccagcucccugauggcccggaagcucgaguucggcaccgacagcaccuuuaaggccuuuagcgcgaugcccaagaccagccugugcuucuacaucguggaacgcgaguacugcaagagcugcucccgcgaggacacccagaagugcgugagcaccaagcuggagcagccccaguccauccucaucgagcacaaaggcaccaucaucggcaagcagaacaacacgugcaccaccaaaacgaccugcuggcuggagagcgugaaguccuucuucuaugggcugaagaacauguuaucauccaucuucggcaacgucuucgucggcaucuucagcuuccuugccccuuucauccugcugauacucuucuucauguucggguggcggauccuguucugcuucaagugcugccgcagaacccgcggucuauucaaguaccggcaccucaaggacgacgaggagaccgguuaccgccggauaaucgagcgccuaaacaacaagaaaggcaaguccaagcugcucgacggcgagcggcuggccgaccgcaagaucgccgaacuguucagcaccaagacccacaucggcuga

SEQ ID NO: 15309 - RNA, 5055 nt, Artificial Sequence
  derived and/or modified CDS sequence (opt11) from CCHFV(SPU415/85)__DQ211635.1__GP
auguacacgccccuggugugcgccgucaucugccuccagcuguggaaccugggcgggacccucguguucaucaaccgcacgcagcacaacgagacgggcaccguggccacaccggaggggacgcugcggccgcgccugccggucagcaccgcguugcccaccaagucagaccggccgucagugggccccgccgccuccagcuccgggcuggagggcagcggcgagcccaacaccucccccagcaucacgaccaaggggcugaccccgcccgagaccacgcccgcccuccccaccgccaccgacacagacgcauccagcacgggcguggucgacguguccacccagaugaccaaggacaucccgaugagcaccgccuacacgaacccucccuccacccccagcgcccccuccacgccccaggggacccaccacaccgcccgcggccugcugagcguggcguccaccaagagcgaggaggucuccaugagcaccagccccgccaagaccuccacggagaccagcagcccgccgcccgccaccuccgagacccccacgcccucccccaccacccaggugcccaccggcaacaacaaccccaacacgagccggcagcccaccccguccgcccagcccgccaugagcaaccccgcgaccuccccggcccagcccaaccucucucagucugcgcccccaaccgccgaccagggcgugcacccgagccccaccaaccgcuccaagcggaaccuggagaucgagaucauccuaacgcucagccagggccugcgcaaguacuacgggaagauccugaagcuccuggaccugacccucgaggaagacacggagggccugcuggaguggugcaagcggaaccucgggcugaccugcgacgacaauuucuuccagaagcgcaucgaggaguucuuccugacgggcgagggcuacuucaacgagguccuccaguucaaggugcccuccacccugagcuccaccgagccgacccauacgcggccgcccaccguggagcccuucaagagcuacuucgccaagggguuccuguccaugaacagcggcuacuucagcgccaagugcuacccccgcaccuccaacagcggguugcagcugaucaacgucaccaagcacuccgccaagaucgccgacacgccgggccccaagaucaccaaccuaaagaccaucaacugcaucaaccuccgggccagcguguucaaggagcaccgcgagguggagaucaacguccugcugccccagguggccgugaaccucuccaacugccacgcgcagauuaagagccacgucugcgacuacucccuggccaccgacgggauggugcgucugccccacauccaccacgagggcacguucaucccgggcaccuacaagaucgugaucgacaagaagaacaagcagaacgaucgcugcacccucgucaccaacugcgugaucaagggacgggagguccgcaagggccaaagugcccugcggcaguacaagacugagauacgcaucgggaaggccuccagcggaagucggcgccuacucagcgaggaguccgacggggacugcaucagccgcacucagcugcugcggaccgagaccacggagauccacagugacaacuacggcggccccggggacaagaucaccaucugcaacggcagcaccaucguggaccagcggcucggguccgagcugggcugcuacaccaucaaccgggucaagagcuucaagcugugcgagaacagcgccacggggaaguccugcgagaucgacagcacccccgugaagugccgccagggauucugccucaagaucacccaggagggccgggggcacgugaaacugucccgcggcagcgagaucgugcuggacgcgugcgacuccaacugcgagauaaugauucccaaggggaccggcgacauccuggucgacugcagcggcgggcagcagcacuuccucaaggacaaccugaucgaucugggcugcccgaacaucccccuccuggggaagauggccaucuacaucugccggauguccaaccaucccaagacaaccauggccuuccuguucugguucagcuucggcuacgugauaaccugcauccucugcaaggugaucuucuaccugcugaucgucgccgggacagugggcaagaaguucaagcaguaccgcgagcuccggccccagacgugcaccaucugcgagaccaucccggucaacgcgaucgacgccgagaugcacgaccugaacugcuccuacaacaucugccccuacugcgccucccgccugaccuccgacggcuuagcccggcacgucaugcagugccccaagaggaaggaaaagguagaggagaccgagcuguaccugaaccucgagcggaucccgugggugguccgcaaguugcuccaggugagcgaguccacggguguggcccugaagcggagcuccuggcucaccguccuguuggugcugcugaucgugagccucucccccguccagagcgcgcccaucggccacgggaagaccaucgagaccuaccaggcccgcgagggcuacacguccuucugccuguucauccuggggucgauccucuucguggugagcugccuggucaaggggcugaucgacuccguuggcaacagcuuuuuccccgggcucuccaucugcaagaccugcucgaucggcuccaucaauggguucgagaucgagagccacaagugcuacugcucccuguucugcugcccguacugccggcacugcagcgccgaccgcgagauccacaagcugcaccucuccaucugcaagaagcggaagaccggcagcaacgugaugcuggccgucugcaagcgcaugugcuuccgcgccaccaucgagguguccaaccgggcacugcucauccgcaacaucaucaacacgaccuucguggucugcauccugacccuggccgugugcguggucagcaccuccgccguggagauggagagcuuacccgccgggacgugggagaaggaggaggaccugaccaacuucugccaccaggagugccaggugaccgagaccgagugccugugucccuacgaggcccucguccugcggaagccccuguuccucgacuccaucgugaagggcaugaagaaccugcucaacagcacgucccucgagaccucucuguccaucgaggcgccguggggcgccaucaacguccagagcaccuucaagcccaccgucagcgccgccaacaucgcgcuguccuggagcuccguggaacaccgcgggaacaagauccucgugagcggccgguccgagagcaucaugaagcuggaggagcgcacggggaucuccugggaccuuggcguggaggacgccagcgaguccaaacuccugaccgugagcgugauggaccugucccagauguacagccccgucuucgaguaccucuccggggaccggcaaguggaggaguggccuaaggcgaccugcaccggcgacugcccggagcgcugcggcugcacgagcucgaccugccugcacaaggaguggccccacagccggaacuggcgcugcaaccccaccuggugcuggggcgucgggaccgggugcacgugcugcggccuggacgucaaggacuuguucaccgacuacauguucgugaaguggaagguggaguacaucaagaccgaggccaucgucugcguggaguuaaccucccaggagcggcagugcagccugaucgaggccggcacacgcuucaaccucgggcccgucaccaucacccuguccgagccgcguaauauccagcagaagcugccgcccgagaucaucacucuccacccccgcaucgaggagggcuucuucgaccugaugcacgugcagcggguucugagcgccagcacggucugcaagcuccaguccugcacccacggggugcccggggaccuccagguguaccacaucgggaaccugcugaagggggacaaggucaauggccaccugauccacaagaucgagccccacuucaacaccagcuggauguccugggacgggugcgaccuggacuacuacugcaacaugggcgacuggcccagcugcaccuacaccggugugacgcagcauaaccacgccgccuucgugaaccucuuaaacaucgagaccgauuacaccaagaacuuccacuuccacuccaagagagucaccgcccacggcgacacgccccagcuggaucucaaggcccggccgaccuauggggcgggcgaggugaccgugcuggucgagguggccgacauggagcugcauaccaagaagaucgagauuagcggccucaaguucgccucccugacgugcaccgggugcuacgccugcagcuccggcaucaguugcaaggugaagauccacgucgacgagcccgacgagcugaccgugcacgugaaguccgaggaccccgacaucgucgccgcggggagcucccucauggcccgcaagcuggaguucggcgccgacagcaccuucaaggccuucuccgcgaugcccaagacgagccugugcuucuacaucguggagcgggaguacugcaaguccugcagccgcgaggacacccggaagugcgugaacaccaagcucgaccgcccgcaguccauccugaucgagcacaaggggaccaucaucggcaagcagaacaacacgugcaccgccaaggccucgugcuggcuggaaagcgucaaguccuucuucuacggccucaagaacaugcugagcgggaucuucggcaacguguucaucgggaucuuccuguucaucgcccccuucgugcuccugauccuguucuucauguucggcuggcgcauccuguucugcuucaagugcugccggcgcacccggggccucuucaaguaccgccaccugaaggacgacgaggagaccggguaccggaagaucaucgagcgccugaacaacaagaagggcaagaacaagcuccuggacggggagcggcuggccgaccgcaagaucgcggaacucuucuccaccaagagccauaucggcuga

SEQ ID NO: 15310 - RNA, 5055 nt, Artificial Sequence
  derived and/or modified CDS sequence (opt11) from CCHFV(SPU 431/85)__KJ682812.1__GP
auguacacaccccucguaugcgcaguaaucugccuucagcucuggaauuuaggaggaacauugguaucaacaaaccgcacacaacauaacgagaccggcaccgucgcgaccccagagggcacucuccgaccucgccucccggucuccacagcccuccccaccaaauccgaucgcccgucggucggaccugccgccucauccuccggccuggaaggcaguggcgaacccaacaccagcccaucgaucacgacaaaaggguuaacaccaccagaaaccacacccgccuuacccacagccaccgacacugacgccucgucuacgggcgucguagacguauccacacagaugacuaaagacauuccaaugagcaccgccuacacuaacccgcccaguaccccgucugcccccucaacaccgcaggguacccaccacacagcacgaggguugcuaaguguugcaucuaccaaguccgaagaagucucaaugucuacaagccccgcuaagacaucaaccgaaacaucgagucccccacccgcaacuagcgaaacacccacacccuccccaacgacacagguccccaccgggaacaauaacccaaacacaucgcgacaaccuaccccgagcgcucaacccgccauguccaaccccgccacguccccugcccaaccgaaucuuagucaauccgccccgcccacagccgaucaaggcguacaccccagccccacgaaccguucuaaaagaaaccuagaaauagaaaucauccucacgcucucacaaggccugcgaaaauacuacggaaaaauacuuaagcuauuagaccucacccuggaagaggauacagaaggccuacuagaguggugcaaacgcaaccugggccuuaccugcgacgacaacuucuuccaaaaacgcaucgaggaguucuuucucacaggggaaggcuacuucaaugaaguccuccaauucaaaguuccgagcacccugucaagcaccgaacccacccacacgcgucccccgacagucgaaccguucaaauccuacuucgccaaaggcuuccucagcaugaacuccggcuacuucuccgcaaaguguuacccgcguaccuccaacaguggucuccaacucaucaacgugacaaagcacuccgccaagauagcagauaccccugggccaaaaauuacgaaccucaaaacgauaaacugcaucaaucugcgagcaaguguauuuaaggaacaccgggaggucgaaaucaacguacuacuaccccagguagccgucaacuuaagcaacugccaugcgcaaauaaaaagccacguuugugacuauucccucgccacagauggcaugguucgccugccccacauccaccaugaagggaccuuuaucccaggcaccuacaagaucguaauagauaagaaaaacaagcaaaacgaccgauguaccuuggugaccaacugugucauaaaaggacgagagguccgcaaaggccaguccgcccucagacaauauaaaacugaaauacgcaucggcaaggcuuccuccggauccaggcggcucuuaucagaagaauccgacggagacugcauaucacgaacacagcuuuugcgcacagagaccacagaaauccacagcgacaacuauggcgggcccggcgacaaaauaacaaucugcaacggcuccaccauagucgaccaacgccucgggagcgaacuaggauguuacaccaucaaccgcgucaaaucauuuaaacuaugcgaaaacucggcaaccggaaaaagcugcgagaucgauucuacaccuguuaaaugccgacagggguucugccucaaaauaacacaagaaggccguggacacgucaaacuaucacguggaucagaaauaguccuagacgcaugcgacuccaacugugaaauuaugauacccaaggguaccggagacauauuagucgacuguucagggggacaacagcacuuccucaaagacaaccucaucgauuuaggcugucccaacaucccacuucuggguaagauggcuauauacaucugccguaugucaaaccauccgaaaaccaccauggcauuccuauucugguucaguuucggcuacguaaucacaugcauacugugcaaagucauauucuaccuacuaauaguagccgggacugugggcaaaaaguucaaacaauaccgagaacuccgaccccaaacaugcaccauaugcgaaaccauccccgugaaugcgauugacgcggaaaugcacgaccuaaacugcuccuacaacauaugucccuauugcgcaagccgccuuacauccgacgggcucgcccgacaugucaugcagugccccaaaagaaaagagaagguagaagaaacggaacuuuaccuuaacuuagagcgcaucccaugggucgugcguaaacuucuacaagucagcgaaucaacaggcgucgcccuuaaacgaagcuccuggcucacaguccuccuagugcuccucauuguaucauuaagccccguccaaucagccccuauuggacacggcaaaacuauagaaacauaccaagcccgugaaggcuacaccagcuuuugccucuucauacugggaagcauuuuauucguugucagcugucucguaaaaggccuaauagauucaguaggaaacucuuucuuuccaggccugagcauaugcaaaacaugcucgaucggaagcaucaacggcuucgaaaucgaaucccauaaguguuacuguucccucuuuugcugccccuacugucgccacugccccgccgacagagagauacauaaacuccaccuguccaucugcaagaaacgaaaaacaggcuccaaugucaugcucgccguaugcaaacgcaugugcuuccgagccaccaucgaaguauccaaccgcgcccuccucauacggaauauaaucaauacaaccuucgucguaugcauccucacacucgccgucuguguagucucuacaucagcaguugagauggaaagucugcccgccggaaccugggaaaaagaagaagaccucaccaacuucugccaucaagaaugccaggucaccgaaacugaaugucucugccccuacgaagcccugguccucagaaaaccacucuuccuagauucaaucguaaaaggucguaagaauuuacuuaauagcacaucucuugaaaccagccuauccaucgaagcgccuuggggagccauuaauguccaaagcaccuucaaacccaccguuucagccgcuaacaucgcacugagcugguccuccgucgagcaccgcggcaauaaaauucucguaucuggucgcucagaaagcauaaugaagcucgaggaacgcacaggcaucuccugggaccuaggcguugaagacgcauccgagucaaaacuguuaaccguaucaguaauggaccuaucccaaauguauucgccaguauuugaauaccucucaggcgaccgacaggucgaagaguggccaaaagcaacguguacaggagacugccccgaacgcugcggcugcaccuccucaacgugucuccacaaggaauggccccacucacguaacuggcgcuguaacccuacuuggugcuggggagucggaacagguugcacaugcugcggccucgacgugaaagaucucuucaccgacuacauguucgucaaauggaaaguggaauacaucaaaacagaagcuaucguuugcgucgaacugaccucccaggaacgccaguguucuuuaauagaggcuggcaccagauucaaccuaggccccguaaccaucacacucagcgaaccaaggaacauucaacaaaaacuacccccagagauaaucacauuacauccgcgcaucgaagaaggcuucuucgauuuaaugcacguucaaagaguucugucagccuccaccgucugcaaacuacaaucuugcacucacgguguccccggcgaucuacaagucuaccacauuggcaaccuacucaaaggagacaaaguaaacggccaccuuauacacaaaauagagccccauuucaauacaucauggauguccugggacggcugcgaccuggacuacuauugcaacaugggcgacuggcccuccugcaccuauaccggggucacgcaacauaaucacgcugcguucguaaacuuacucaacaucgaaacggacuacacuaaaaacuuccacuuccacucaaaacgugucacggcgcacggagacacaccccaacuagaccugaaagcacggccuaccuacggagccggagaagucacgguacucgucgaaguagcagauauggaacuacacacgaaaaagaucgagauauccggccucaaauuugccucauuaaccugcaccggcugcuacgccuguuccucugguaucucaugcaaagucaagauccacguagacgaaccagacgagcuaaccguucauguuaaaagugaagacccagacauaguagccgcaggauccucucugauggcgcgcaaguuagaguucggcgcagauucaaccuuuaaggccuucuccgccaugccaaaaacuagccucugcuucuacauuguagaacgcgaauacugcaaaagcugcucacgugaagacaccagaaagugcgucaacaccaaacucgaccgcccccaaucaauacucaucgaacacaaagguacgaucauuggaaaacaaaacaacacguguacagcuaaagcaucaugcuggcucgaguccguaaaaucauuuuucuacgggcuuaaaaacaugcucucgggaauauucggcaacgucuuuaucgggaucuuccucuucaucgccccuuuuguacuccugauccucuucuuuauguuuggguggcgaauacuuuucuguuucaaaugcugccgccguacccgcggccucuucaaguacaggcaccuuaaagacgaugaggaaaccggcuauagaaagaucauugaacgacugaauaauaagaaaggcaaaaacaaacuccuagacggagaacgacuggccgacagaaaaaucgcagaacucuucagcacgaaaucccacauaggauaa

SEQ ID NO: 15311 - RNA, 5055 nt, Artificial Sequence
  derived and/or modified CDS sequence (opt11) from CCHFV(8402)__AB069674.1__GP
auguacacuccccugcucugcgccgugcugugucugcaacucuggagccuggagggcucccacgggcugagcaacaagacccaacacuccaacaccagcaccaccaaggccccggaggucucgcaggagcucggccuucccgucagcaccguguccacgaucaccagcgacccgcccucgaucaccagcgcgguuuccgugagcggguccgagggcagcggggacaccaacacgucucccagcgugaccacccagggccccacccugcccgagacgacccucgagccccugacgaccacggacaccgacgccuccagcaccgucgugguggacgucuccacccagacggugaaggacaccccgauaagcaccaccuacacgagccugcccuccacccccagcgaacccaccaccccgcaaggaacgcaccacaccgcccgcgggcuccuauccgugaccagcaccaagcccgaggaggccuccacccaggccaaccccggcaagaucagcauggagaccaacgggccccgucuggcgaucagugagaccccgagcuucucccccaccacccaggcccccacugaaaacagcaaccccaucaccucgaagcaacuuaugcuuagcgcccagccggucacccccaaccccaugaccucccccgugcagccggcccugagccaguccgacacgagcaccgcgauccaggaugugcacccaucgcccacuggccgcagcaagcggaaccucgagauggagaucauccugacccugucccagggauuaaagaaguacuacggcaagauccugaagcugcucgaccugacgcuggaggaggacaccgaaggccuccuggaguggugcaagagaaaccuggggcucgucugcgacgacaacuucuuccagaagcggaucgaggaguuuuuccugacaggcaaggggcacuucaacgaggugcugcaguucaagacccccucgacgcucucgccgaccggccccgcccgcaccggcucccccacaguggaaccguucaagagcuacuucgccaagggauuccuguccauggacagcggcuacuucucagccaagugcuacccacgggccagcaacuccgggcugcagcucaucaacgugacacaacacagcaccaggaucacugacaccccuggccccaagaucacgaaccugaagaccaucaacugcaucaaccugaaggcguccguguucaaggagcaccgggagaucgagaucaacguccuccugccgcaggucgccgugaacuuaagcuccugccacgugcuaaucaagagccacgucugcgacuacucccuggacaucgacgggcccgugcgccugccccggauccaccacgagggcaccuucauccccggcaccuauaagaucgucaucgacaagaagaacaagcagaacgaccggugcacgcucgugaccaauugcgugaucaaggggagggagauccgcaagggccagagcguccuucgacaguaccguaccgagaucaagaucgggaaggccuccagcggcucccggcgccuguugagcgaggagagcggggaugacugcaucucgcggacccagcugcugcgcacggagaccgcagagauccacaacgauaacuacggcggccccggggacaagaucaccaucugcaacggcagcaccgugguggaccagcggcugggguccgagcucgggugcuacacgaucaaccgcgucaagagcuucaaguuaugcgagaacuccgccaccggcaagagcugcgagaucgacuccacccccgugaagugccgccagggguucugccugaagaucacccaggagggcagggggcacgugaaacucagccgcggcucggaggucguacuggaugcgugcgauuccuccugcgagauaaugauccccaaggggacgggcgauauccugguggauugcagcggcggccaacagcacuuuuuaaaggacaaccugauagaccugggcugccccaacaucccgcuccuggggaagauggccaucuacaucugccggauguccaaccaucccaagaccaccauggcauuccuguucugguucucuuucggcuacgucgugaccugcauccucugcaaggugaucuucuaccugcugaucguaguggggacgcucggcaagaaguucaagcaguaccgcgagcugaagccccagaccugcaccauuugcgagacaacccccgugaacgccaucgacgccgaaaugcacgacuugaauugcuccuacaacaucugcccguacugugcgagccggcucacguccgacggccuggcacgccacgucaugcagugccccaagcgaaaggagaaaaucgaggagaccgagcuguaccucaaccuggagcgcauccccuggguggugcggaaguuacuccaggucagcgaguccaccgggguagcccugaagcguagcagcuggcuggugguccuccuggugcugcucacugugucccugagccccguccaguccgccccgaucggccacgggaagacgguggagaccuaccaaacccgggagggcuacaccagcaucugccuguucgugcucggguccauccuguucaucguuaguugcuuaaugaagggccucguggacuccgucggcaacagcuuuuuccccggguugagcaucugcaagacgugcagcaucggcuccgucaacggguucgagaucgagagccacaaauguuacugcucccuguucugcugucccuacugccgccacugcagcgcagaccgggagauccaccgccuccaccuguccaucugcaagaagcggaagaccggcagcaacgugaugcuggcggugugcaagcgcaugugcuuccgcgccaccgucgagguguccaacaaagcccuccugauccgcaacaucauuaacaccacguuugugcugugcauccucaucuuagcggucugcguggugagcacguccgcgguagagauggagagcuuacccgccgggaccugggagcgggaggaggacuuaaccaacuucugccaccaggagugccaggugacggagaccgagugccugugcccguacgaggcccuugugcuccgcaagcccuuauucagcgacuccaucgucaagggcaugaagaaccugcucaauagcaccucccuggagacaagccuguccaucgaggccccuuggggcgccaucaacgugcagagcacguucaaaccgaccguguccgcggccaacaucgcucucaguugguccagcguggagcaccgugggaacaagauccugguguccggccggucugaguccaucaugaagcuggaggagcgcaccgggaucagcugggaccucggcguggaggacgcuuccgagagcaagcugcugaccgucuccgugauggaccucagccagauguacuccccagucuuugaguaccugagcggggaccgccagguggaagaguggcccaaggccacgugcaccggcgauugccccgagcggugcggcuguaccagcuccacgugccugcacaaagaguggccccacagccgaaauuggcgcugcaaccccaccuggugcuggggcguggggaccgggugcacgugcugcggccucgacgucaaggaccuguucaccgacuacauguucaucaaauggaagguggaguacaucaagaccgaggcgaucguuugcgucgagcugacaagccaggagcggcagugcacccuaaucgaggcaggcacgcgcuucaacuuagggcccgugacgaucacccuguccgagccccggaacauucagcagaagcucccgcccgagaucgugacacugcacccccgcaucgaggagggcuucuucgaccugaugcacguccagaaagugcucuccgccagcaccgugugcaagcugcaguccugcacccacgggguccccggcgaccuccagguguaccacauuggaaaccuacugaagggcgacaaagugaacggccaccugauccacaaaaucgagccgcacuucaacaccagcuggauguccugggacgggugcgaccucgacuacuacugcaacaugggcgacuggcccagcugcaccuacaccggggucacgcagcacaaccacgccgccuucgugaacaugcugaacaucgagacagacuacaccaagaacuuccacuuccacuccaagcgggugaccgcgcacggcgacacuccccagcuggaccucaaggcccgccccaccuacggagccggcgagaucaccguccugguggagguggccgacauggagcugcauaccaagaagaucgagaucagcggccucaaauucgccucccugaccugcacgggguguuacgccugcagcuccggcaucagcugcaagguccggauccacguggacgagccggaugagcugaccgugcacgucaaguccgaggaucccgacaucguggccgccagcuccagccucauggcccgcaagcuggaguucgggaccgauagcaccuucaaggcguucuccgccaugcccaagacgagccugugcuucuacauuguggagagagaguauuguaagaguugcagcaaggaggacacgcagaagugcgucaacaccaagcucgagcaaccccaguccauccucaucgagcacaaaggaaccaucaucgggaaacagagcaacacgugcaccgccaaggccuccugcugguuagagagcgugaaguccuuuuucuacggccugaagaacaugcucagcggcaucuucgggaacguguucaucggcgucuuccuguucuucgccccguucauccuacucauccuguucuucauguuuggguggcguauccuguucugcuucaagugcugccggcgcacccggggccucuucaaguaccgccaccugaaggacgacgaggagaccggcuaucggaagaucaucgagcgacugaacaacaagaagggcaagaacaagcuccuggacggcgagcgccuggcggaccggaaaaucgccgagcuuuucuccacgaagacccacaucggguga

SEQ ID NO: 15312 - RNA, 5055 nt, Artificial Sequence
  derived and/or modified CDS sequence (opt11) from CCHFV(SPU 383/87)__KJ682806.1__GP
auguacacgccccugcucugcgccauucugugccuccagcucuggagccuggagggcaucuacgggcuguccaaccgcacccagcacaacgacaccagcaccaucaaagugccggaggagucccagaagaccagccuccccgccaacaccgcgucccccauuacgagcgacccgcccuccaccaccagcaccgccuccgccagcggccccgagggguccggcgacacgagcaccuccccgcccgucaccacccaggggcccacaccgcccgagaccacccccgagccccacaccacgaucgacaucgacaagagcuccaccgccaucgccgacaucagcacccagaccgugaaggacauccccacgcccaccacccacaccucucugcccagcacgcuguccgcgccgaccaucccccaggaggcccaccacaccgcccggggccuccugagcaucaccagcacgaagcccggcgaggccuccacccccaucagcccgggggaggcgucuaccgaggccucuagcccccagcccaccaucuccgagacgcccuccccaccgccaaccgcccaggcccccaccgagaucaacucccccaacaccucccgccagcccaugcccagcacgcaaccggccgcgcccaacuccgugacccaccccgcccagccuaccccgagccaguccgacguccccaccgccgcccaggacauucaccccaaccccaucaaccggagcaagcgcaaccuggagauggagaucauccucacccugucccagggccugaagaaguacuacgggaaggugcuaaagcugcuggaccuaacgcuggaggaggacaccgagggccugcucgagagcugcaagcggaaccuggggcugacaugcgacgacaacuucuuccagaagcgcaucgaggaguucuuccucaccggcgagggucacuucaacgagguccugcaguucaagacgccuuccacacugagccccaccgagcccgcccgggucgagucccccaccguggagccguucaagagcuacuucgcgaagggguuccucagcauggacuccggcuacuucagcgccaaaugcuacuccaagucuuccaacagcgggcugcagcugaucaacgugacgcagcaccuuauccgcaucaccgacacccccggcccaaagaucaccaaccuaaagacgauaaacugcaucaaccugaaggcccucgucuucaaggagcaccgggagaucgagaucaacgugcugcugccccagguggccgucaacuuguccaacugccacgugcugaucaagagccacgugugcgacuacucccuggacauugacggccccguccgccucccccggauccaccacgaggggaccuucauccccggcaccuacaagaucgugaucgacaagaacaacaagcagaacgaccgcugcacccuggugaccaacugcgucaucaaggggcgggagauccgcaagggccagagcgugcugcgccaguaccgcaccgagaucaagaucgggaaggccuccagcggcucccggcgccuccugagcgaggagucgaacgacgacugccugagccggacccagcuccugcgcaccgagaacgcggagauccacuccgacaacuacggagggcccggcgacaagaucacgaucugcaacgggagcaccaucguggaccagcggcugggcagcgagcucgggugcuacaccaucaaccgcgucaaguccuucaagcugugcgagaacagcgcuaccggcaaguccugcgagaucgauagcacgccggugcgcugccggcagggcuuuugucugaagauaacacaggaggggcgcggccacgugaagcugucccgggggagcgaggucgugcucgacgccugugacuccagcugcgagaucaugauccccaagggcaccggggacauacuggucgacugcuccggcggccagcagcacuuccugaaggacaaccucguggaccuggggugccccaacaucccccugcucggcaagauggcuaucuacaucugccgcaugagcaaccacccgaagaccacgauggccuuccuguucugguucuccuucggguacgugaucacguguauacugugcaagguaaucuucuaccuccuggugguggucggcacccugggcaagaaguucaagcaguacagggagcucaagccccagaccugcaccaucugcgagaccaaccccgugaacgcuaucgacgccgagaugcacgaccugaacuguagcuacaacaucugcccguacugcgccucccgccugaccagcgacgggcucgcccggcacgugauccagugccccaagcgcaaggagaagaucgaggagacagagcuauaccugaaccuggagcggauccccugggucgugcgcaaguuacuccagguauccgagagcacgggcgucgcgcucaagcgguccucguggcuggugauccugcucgugcugcugaccgucucccugucccccgugcagagcgccccgaucucccacggggagaccguggaggucuaccagacccgcgagggcuacaccagcaucugccuguucgugcugggguccauccucuuccugguuagcugccugaugaagggcuuagucgacucagugggcaacagcuucuuccccgggcuguccaucugcaagacgugcagcauaggcuccaucaacggguucgaaaucgagagccacaagugcuacugcucccuguucugcugccccuacugucggcacugcagcgccgacaucgagauacaccgccuccaccuguccaucugcaagaagcggaagaccggcagcaacgugaugcuggccgucugcaagcgcaugugcuuccgggccaccguggaggucuccaacaaggcgcuccugauccgcaacaucaucaacaccacguucguagugugcauccugauccucgccgugugcgucgugagcaccuccgccguggagauggagaaccugccggccgggaccugggagaaggaggaggaccugaccaacuucugccaccaggagugccaggucacggagaccgagugccucugcccguacgaggcccuggugcugcgcaagccccucuuccuggacagcaucgugaagggcaugaagaaccugcucaacuccaccagccuggagaccagccuguccaucgaggcgcccuggggcgccaucaacguccagagcacguucaagcccaccguguccgccgccaacaucgcccucagcugguccagcguggagcaccgcgggaacaagauccuggucuccggccgaagcgaguccaucaugaagcuggaggagcggaccgggaucagcugggaccucggcguugaggacgcauccgagagcaagcugcugaccguguccgucauggaccucagccagauguacucccccguguucgaguaccugagcggggaccgccagguggaggaguggcccaaggccacgugcaccggcgacugccccgagcggugcggcugcacuuccuccacgugccugcacaaggaguggccccacagccgcaacuggcggugcaacccgaccuggugcuggggcgucgggaccggguguaccugcugcggccucgacgugaaggaccuguucaccgacuacauguucgugaaguggaaggucgacuacaucaagaccgaggccaucgugugcguggaacugaccagccaggagcgccagugcagccucaucgaggcagggacccgguucaaccugggccccgucaccaucacgcuguccgagccccgcaacauccagcaaaagcugcccccggaaaucgugacccuucaccccagaauugaggagggcuucuuugaccugaugcacauccagaagguccucagcgcguccaccgugugcaagcuacagagcugcacccacgggguacccggcgaccugcagaucuaccacaucgggaaucuccugaagggcgacaaggucaacggccaccugauccacaagaucgagccccacuucaacacguccuggaugagcugggacgggugcgacuuagacuacuacugcaacaugggcgacuggccguccugcagcuacaccggggugacccagcacaaccacgccgccuucgugaauaugcugaacaucgagaccgacuacaccaagaacuuccacuuccacuccaagcgcgucaccgcccacggcgacacuccccagcuggaccucaaggcccggcccaccuacggggcgggcgagaucaccgugcugguggaggucgccgacauggagcugcacaccaagaagaucgagaucagcggccucaaguucgccucccugaccugcaccgggugcuacgccugcagcuccggcaucucaugcaaggugcgaauccacguggacgagcccgacgagcugaccguccacgugaaguccgaggacccggacaucguggccgcgagcuccagccucauggcccggaagcuggaguuugggacggacuccaccuucaaggccuucagcgccaugcccaagaccagccugugcuucuacauagucgagcgcgaguacugcaaguccugcagcaaggaggacacccagaagugcgugaacacgaagcucgagcagccccaguccauccugaucgagcacaagggcaccaucuucgguaagcagaacgacacgugcaccgcaaaggcgagcugcuggcuggaguccgucaagagcuucuucuacggccucaagaacaugcuuuccggcaucuucgggaacguuuucaucggcguguuccuguuccuggccccguucaucaugcucauccuguucuucauguucggguggcggauccuguucugcuucaagugcugccgccggacccgcggccucuucaaauaccggcaccugaaggacgacgaggagaucggguaccgcaagaucaucgagcggcugaacaacaagaagggcaagaacaagcucuuggacggcgagcgccuggccgaccgcaaaaucgccgagcuguucagcaccaagacccacaucggguga

SEQ ID NO: 15313 - RNA, 5055 nt, Artificial Sequence
  derived and/or modified CDS sequence (opt11) from CCHFV(SPU 497/88)__KJ682808.1__GP
auguacacgccccugcucugcgccaucuuaugccugcagcucuggagccuggagggcaucuacgggcuguccaauaagacccagcacaacgacaccagcaccaucaaggugccagaggagucccagaagaccagccuccccgccaauaucgcgucccccaccacgagcgaucccccguccgccaccagcaccgccuccgccucgggccccgagggguccggggacaccagcacgucccccagcgucaccacccaggggccgaccccgcuggaaaucacgcccgagccccacaccaccaucgacauagacaaguccucaaccuccaucgccgacaucagcacgcgcaccgugaaggacauccccaccccgacaacgcacaccucucuucccagcacccccagcgcgcccaccauaccgcaggaggugcaccacacggcccggggccuccuguccgucacaagcaccaagcccgaggaggccuccacccugacgagccccggcgaggccuccaccgaggcgagcagcccccagccgaccaucuccgaaacccccagucccccgcccacgacccaggcacccaccgagaucaacaaccccaacaccucccgccagcccaugcccuccacgcagcccgccgcccccaacucagugaccccacccgugcagcccaccuucucccagagcgacgucuccaccgcugcgcaggacauccaccccagcccgaccaacagguccaagcgcaaccucgagauggagaucauccugacgcugagccaggggcucaagaaguauuacggcaaggugcugaagcugcucgaccugaccuuagaggaggacaccgaagggcuccuggaguggugcaagcggaaccuaggccugaccugcgacgacaacuucuuccagaagcgcaucgaggaguucuuccugacgggggaaggccacuucaacgaggugcugcaguucaaaacccccucaacccucagccccaccgagcccgcccgggucgagagcccgacgguggagcccuuuaaguccuacuucgcuaagggauuccugagcauggacuccggguacuucucugccaagugcuaccccaaguccagcaacucuggccuccagcucaucaacgugacccagcaccugauccgcaucaccgacacccccgggccuaagaucacgaaccugaagaccaucaacugcaucaaccucaaagcccuggucuucaaggagcaccgggagaucgagaucaacgugcugcucccccaggucgcgguaaaccugagcaacugccacgugcugaucaagagucacgugugcgacuacucucucgacaucgacggccccgucagauuaccccggauccaccacgagggcacuuucaucccggggacauacaagaucgugaucgacaagaagacgaagcagaacgaccggugcaccuuagugaccaacugcgucaucaagggccgggagauccgcaaggggcaguccgugcuccgccaguaccgcaccgagauuaagaucggcaaggccagcuccgggucucggcgcuugcuguccgaggagagcaacgacgacugccucucccggacgcaguugcucaggaccgagaacgccgagauccacuccgacaacuacggcggccccggggacaagaucaccaucugcaacggcagcaccaucguggaccagcggcucgggagcgagcugggcugcuacacgauuaaccgcguuaagagcuucaaguuaugcgagaacuccgccacaggaaagagcugcgagaucgacucaacccccguucguugccggcagggcuuuugccucaagaucacccaggagggcaaggggcacgucaagcucagccgcggcuccgagguggugcuggacgccugugacagcuccugcgagauuaugauccccaaggggacgggcgacauucuggucgacugcagugggggccaacagcacuuccucaaagacaaccugguggacuuagggugcccgaauaucccccuccuggggaagauggcgaucuacaucugccgaauguccaaccaccccaagaccaccaugguguuccuguucugguucagcuucggcuacgucaucacuugcauccucugcaaggugaucuucuaccuacugaucguggucgggacgcugggcaagaaguucaagcaguaccgcgagcugaagccccaaaccugcaccaucugcgagaccaacccggugaacgccauugacgcggagaugcacgaccugaacuguuccuacaacaucugccccuacugcgccagccggcucacguccgacggccuggcccgccacgugaugcagugccccaagcggaaggaaaagaucgaggagaccgagcuguaccucaaccuggagcgcaucccgugggucgugaggaagcugcuacaggugagcgaguccaccggggucgcgcugaagcgcagcuccuggcuagugaucuugcuggugcugcucaccgucagccugagcccagugcaauccgcccccaucucgcacggcgagaccguggaggucuaccagacccgggagggguacaccuccauuugccuguucgugcucggcgggauccuguuccugguaagcugccucaugaagggccugguugacuccgugggcaacagcuucuuccccgggcuguccaucuguaagaccuguucaaucggcagcaucaacggguucgagaucgagagccacaagugcuacugcucccucuucugcugcccguacugccgucacugcagcgccgacaucgagauccacaagcugcaccuguccaucugcaagaagcggaagacauggagcaacgugauguuagccgugugcaaaagaaugugcuuccgggcgacgguggagguguccaauaaggcgcugcugauccgcaacaucaucaacaccaccuucgucgugugcauucucauccuggccaucugcguggucagcaccuccgccguggagauggaaaaccugcccgccggcacgugggagaaggaggaggaccucaccaacuucugccaucaggaaugucaggugaccgagaccgaaugccuuugccccuacgaggcgcugguccuccggaagccccuguuccuggacucgaucgugaagggcaugcgcaaccuccugaacaguaccagccuggagaccagccucuccaucgaggccccauggggcgccauaaacguacagagcacguucaagcccaccgucuccgcggccaacaucgcucugagcuggucgagcguggagcaccggggcaacaagauccugguguccgggagaagcgaauccaucaugaagcucgaggaacgcacgggcaucagcugggaccugggggucgaggaugccuccgagagcaagcuacucacggugucggugauggaucugagucagauguauuccccagucuucgaguacuugagcggcgaccgccagguggaggaauggcccaaggcgaccugcaccggggacugcccagagcggugcggcuguacuagcagcaccugucuccacaaagaguggccccacucccggaacuggcgcugcaacccaaccuggugcuggggcgugggcaccgguugcacgugcugcgggcuggacgucaaagaccuguucaccgacuacauguuuguuaaguggaagguggacuacaucaagaccgaggccaucguaugcguggagcugaccagccaggagcggcagugcagccugaucgaggccggcacgcgcuucaaccuggggcccgucacgaucaccuuauccgagccgcggaauauccagcagaaacugccucccgagaucgugacccugcauccccgcaucgaggagggcuuuuucgaccucaugcacauccagaagguguuaagcgccuccacggucugcaagcugcagagcugcacgcacggcgugccgggggaccuccagaucuaccacaucggcaaccugcugaaaggggacaaggugaacggccaccuaauccacaagauugagccccacuucaacaccuccuggaugagcugggacggcugcgaccuggacuacuacugcaacaugggggacuggcccuccugcagcuacaccggcguaacgcaacacaaccacgccgccuucgugaacaugcugaauaucgagacggacuauaccaagaacuuucacuuccacucgaagcgggugaccgcccacggagacacgccccagcucgaccugaaggcgcgcccaaccuacggcgccggggagaucaccguccuaguggaggucgccgacauggagcuccacaccaagaagaucgagaucagcggcuugaaguucgccucccugaccugcacgggcugcuacgccuguagcuccggcauaagcugcaagguccggauccacguggacgagcccgacgagcucaccgugcacgucaaguccgaggaccccgacaucguggcggccagcaguagccugauggcccgcaagcuggaguucggcaccgauuccacauucaaggccuucagugccaugcccaagacgagccucugcuucuacauuguggagcgggaguacugcaaguccugcucuaaagaggacacccaaaagugcguuaacaccaagcuggagcagccgcaguccauccugauugaacacaaggggaccauaaucggcaagcagaaugacacgugcaccgcccgcgccagcugcuggcucgaguccauaaagagcuucuucuacgggcugaagaacaugcuguccggcauauucggcaacguguucaucgggaucuuucuguucuucgcccccuucaucaugcuaauccuguucuucauguucggcuggcggauccuguucugcuucaagugcugccgccggacccgcggacucuucaaguaccgucaucugaaggacgaugaggagguaggcuaucgcaagaucaucgagcggcugaacaauaagaaggggaagaauaaacuccuggacggcgagcgccuggccgaccgcaagaucgccgaacucuucagcaccaagacgcacaucggcuga

SEQ ID NO: 15314 - RNA, 5055 nt, Artificial Sequence
  derived and/or modified CDS sequence (opt11) from CCHFV(88166)__AB069675.1__GP
auguacacuccccugcucugcgccguucugugucugcagcuguggagccuggagggcucccacgggcucagcaauaagacccagcacuccaacaccagcaccaccaaagccccggaggucucccaggagcuaggccugcccgugagcaccguguccacgauaaccuccgacccgcccuccaucacgagcgcggucagugugagcgggagugagggcagcggggacaccaauacguccccgagcgugaccacccaaggccccacccugcccgagacgacccucgagccccugacuaccacggacaccgacgccuccagcaccgucgucguggacgucucuacccaaacggugaaggacaccccgaucagcaccaccuacacgagccugcccuccacccccucugagcccaccaccccgcagggcacgcaccacaccgcccgcgggcuccuguccgugacaagcacuaaacccgaggaggccuccacgcaggccaaccccggcaagaucagcauggagacuaacagcccccgucuggcgaucagcgaaaccccguccuucagccccacuacgcaggcccccaccgaaaauuccaacccaaucaccagcaagcaacucaugcuguccgcccagccggucacccccaaccccaugaccagcccagugcaaccggcccugucccagagcgacacguccaccgcgauccaagacauccaccccagccccaccgguagguccaagcggaaccucgagauggagaucauucugacccugagccagggucucaagaaguacuaugggaagauccugaaacuucuugaccucacgcuggaagaggacaccgagggacuccuggaguggugcaagcgcaaccugggccuuguuugcgacgacaacuucuuccagaagcggaucgaggaguucuuccuuaccgggaagggccacuucaacgagguccugcaguucaagacacccagcacgcucuccccgaccgggcccgcgcgcaccgggagccccacaguggagccguucaaguccuacuucgccaagggcuuccugagcauggacuccggguauuucagcgcaaaaugcuauccccgggccuccaacagcggccuacagcugauaaaugugacgcagcauuccacacguaucaccgacacccccgggccuaagaucacgaacuuaaagaccaucaacugcaucaaccugaaagcgagcgucuucaaggagcaccgggaaaucgagaucaacguacuccugccccagguagccgucaacuuauccagcugucacgugcucaucaagucccacgugugcgauuacagccuggauaucgauggcccuguccgccugccccggauccaccacgaggguaccuucaucccaggcaccuacaagauuguaaucgacaagaagaacaagcaaaacgaccgcugcacccucgugaccaacugugugaucaagggccgggagaucagaaaaggucaguccgugcugcgucaguaccgcaccgagauuaagauaggcaaagccagcuccgggagccggcgccugcucagcgaggaguccggcgacgacugcaucucacggacccagcuacugaggacggagaccgccgagauccacucugacaacuacgggggcccgggcgacaaaaucaccaucugcaacgggucaaccgucgucgaccagcggcugggcuccgagcucgggugcuacacgaucaaccgagucaaguccuuuaaacugugcgagaacuccgccaccggcaagagcugcgagaucgacuccacccccgucaagugucgccaaggguucugccugaagaucacccaggagggccguggccacgugaaacuuagccgcggguccgaggugguccuggacgcgugugacagcuccugcgaaaucaugaucccaaagggcacgggggacauccugguggauugcucgggcggccagcagcacuuccucaaggacaaccugaucgaucugggaugccccaacaucccccucuuggguaagauggcuaucuacaucugccggaugucaaaccaccccaagacuaccaugggcuuccucuucugguuuagcuucggcuauguggugaccugcaucuugugcaaggugaucuuuuaccugcuaaucgugguagggacgcucgggaagaaguucaagcaauaccgcgagcugaaaccacagaccugcaccaucugcgagaccacucccgugaacgccaucgaugccgagaugcacgaccuaaacugcuccuacaacauaugcccauacugugccucacgucuaacguccgacggccuggcgcgucacguuaugcagugucccaagcggaaggagaagauugaggagaccgagcuguaccucaaccuggagcgcauccccugggucgugcggaaguugcuucaggugagcgagagcacgggggucgcccugaaacgcuccagcuggcucgugguacuccugguccugcucaccgugucccuaucccccgugcaguccgccccgaucggccacgguaagacggucgagaccuaucagacccgcgagggcuacaccagcaucugucuguucguguugggguccaucuuguucaucgugagcugccugaugaagggacucgucgacuccgugggcaacagcuucuuccccgggcuguccaucugcaagacgugcagcaucggcuccgugaacggguucgagaucgaaagccacaagugcuauuguucccuguucugcugccccuacugccgccacugcucagccgaccgggagauccaccgccuccacuuguccaucugcaagaagcggaagaccuggagcaaugucaugcuggccgugugcaagcgcaugugcuuccgagcgaccguagaggucuccaacaaggccuugcugauccgcaacaucaucaacaccacguucgugcugugcauccugauccuagccgugugcgucgugagcaccagcgccguggagauggagucucugcccgcgggcacgugggagcgggaggaggacuugaccaacuucugccaccaggaaugccaggucacggagacagagugccugugcccauaugaggcccuggugcuccgcaagccccuguucucggacuccaucgugaaggggaugaagaaccugcucaacagcaccuccuuagagaccagccuguccauagaggcccccuggggcgccaucaacguccaaagcacguucaaaccgaccauguccgccgcgaacaucgcccucaguugguccagugucgagcaccgcggcaacaagauccugguguccggccggagcgaguccaucaugaagcuggaggagcgaacgggaauuagcuggaaccucggggucgaggacgcauccgagagcaagcugcugaccgugaguguuauggaccucagccagauguacagcccugucuuugaguaccuuuccggagaucgccaggucgaggaguggcccaaggccacgugcaccggggacugccccgagcgaugcggaugcaccagcuccacgugccugcacaaggaguggccgcacagucggaacuggcgcugcaaccccaccuggugcuggggcguugggaccgguugcacgugcugcggucucgacgugaaggaccuguuuaccgauuauauguucaucaaguggaaaguggaauacaucaagaccgaggccaucgucugcguggagcuuaccucccaggagcggcaauguacccucaucgaggcuggcacccgcuucaaccuaggccccgugacaaucacacugagcgagccccggaacauacagcagaagcugccucccgagaucgucacccugcacccccgcaucgaggagggguucuuugaccugaugcaugugcagaaggugcucuccgccagcaccgucugcaagcugcaauccugcacccacggcguucccggggaccuucagguguaccacaucggcaaccugcuaaagggggacaaggucaacggacaccugauccacaagaucgagccgcauuucaauacaagcuggauguccugggacggcugcgaccucgacuacuacugcaacaugggagacuggcccagcugcaccuacaccggcgugacccagcacaaccacgcggccuuugugaacaugcugaacaucgagacggacuauaccaagaacuuccacuuccacuccaagcgggucaccgcccacggagacacgccccagcuggaucucaaggcgcgucccaccuacggggccggggagaucaccgugcugguggaagucgccgacauggagcugcacaccaagaaaaucgaaaucagcggccucaaauucgccucccucacgugcacgggcugcuaugcgugcagcucagggaucagcugcaaggugcgcauccacguggacgagccggacgaacugaccguccacgugaaguccgaggaccccgaccucguagccgccaguagcucccugauggcgcggaaguuagaguucggcaccgacagcacguuuaaggccuucuccgcgaugcccaagacgagcuuauguuucuacaucgucgaacgggaguacuguaaguccugcagcaaggaggacacgcagaaaugcguaaacaccaagcuggagcagccccaguccauccugauagagcacaaggguaccaucaucgguaagcaaaacaacacgugcacugccaaggcgagcugcuggcuggagagcgucaagagcuucuucuacgggcuaaagaacaugcuguccggcaucuucggcaacgucuucaucggcguguuccuguucuucgccccauucauccuccugauccuguucuucauguucggcuggcgaaucuuguucugcuucaagugcugccggcguacccgggggcuguucaaguaccgccaccugaaggaugacgaggagaccggcuaccggaagaucaucgagcgccucaacaacaagaagggcaagaacaagcugcuggacggggaacgcuuagccgaccggaaaaucgcggagcuuuucagcacgaagacccacaucggguga

SEQ ID NO: 15315 - RNA, 5055 nt, Artificial Sequence
  derived and/or modified CDS sequence (opt11) from CCHFV(strain BA88166)__AF338470.1__GP
auguacacgccccuacucugugccguacugugccugcaacucuggagccuggagggcucccacgggcugagcaacaagacccagcacuccaacaccagcaccaccaaggccccggaggucucccaggagcucggccugcccgugagcaccgugucuaccaucaccagcgacccgcccuccaucaccagcgcuguguccgugaguggguccgagggcagcggcgacacaaacacguccccgagcgugaccacccagggccccacccuuccggagacgacccucgagccgcugaccacuacggacaccgacgcauccagcaccgucgugguggacgucuccacccagacugugaaggacacccccaucaguaccaccuacacgagccugcccuccaccccaagcgagcccaccaccccgcagggcacgcaccacaccgcccgcgggcuccugucugugaccucuaccaagccagaggaggccuccacgcaggccaaccccggcaagaucagcauggagaccaacagcccccgguuagcuaucuccgagaccccguccuucagccccaccacgcaggcccccaccgagaacuccaaccccaucaccagcaagcaacucaugcugucagcccagccgguaacccccaaccccaugaccagccccgugcaaccggcccugucccagagcgacacguccaccgcgauccaggacauccaccccagccccaccgggcgcuccaagcggaaccucgagauggagaucauucugacccugagccaggggcucaagaaguauuacgggaagauccugaagcugcucgaccugacgcuggaggaggacacagagggccuucuggaguggugcaagcgcaaucugggccuggugugcgacgacaacuucuuccagaagcggaucgaggaguucuuccugacggggaagggacacuucaaugagguccugcaauucaagacuccuagcacgcucuccccgaccgggcccgccaggaccggcucuccgaccguggagccguucaaguccuacuucgccaagggcuuccugagcauggacaguggguacuucagcgccaagugcuacccccgggccuccaacagcggccugcaacucaucaacgugacgcagcacuccacccgcaucaccgacacccccgggccuaagaucacgaaccugaaaacuaucaauugcaucaaccugaaggccagcgucuucaaggagcaccgggaaaucgagaucaacguucuacugccccagguugccguuaaccuuuccagcugccacgugcucaucaagucccacgugugcgacuacagccuggacaucgacggccccguccgccugccgcgcauccaccacgaggggaccuucauccccggcaccuacaagaucgugaucgacaagaagaacaagcagaacgaccgaugcacgcucgucaccaacugcgugaucaagggccgggagauccgcaaggggcaguccgugcuucggcaguaccgcaccgagaucaagaucggcaaagccucauccgggagccggcgucugcucagcgaggaguccggggacgacugcaucagccgcacccagcugcugcgcacggagaccgccgagauccacuccgacaacuacgggggcccaggcgacaagauaaccaucugcaacgggagcaccgucguagaccagcggcugggcuccgaacucgggugcuacacgaucaaccgcgucaagagcuucaagcugugcgagaacuccgccaccggcaaaucgugcgagaucgacuccacccccguaaagugccgccagggcuucugccugaagaucacccaggaaggccggggccacgugaagcucagccgcggguccgagguagucuuggacgccugcgauagcuccugcgagauaaugaucccaaaagguaccggggacauccugguggacugcagcggcggccagcagcauuuccucaaagacaaccugaucgaccuggggugccccaauaucccgcuccugggcaagauggccaucuacaucugccggauguccaaccaccccaagaccaccaugggguuccuauucugguucagcuucggcuacgugguuaccugcauccucugcaaggggaucuucuaccugcugaucguggugggcacgcucgguaagaaguucaagcaguacagagagcugaagccccagaccugcaccaucugugagaccacccccgucaaugccaucgaugccgagaugcacgacuugaacugcuccuacaacaucugcccguacugcgcaagccggcucacgucagacgggcuggcgcggcaugugaugcagugccccaagcggaaggagaagaucgaggagaccgagcuguaccucaaccuggagcgcauccccugggugguccggaagcuguuacaggugagcgagagcaccggcguggcccugaagcgcucgaguuggcuggucgugcuccuggugcugcucaccgucucccugucucccgugcaguccgccccgaucgggcacggcaaaacaguagagacauaccagacuagggagggguacaccagcaucugccuguucguccucggcuccauccuguucaucgugagcugccugaugaagggccucguggacuccgucgggaauagcuucuuccccggccuauccaucugcaagacgugcagcaucggguccgugaacggcuucgagaucgagagccacaaaugcuacugcucccuguucugcugccccuauugccgccacugcagcgcugacagagagauccaccgccuccaccuguccaucugcaagaagcggaagaccuggagcaacgugaugcuggccguuugcaaacgcauguguuuccgggcgaccguggagguguccaacaaggcccuccugauccgcaacaucaucaacaccacguucgucuugugcauccucauccuggccgugugcguugucagcaccagcgccguggagauggagucccugcccgccggcaccugggagcgggaggaggaccucacgaacuucugccaccaggagugccaggugacagagaccgagugccugugcccguacgaggcccuggucuuacgcaagcccuuguaccuggacagcaucgugaagggcaugaagaaccuccugaauagcaccagccuggagaccucacucuccaucgaggcccccuggggcgccauaaacgugcaguccacguucaagccgaccaugagcgccgcaaacauagcuuuaucauggagcuccgucgagcacagggggaacaagauccuggucagcggccgguccgagagcaucaugaagcucgaggagcgcaccgggaucuccuggaaccugggcguggaggacgccagcgagucuaagcugcucaccgucuccgugauggaccugucccagauguacagccccguguucgaguaccugagcggggaccggcaggucgaggaguggcccaaggccacgugcaccggcgacugcccggagcgcugcggcugcaccuccagcacgugccuccauaaggaguggccgcacucccggaacuggcgcugcaaccccaccuggugcuggggcguggggaccgggugcacgugcugcggccuggacgucaaggaccuguucacugacuacauguucaucaaguggaaagucgaguacaucaagaccgaggccauugugugcgucgagcucaccagccaggagcggcaguguacccugaucgaggcgggcacccgcuucaaccuggggcccgugaucaucacgcucuccgagcccagaaacauccagcagaagcugccgcccgagaucgugacccugcacccccgcaucgaggagggcuucuucgaccucaugcacguccagaaggugcugagcgccuccacugugugcaaguuacagagcugcacccacgggguccccggcgaccuccagguguaccacaucgggaaucugcugaagggcgacaaggugaacggccaccucauacacaagaucgagccccacuucaacaccuccuggaugagcugggacgggugcgaccuggacuacuacugcaacaugggugacuggcccuccugcacguacaccggugucacccagcacaaccacgcugccuucgugaauauguugaacaucgagaccgacuacacgaaaaauuuucacuuccacagcaagcgggugaccgcccacggcgacacgccacagcucgaccugaaggcgcgccccaccuacggggccggcgagaucaccguccugguagagguggccgacauggaauuacacaccaagaagaucgagaucuccggccugaaguuugcaagccugacaugcaccggaugcuacgcgugcuccagcggcaucuccugcaagguccggauccacguggacgaacccgacgagcucacggugcacgucaagagcgaggaccccgacauuguagccgccuccagcagccugauggcccgcaagcuggaguuugggaccgacuccacuuucaaggccuucagcgcaaugcccaagaccucccucugcuucuacaucguggagcgagaguacugcaagagcugcuccaaggaagacacgcagaagugcgucaacaccaaacuggagcagccccagagcauccuaaucgagcacaagggcacgaucaucggcaagcagaauaacacuugcaccgccaaggccuccugcuggcuggagagcgugaaguccuucuuuuacggccucaaaaauaugcugagcggcaucuucgggaacguguucaucggcgucuuccuguucuucgcccccuucauccuccucauccuguucuucauguucggcuggcgcauccucuuuugcuucaagugcugccggcgcacucggggccuguucaaguaccgccaccugaaagacgacgaggaaaccggcuaccggaagaucaucgagcgccucaacaacaaaaaggggaagaacaagcugcuggauggcgagcgccucgccgaccggaagaucgcggagcuguucuccaccaagacgcacaucggguga

SEQ ID NO: 15316 - RNA, 5055 nt, Artificial Sequence
  derived and/or modified CDS sequence (opt11) from CCHFV(SPU 130/89)__KJ682807.1__GP
auguacacgccccuucucugcgccauccugugccugcagcucuggagccuggagggcaucuacgggcuguccaacaagacucagcacaacgacaacagcacgaccaaggcgccggaggagucccacaagaccagccuccccgcgaacaccgccucccccaucacgagcgacccgccuuccacaaccagcaccacguccgccagcggccccgagggguccggcgacacgagcaccuccccgcccgugaccacgcaggggcccgccagccccgagaccacccccgagccccauacuacgaucgacaucgacaaauccagcaccgccaucgcggacaucaguacccagaccgucaaggacaucccgacgcccaccacccacaccagccugcccuccacgcugagcgcccccaccaucccgcaggaagcgcaccacaccgcccgcggccuccugucagugacccggcacaagcccggcgaagcgagcaagcccacgagccccggggaggccuccaccgaggccagcuccagccagccgaccaucuccgagacccccagcccgccacccacgacccaggccccaaccgagaucaacaaccccaacaccucccgccagcccaugcccagcacgcagcccgccgcgcccuccagcgugacccacccggcccagcccacgccgucccagagcgacguccccaccgccgcccaggacauccacccgucccccaccaaccggagcaagcgcaaccuggagauggagaucauccucacgcugucccagggccugaagaaguacuacgggaagguguuaaagcugcuggaccucacccuggaggaggacaccgagggccugcucgagugguguaagcggaacuuagggcugaccugcgacgacaacuucuuccagaagcgcaucgaggaguucuuccucacgggcgaaggccacuucaacgaggugcugcaguuuaagacccccaguaccuugucccccaccgagcccgcgcgggucgaaagccccacgguggagcccuucaagagcuacuucgcgaaggguuuccucuccauggacagcggcuacuucucagccaagugcuaccccaaaagcuccaauagcgggcugcagcugaucaacgugacccagcaccucauccgcaucaccgacaccccgggccccaagaucacgaaccugaagaccaucaacugcaucaaccugaaggcccucgucuucaaggagcaccgggaaaucgagaucaacgugcuccugccccagguggccgucaaccucuccaacugccacgugcugaucaagucccaugugugcgacuacucccuggacaucgauggccccguccgccucccgagcauccaucacgaggggaccuucauucccggcacuuacaagaucgugaucgacaagaagaacaagcagaacgaccggugcacccuggugaccaacugcgucaucaaggggcgcgagauccggaagggccaguccgugcugcgccaguaccggaccgagaucaagaucgggaaggccaguuccggcagccgccggcuccuguccgaggagcccaacuacgacugccugagccgcacccagcuccugcggacugagaacgcggagauccacuccgacaacuauggcgggcccggcgacaagaucaccaucugcaaugggagcaccaucguggaccagcgacugggcagcgaacucggguguuacaccaucaaccggguaaaguccuucaagcugugcgagaacucagccacgggcaaguccugcgagaucgacagcaccccggugaggugccgccaaggcuucugccugaagaucacccaggaggggcggggccacgugaagcugucccgcgggagcgaagucgugcucgaugcuugcgacuccagcugugagaucaugauccccaagggcaccggugacauccuggucgacugcuccggcggccaacagcacuuccugaaggauaaccucgucgaccuggggugccccaauaucccccugcucggcaagauggccaucuacaucugccggaugucuaaccacccgaagacgaccauggccuuccuguucugguucuccuucggguaugugauuacguguauccugugcaaggucaucuuuuaccuccugaucguagugggcacucuaggcaagaaguucaagcaguaccgcgaacucaagccacagaccuguaccaucugcgagaccaaccccgucaacgcgaucgacgccgagaugcaugaccugaacugcagcuacaacaucugcccguacugcgcaagucggcucaccagcgacgggcucgcccgccacgugaugcaaugccccaagcggaaggagaagaucgaggagacggagcuguacuuaaaccucgagcgcauccccugggugguccggaaacugcuccagguguccgagagcaccggcguggcgcugaagcgcuccagcuggcuggucgugcuccucgugcugcugaccgucucccucagccccgugcagagcgccccgaucucccacggggagaccguggaggucuaccagacccgggagggauauacgagcaucugccuguucgugcuggggagcauccucuuccuggugagcugccugaugaagggccucgucgauuccgugggcaacagcuucuuccccggucuguccaucugcaagaccugcagcaucggcuccaucaacggguucgagaucgaaagccacaagugcuacugcucccuguucugcugccccuacugccgccacugcagcgccgacaucgagauccacaagcuccacuuguccaucugcaagaagcggaagaccggcagcaacgugaugcuggcagucugcaagcgcauguguuuccgggcgaccguagagguguccaacaaagcgcucuuaauccgcaacaucaucaacacgaccuucgucguuuguaucuuaaucuuggccgugugcgucgugagcaccuccgccguggagauggagaaucugcccgccgggaccugggagaaggaggaagaccugacgaacuucugccaccaagagugccaggucaccgagaccgagugccucugccccuacgaggcccuggugcugcggaagccucucagccuggacuccauagugaagggcaugaagaaccugcucaacagcacgagccuggagacgucccugucaaucgaggcgcccuggggcgccaucaacguccaguccacguucaagcccaccgugagcgccgccaacaucgcccucuccuggagcuccguggagcaccgcgggaacaagauccuggucagcggccgguccgagagcaucaugaaacuggaggaacgcacggggaucuccugggaccucggcguggaggacgcgagcgaguccaagcugcugacuguaagcgucauggaucucucccagauguacucgccgguguucgaguaccuguccggggaccgccagguggaggaguggcccaaggcgacaugcaccggcgauugccccgagcggugcgggugcaccuccuccacgugccugcacaaggaguggccacacagccgcaacuggcggugcaauccaaccuggugcuggggcgucgggaccgggugcacgugcugcggccuggacgugaaggaccuguuuacggacuacauguucgugaaguggaaggucgacuacauuaagaccgaggcuaucguguguguggagcugaccagccaggagcgccagugcucccucaucgaggcagggacacgguucaaccugggcccagucacgaucacccugagcgagccccgcaacauacagcagaagcugcccccagagaucgugacccuccacccccggauugaggagggcuucuucgaccuuaugcacauccagaagguccuauccgccucaaccguguguaaguuacagucuugcacgcacggggugcccggcgaccugcagaucuaccacaucgggaaccuccugaagggcgacaaaguuaacggccaccugauacacaagaucgagccccacuucaacaccagcuggauguccugggacgggugugaccuggacuacuacugcaacaugggagacuggccgagcugcuccuacaccggggugacccagcacaaccacgccgccuucgugaacaugcugaacaucgagacugacuacaccaagaacuuccacuuccacagcaagcgcgucaccgcccacggcgacacuccccaacuggaccucaaagcccggcccaccuacggggcgggcgagaucaccgugcugguggaggucgccgacauggagcugcacaccaagaagguggagaucucgggccucaaguucgccagcuuaaccugcaccgggugcuacgccugcuccagcggcauauccugcaaggugcgcauccaugucgacgagcccgacgaguugacggugcacgucaagagcgaggacccggacaucguggccgcgucgagcucccuaauggcccggaagcuggaguucgggaccgacagcaccuuuaaggccuuuagcgccaugcccaagaccucccugugcuucuacaucguggaacgcgaacacugcaagagcugcuccaaggaggacacgcagcggugcgugaacacuaagcucgagcagccccagagcauccugaucgagcacaagggcaccaucaucgggaagcaaaacgacacgugcaccgcgaaggcgaguugcuggcuggagucaaucaaguccuucuucuacggccucaagaauaugcuuagcggcaucuucgggaacgucuucaucggcguuuuccuguuuuuggccccguuuauaauccucauccuguucuucauguucggguggcgcauucuguucugcuucaagugcugccgucgcacccgaggccuccuaaaguaccgccaccugaaggacgaugaggagaucggguaccggaaaaucaucgagcgccucaauaacaagaagggcaagaauaagcugcuggacggcgaacggcucgccgaccguaagaucgccgagcuguucuccaccaagacccacaucggguga

SEQ ID NO: 15317 - RNA, 5052 nt, Artificial Sequence
  derived and/or modified CDS sequence (opt11) from CCHFV(4701-ST-2009)__KR814872.1__GP
augcacacccugcuagugugcuuuauccuguaccugcaguugaguggccucgggggcgcgcacggucaguccaacgcgaccgagcacaauggcacuaacaccaccaccgcucccgggacaagccaguccccgaagccucccgccagcacgacgcugccccacacccccgagaguagcacggucaagcucaccacccccaccuccgagacagagggcagcggcgagacuacgcccccgcccaacaccacccagggguuaccccugaccggcaccacccccgagcgcagcgccacgaccgccaccuccaccuccagcacggacaacaugaacucgaccacccaggugacagacaacacgcccacuagcacuguguccaucagcccuuccucaaguaguagcaugcccuccacgccccaggggacccaccaccccguccggagccuccuguccgugucgucuccgaagaccgugaccacccccacgccaaugagccccggcgagauguccccggagaccagcucccaacacucagccaugucccgcguccccacccuguacaccgcgacccaggugagcacggagaacaccgaccgguccacgccccgccagucugaguccuccgugcagcccgccacccagucgccgauaaccagcccagcccagaccauccuccugauguccgccgcacccaaggcuauccaggacaugcacccgagcccgaccaaccggagcaaacgcaaccuggaggucgagaucauccucacccugucgcaggggcugaagaaguacuacggcaagauccucaagcuccugcaucuaacgcuggaggaggacaccgagggccugcucgaguggugcaagcggaaccugggaagcaacugcgacgacgacuucuuccagaagcggaucgaggaguucuucaucacuggcgaaggguacuucaacgagguucugcaguuuaagacccucuccacgcuuagccccaccgagcccucacacgugcggcugccaaccgcugagccguucaagagcuauuucgccaagggcuucuuauccauagacagcggguacuucuccgccaagugcuacccccgcuccuccaccagcgggcugcagcucaucaacgucacgcagcaccccgcgcgcaucgccgagaccccaggcccaaagaccaccucccucaagacaaucaacugcauaaaccuccgcgccagcguguucaaggaacaccgggagguggaaauuaacguccugcucccucagaucgccgugaaccuguccaauugccacguagucaucaacagucacgugugcgacuacucccuggacaccgacgggcccguucgccucccgcggauccaucacgaggguaccuucauucccgggaccuauaaaaucgucaucgaccgcaaaaacaagcugaaugaccggugcagccuggucaccaacugcguaaucaagggcagggagguucggaagggccagagcgugcuccgccaguacaagacggagaucaagaucgggaaagccucuacaggcagccguaagcugcuguccgaggagcccggggacgacugcaucucgagaacccagcuccuuaaaacggagaccgcggagauccacgacgacaacuacggcgggcccggcgacaagaucaccaucugcaacggcucgaccgucguggaucagcgccuggggagcgaacuugguugcuauacgaucaaccgggugaaguccuucaagcugugcgagaacucagcgaccgggaagacaugcgaaaucgacuccaccccugucaagugccgccagggcuuuugccugaagaucacacaggaagggcggggacacgugaaacugagccgaggcuccgaagugguccucgacgccugcgacagcuccugugagaucaugauccccaaagggaccggcgauauccugguggacuguagcgguggccagcagcacuuccuuaaggacaaccucaucgaucugggcugcccccacaucccccugcucgggaagauggccaucuauaucugucggauguccaaccacccgcgcacuaccauggccuuccuguucugguucagcuucggcuacgugaucacgugcaucuucugcaaggcgcuguucuacucacucaucaucaucgggacccugggcaagaagaucaagcaguaccgggaacugaagccccaaaccugcaccaucugcgagaccgccccaguaaacgccaucgacgccgagaugcacgaccugaacuguagcuacaauaucugccccuacugcgccucucgucugacgagcgacgggcuggcgcggcacguaacacaaugcccgaagcgcaaggagaaaguggaggagaccgagcuguaccugaaccuggagcggauccccuggauugugagaaagcuccuccaagugagcgaguccaccggcguggcccugaagcgguccucuuggcucaucguacugcuggugcuccugacggugagccugucccccgugcaaagcgcccccgugggucacgggaagaccauugagaccuaccagacccgcgagggcuucacguccaucugcuuguucaugcuggggagcauccuguucaucguguccugucucgucaagggccugguggauucugucuccgacagcuucuucccugggcuguccgucugcaagaccuguagcauuggcuccaucaacggcuucgagaucgagagccacaagugcuacugcucccucuucugcugccccuacugccggcacugcagugccgaucgcgagauccaccaguugcaccuguccaucugcaagaagcggaagaccgggagcaacgugaugcucgcggugugcaagcgcaugugcuucaaagccacaaucgaggccagcagacgcgcccugcugauccgcuccaucaucaacacaaccuucgucaugugcauacucacccucgccaucugcgugguaagcaccuccgcggucgaaauggaggacuuacccgccgguacgugggagcgggaggaggaccucaccaacuuuugucaccaggaaugccaggugaccgagaccgagugccuguguccguacgaggcguuagugcucagaaagccccuguuucuggacagcaucguuaaagggaugaagaaccuccuuaacuccacgagccuggagaccucccucagcaucgaggcacccuggggagccaucaacgugcagaguaccuucaagcccaccgugagcacggcgaacaucgcccuguccuggagcuccgucgagcaccgggggaacaagauccucgugaccggccgcagcgaguccaucaugaagcucgaggagcggacgggcgugagcugggacuugggggucgaggacgcauccgagucgaaacugcuuacggugagcaucauggacuuaagccaaauguacucgccgguguucgaguaccuguccggcgaccgccaggucgaggaguggcccaaggccacgugcaccggggacugccccgagcggugcggcugcaccagcagcacgugccuccacaaggaauggccccacucacgcaacuggcggugcaacccgaccuggugcuggggcguggggaccggcugcacguguugcggcguggacgucaaggaccuguucaccgaccacauguucaucaaguggaagguugaguacaucaagaccgaggccaucgugugcgucgaacugaccucccaggagaggcagugcagccucaucgaggcgggcacccgguucaaccugggccccgugaccauaacccuguccgagccccgcaacauccaacagaagcugcccccggagauuaucacgcuccaccccaagaucgaggagggcuucuucgaccugaugcacgugcagaagguccucagcgccuccaccgugugcaaacuucagucgugcacccacggcauccccggggacuuacagaucuaccacaucgggaaccucuuaaaaggugaccgggucaacggccaccugauccauaagaucgagccccacuucaacaccuccuggaugagcugggacgggugcgaccucgacuacuauugcaacaugggcgauuggccguccugcacguacaccggcgugacccagcacaaccacgccgcguucgugaaucuacugaacauugagacggacuacacgaagaccuuccacuuccauagcaagcgcgucaccgcgcacggggacacgccacaacucgaccugaaggcccggcccaccuauggcgccggggagaucaccgugcugguagagguagccgauauggagcuccacaccaagaaggucgaaaucuccggccugaaguucgccucccugaccugcacgggaugcuacgcguguuccucaggcaucuccugcaaggugcgcauccacgucgaugagcccgacgagcucaccgugcacgucaagagcagcgacccggacgugguggccgccuccaccagccucauggcccggaagcucgaguucggcaccgacuccacguucaaggcuuucagcgcgaugcccaagaccucucucugcuuuuacaucguggaacgcgaguacugcaagagcuguuccgaggacgacaccaagaagugcgucgacaccaaacuggagcagccccagucuauccugauagaacauaaggggaccaucaucggcaagcagaacgauaccugcaccgccaaggccuccugcugguuggagagcgugaaguccuucuucuacggccugaagaacaugcugggcagcguguuugggggcuucuuugucggcaucuuacuguuucuggcccccuucguauuacucgugcuguucuucauguuuggcuggaagaucuuauuuugcuucaagugcugccggcgcacccggggccuguucaaguaccgccaccuaaaggacgacgaagagaccggguaucgccggaucauugagagauuaaacuccaagaaggggaagaaccgacuccuggacggcgagcgccuggccgaccggaagaucgcggagcuauucucaaccaagacccacaucggguga

SEQ ID NO: 15318 - RNA, 5052 nt, Artificial Sequence
  derived and/or modified CDS sequence (opt11) from CCHFV(36-ST-2014)__KR814857.1__GP
augcacacccucuuagugugcuuuauccuguaccugcagcucagcggccucgggggcgcgcacgggcaguccaacgcaaccgagcacaacggcacgaacaccaccaccgugccggggaccagccaaucuccgaagccacccgcaucgaccacgcugccccauaccccggagucgagcacgguuaagcugacgaccccuaccuccgagaccgagggcucaggcgaaaccacaccacccccgaauaccacgcaagggcugccaccacccggcaccaccccggagcgccccgccaccaccgcgacgucaaugagcuccaccgacaacaugaacagcaccacacaggugaccgacaauaccccuaccucaacgguuucuaucucccccagcuccagccccuccaugccuagcacaagccaagggauccacuaccccgugcggucccugcugagcguguccagccccaagaccgucaccacgccgacccccaugucccccggugaaaugagccccgagacuuccagccagcacagcgccaugagccggauuccgacccuguacacggccacccaaguuuccaccgaaaacaccaacagaucuacaccccgccaguccgagagcuccgcucagcccgcuacgcaaagccccaccacauccccgacccagacgauucugcucaugagcgccgcccccaaagcgauccaagacaugcaccccucuccgacaaaucgaucaaagaggaaccucgaaguggagaucauacugacgcucagccaggggcugaagaaguacuacggcaaaauccugaaacuccugcaccugacccucgaggaggacacugagggccugcucgaguggugcaagcguaacuuaggguccaacugcgacgacgacuucuuccagaagcgaaucgaagaguucuucaucaccggcgaaggguacuuuaacgagguccugcaguucaagacccugaguacccuaucccccacggagcccagccacgugcggcugccaaccgccgagccguucaaguccuacuuugccaagggcuuccugagcaucgacuccggcuauuucagcgccaagugcuacccgcguuccucaaccuccggucuccagcuuaucaacgugacccagcacccggcccggauugcugagacgcccggcccgaagaccaccucucugaagaccauaaauugcaucaaccuccgcgccuccgucuucaaggagcaucgggaagucgagauuaaugugcugcugccccagaucgccguaaaccucaguaacugccacguggucaucaacucccacgucugcgacuacagccuggacacggacgggcccgugaggcugccccggauccaccaugagggcacauucauccccgggaccuacaaaaucguuaucgacaagaaaaacaagcucaacgaccgcugcucccuggucacuaacugcgugaucaaggggcgagaggugcgcaagggacagagcgucuuacggcaguacaagacggagaucaagaucgggaaagcaagcaccggcucccgcaagcuccucucggaggagcccggggacgacugcaucucccggacccagcugcucaaaaccgagacggcugagauccacgacgacaacuauggcgggcccggcgacaagaucaccaucugcaacggaaguaccauuguggaccagcgccugggauccgaguugggcuguuacaccaucaaccgugucaagagcuucaagcucugugagaacuccgcgacggggaagaccugcgaaauagacagcacgcccgugaagugccggcagggcuucugccucaagauuacucaggaggggagggggcacgugaagcucucccggggcagcgaagucgugcuggacgccugcgacuccagcugcgagaucaugaucccgaaggggacgggcgacauccucguggacugcuccgggggccagcagcauuuccugaaagacaaccugaucgaccuuggcugcccccacaucccccugcuggggaagauggccaucuacaucugccgcaugucaaaccauccccguaccaccauggcauuccucuucugguucuccuuuggcuacgucauaaccugcaucuuuugcaaggcacucuucuacagccugaucauaaucggcacucucggcaagaagaucaagcaguaccgcgagcugaaaccccaaacgugcacuaucugugagaccgcgcccguaaacgccaucgacgccgagaugcacgaccugaacugcuccuacaauauuugccccuacugcgccagucgccucaccuccgacgggcucgcccgccacgugacccagugucccaagcggaaggagaaggucgaggagacugagcuguaucucaaccuggagcguaucccguggaucguccggaagcugcuccaggugagcgagagcaccggcguagcgcugaagcgcuccagcuggcugaucgugcuccugguacuacucacugucucacugagcccugugcaauccgcccccgugggccacgggaagaccaucgagaccuaucagacccgggagggcuuuaccaacauaugccuguucaugcucgguagcauccucuucaucgucuccugccuugugaaaggcuuaguggacagcgucuccgauagcuucuucccggggcuguccguaugcaagaccugcucaaucggauccauuaacggcuucgaaaucgaaagccacaagugcuacugcagccuguucuguugccccuacugccgccacuguagcgccgaccgagagauucaccagcugcaccuggguaucugcaagaagcgaaaaacaggcucaaacgugaugcuggccgucugcaagcggauguguuucaaggcgaccaucgaggccagccgccgggcccucuugauucgguccauaaucaacaccacguucgugaucugcauccugacccucgccaucugcguggucagcaccuccgccguggagauggagaacuugcccgcuggcaccugggagcgagaggaagaccugaccaacuuuugccaccaagagugccagguguccgagaccgaaugccugugccccuacgaggcccuaguccuccggaaaccguuauuccuggacagcaucgugaagggaaugaagaaccugcucaacucgacgagcuuggaaaccucccugaguaucgaggccccguggggagccaucaaugugcaguccacguucaagcccaccgucagcaccgcuaacauugcgcuuuccuggucauccguggaacaucgcggcaacaaaauccucguuaccggccggagcgaaucgaucaugaagcucgaggaacgcacaggagucucgugggaccucggcguggaggaugcaagcgaaagcaagcugcugaccguguccaucauggaccuaagccagauguacuccccggucuucgaguaccugagcggcgaucggcaggucgaagaguggccgaaggccacuugcacaggcgauugccccgaaagaugcgggugcacgagcagcaccugucugcacaaggaguggccucacagccggaacuggcgcugcaaccccaccuggugcuggggcguggggaccgguugcacgugcugcggugucgacgugaaggaccuauucacagaccacauguucaucaaguggaagguugaguacaucaagaccgaggcgaucgucuguguggagcuaaccucccaggagcggcagugcagccugauagaggccgguacccgcuuuaaccucggacccgugacgaucacccuguccgagccccggaacauccagcagaagcugcccccagagaucaucacccuacauccgaagaucgaggagggauuuuucgaccugaugcacguccagaaggugcugagcgcgucgaccgugugcaagcuccagagcugcacucaugggauccccggcgaccugcagaucuaccauaucgggaaccugcucaagggcgaccgacuuaauggucaccugauccacaaaaucgagccacacuucaacaccuccuggaugagcugggacggaugcgaccucgacuauuacuguaacaugggagauuggcccucaugcaccuacacagguguaacgcaacacaaccacgccgccuuugugaaucugcugaauaucgagaccgacuacacgaagaccuuccacuuccacuccaagcggguaacagcgcacggcgacacuccgcagcucgaccugaaagcgcgccccaccuacggggccggcgagaucaccgugcugguggaggucgccgacauggagcuccacaccaagaagguggagauuuccgggcugaaguucgccagccuggccugcacgggcugcuaugcguguucgagcggcauauccuguaaaguccggauccaugucgacgagcccgacgagcucaccgugcacguaaaguccuccgacccggacgucguagccgccucuacuucgcugauggcgcgcaagcuagaguucgggacggauuccaccuucaaggccuucucugcgaugccgaaaaccucccucuguuucuacaucguagagagagaguacugcaagaguugcuccgaggacgacacgaaaaagugcgucgacacgaagcuggaccagccccagagcauacugaucgaacacaagggaaccaucaucgggaagcagaacgauaccugcaccgccaaggcaucuugcuggcucgagagcgugaaguccuucuucuacggccuaaagaauaugcugggaagcguguucggcaacuucuucgucggcauccuccuguuccuggcgccguucgugcuucuaguccuguucuucaugugcggguggaaguuccuguucuguuucaagugcugccgccggacgagaggccucuucaaguaccgacaccugaaggacgacgaagagaccgguuaccgccgcauuaucgagcggcucaauuccaaaaagggcaagaaucgccuccuagacggcgagcggcuggccgacaggaagauugcggaacucuuuagcacuaagucccacauuggguag

SEQ ID NO: 15319 - RNA, 5055 nt, Artificial Sequence
  derived and/or modified CDS sequence (opt11) from CCHFV(Matin)__AF467769.2__GP
auguacacccugcugcugugcgccauucugugcagucagcucugguccagcgaggggauccacgggcuguccaacgagacccagcacggcaacgccagcacaaucaaggcccccgaggugucacaggggcugggccuccccguuucuaccgcgccgcccaucaccuccgacccgcccucaaucaccuccgccgccagcguuucggggcccgagggcagcggcgacaccaacaccagcccucccgugaccacucaggggcuaacccuccccgagaccacccucgagcugcugaccaccaccaacaccggcgccagcuccaccgucaucguggacguuagcacccagacugucaaggacacccccgugucuaccgcccacaccagcccgcccgggacccccuccgccccaaccacgccccagggcacgcaccacaccgcccgcgggcuccugagcguuaccagcaccaaguccgaggaggccagcacccagaccaaccccaagaagaccuccauggagaccaauagcccgggccccgcgacguccgagacccccucccccucccccaccacccaggcccccacggagaacaacaaccccaacacaccccggcagccgacgccgcccacacagcccgccaccccgagccccgucacgucccccgcccugcucgccagcucccagggugacaccagcaccgccgugcaggacgugcauccuucccccaccaaccgcagcaagcggaaccuggagauggagaucauccucacgcucucccaggggcugaagaaguacuacggcaagauccugaagcuccuggacuuaacccucgaggaggacaccgaggggcugcuggagugguguaagcgcaaccucggccuggucugcgacgacagcuucuuccagaagcggaucgaggaguucuuccugaccggcgaggggcacuucaacgaggugcuccaguucaagacgcccucuacgcugagccccaccgagccggccagggccggcucccccaccguggagcccuucaagagcuacuucgcccggggguugcucagcauggacuccggcuacuucagcgccaagugcuauccccgcgcguccaacagugggcugcagcugaucaacaucacgcaacacuccgcccggaucaccgacaccccgggccccaagaucacuaaccucaagacgaucaacugcaucaaccugaaggccagcaccuucaaggagcaccgcgagauagagauuaacguccuguuaccucagguggccgugaaucuguccagcugccacguccugaucaagagucaugugugcgauuacucacucgacaucgacggcccggugagacugccgcgcauccaccacgaggggaccuuuauacccggcaccuacaagauagucauagacaagaagaacaagcagaacgaccgaugcacgaucgugaccaacugcguuaucaaggggcgcgagauccggaagggccaguccguccugagacaguauaagaccgagaucaagaucgggaaggccagcuccggcagucggcgccuucuguccgaggagagcggcgacgacugcaucucccggacccagcugcuccgcacggaaaccgcggagauccacagcgacucguacgggggccccggggauaagauuaccaucugcaacggcuccaccguugucgaccagcggcuggggagcgagcuaggcugcuacacgaucaaucgcguaaaauccuucaagcugugcgagaacagcgccaccggcaagucuugcgagauagacaguacccccgugaagugccgccagggguuuugccucaagaucacccaggagggccggggccacgucaagcugucgcgcggcucagagguggugcucgacgcaugcgacaguagcugcgagaucaugauccccaagggcacgggggacauccucgucgacugcucgggcgggcagcagcacuuccugaaggacaaccugaucgacuuaggcugccccaacaucccccugcuggggaagauggccaucuacaucugccggaugagcaaccaccccaagaccaccaugguguuccucuucugguucuccuucggcuacgugaucacgugcauccuguguaaggucaucuucuaccugcucaucguugugggcacgcuugggaagaaguucaagcaguaccgcgagcugaagccgcagacuugcaccaucugcgagaccacccccguuaacgccaucgacgcggagaugcacgaccucaacugcucauacaacaucugcccauacugcgccucccgacugacgucggacggccuggcccgccaugugaugcagugccccaagcggaaggagaagaucgaggagaccgagcucuaccugaacuuggagcggauccccugggugguccggaagcuccuccagguguccgagagcaccggcguggcccugaagcgcaguagcuggcucgucgugcugcuggugcuccugaccgucagccugucccccgugcagagcgcgcccaucggccacgggaagacgguugagaccuaccagauccgggagggcuacaccuccgucugccucuucgugcugggcagcauccuguucaucgucuccugccucaugaaggggcuggucgacagcgacggcaacuccuucuucccuggccugagcauuugcaagacgugcuccaucggcaguauuaacggguucgagaucgagucccacaagugcuacugcagccucuucugcugcccuuacugccgccacugcuccacggaccgggagauccacaaguuacaccugagcaucugcaaaaagcgcaagacuggcuccaacgugaugcucgccgugugcaagcggaugugcuuccgagccaccguugaggugagcaacaaggcccugcucauccgguccaucaucaacaccacguucguggucugcauccucauccuggccgugugcguggucagcaccuccgcgguggagauggagagccugcccgccggcaccugggagcgcgaggaggacuugaucaacuucugccaccaagagugccagguaaccgagacggagugccugugccccuacgaggcccuaguccuccggaaaccgcuguuccuggacagcaucaucaagggaaugaagaaccuccugaacuccaccagccuggagacgucccucagcaucgaggcgcccuggggcgccaucaacgugcaguccacuuucaagcccacgaugagcgcggcuaauauagcccuguccuggagcuccguggagcaccgcgggaacaagauccuggucucuggccgauccgagagcauuaugaagcucgaggagcgaaccgguauuuccugggaccugggcguggaggacgccagcgaguccaagcugcucacugugagcgucauggaccugucccagauguacagccccguguucgaguaccugaguggcgaccgccagguggaggaguggccgaaggcaacgugcacgggggacugccccgagcggugcggaugcaccagcuccacgugccuacacaaggaguggccccacucccgcaacuggcggugcaacccuaccuggugcuggggcgugggcacaggcugcacgugcugcggacuggacgugaaggaccuguucaccgacuacauguucguuaaguggaaagucgaguacauaaagaccgaggugaucguuuguguggagcucacgagccaggagcgccagugcucccugaucgaggcgggcacccgguucaaucuggguccggugaccauaacccucagcgaacccaggaacauccagcagaagcugccgccugagaucgucacgcugcacccacggaucgaggagggcuuuuucgacuuaaugcacgugcagaaggugcuguccgccagcaccgucugcaaacugcagucgugcacccauggggugcccggcgaccuccaaguguaccacaucggcaaccuccugaagggggacaaggucaacggucaccucauccacaagaucgagccccacuucaacaccagcuggauguccugggacggcugcgaccuggacuacuacugcaacaugggcgacuggcccagcugcuccuacaccggggugacgcagcacaaccacgccgcguucgugaacaugcugagcaucgagaccgauuacaccaagaacuuccacuuccacuccaagcgcgucaccgcccacggcgacacgccgcaacucgaccucaaggcccgucccaccuacggcgccggggagaucaccgugcugguggaagucgccgacauggaacuccauaccaagaagaucgagaucagcggccugaaguucgcgucccugacgugcaccgguugcuacgcgugcagcucgggcaucagcugcaaggugcgaauccacguugacgagcccgacgagcucaccguccaugugaaguccgaagaucccgacaucguggccgccagcagcagucugauggcccggaaacuggaguucgggaccgauagcaccuucaaggccuucuccgcgaugccgaaaacuagccucuguuucuacauugucgagcgcgaguacugcaaguccugcagcaaggaggacacccagaagugcgugaacacaaagcuggagcagccccaguccauccuaauagagcacaagggcacgaucaucggcaagcagaacgacacgugcaccgccaaagccagcugcuggcucgaguccgucaagagcuucuucuacggguuaaagaacaugcuuuccggcaucuucgggaacgucuucaucgggaucuuccuguuccucgcccccuucgcccugcugauccucuucuucauguucggcuggcggauccuguucugcuucaaguguugccgccggacccgcgggcuguucaaguaccggcaccucaaagacgacgaggagacgggcuaccgcaagaucauugagcggcugaacaacaagaaggggaagaacaagcugcucgacggcgagcggcuggcggaccgcaagaucgcugagcuguucagcacuaagacccacgugggguaa

SEQ ID NO: 15320 - RNA, 5052 nt, Artificial Sequence
  derived and/or modified CDS sequence (opt11) from CCHFV(UCCR4405)__KY484029.1__GP
augcacgccuugcucgugugcuucauccuguaccugcagcucagcggucucggcggcgcccaccgccaguccaacgcgaccgagcacaacggaaccaacacgaccaccgcccccggcaccagucaguccccaaagccgcccgucagcacgacccugccccacacccccgaagccuccaccaucaagcugacgacccccaccagcgagaccgagggguccggcgagacgaccccgccgcccaacacgacccagggccuaccccugcccgggacgacccccgagcggagcgccaccaccgcaaccuccacuagcuccacagacgauaugaacagcaccacgcagaugacagacaacacccccaccucaacugugagcaucggccucuccagcucccccucuaugcccaguaccagccaagggauccacuaccccguccgcucccugcuguccgucagcaguccgaaaaccgcgaccacgcccacccccaugagcccgggcgagguguccccggagaccagcucgcagcacagcgccaugucccggauccccacgcucuacacggccacccaggugucuaccgagaacaccaaccgcucaaucccccggcaaagcgaguccucgguccagcccgccacccaguccccgaucacgagccccgcgcaaaccauccugcugauguccgccgccccgaccgccauccaggacaugcaccccucuccgaagaaccgcuccaagcggaaucucgagguggagaucaucuugacccugagccaggggcucaagaaguauuauggaaagauccugaagcugcuacaccugacgcuagaggaggacaccgaaggccuccuggaguggugcaagcgcaaccuggggucgaacugcgaugacgacuucuuccagaagcggaucgaggaguucuuuaucaccggcgagggguacuuuaacgaggugcuccaguucaaaacccccuccacgcugagccccaccgagccaucccacguccgccugcccacugccgagcccuuuaaaagcuacuucgcgaagggauuccuguccaucgacagcggcuauuucuccgccaagugcuacccccggagcuccaccuccgggcugcagcugaucaacgugacgcagcacccggcccgcaucgccgagacccccggccccaagaccacuucccucaaaacaaucaacugcaucaaccugcgggccagcguguucaaggagcaccgcgaggucgagaucaacgugcugcucccccagaucgcgguuaaccuguccaacugccacguggugaucaacagccacgugugcgauuacucccuggacaccgacggcccgguccggcugccccgcauccaccacgaaggcgccuucauccccgggaccuacaagaucgugauagacaagaagaacaagcugaacgaccggugcagccuggugaccaauugcgucaucaagggccgcgaggugcggaaaggccagagcguacucaggcaguacaagacggagaucaagaucgggaaggccagcaccggcucccggaagcugcuguccgaggaacccggggacgacugcaucagccgcacucagcuucugaagaccgaaacugccgaaauccacgacgacaacuacggagggcccggcgacaagaucaccaucugcaacggcuccaccaucgucgaccagcgcuuagggagcgagcucggcugcuacaccaucaaccgggugaaguccuucaagcugugcgagaacagcgccaccgggaagaccugcgagaucgacucgacccccgucaagugccgccagggcuucugccugaagaucacccaggaggggcggggccacgugaagcugagccgcggcuccgaggugguccucgacgcgugcgacagcuccugcgaggucaugauccccaaggggacgggcgacauccuggucgacugcagcgggggccagcaacacuuccugaaggacaaccuaaucgaccugggcugcccccacaucccgcugcucgggaagauggccaucuacaucugccggauguccaaccacccccgcaccaccauggccuuucuguucugguucagcuucgguuacgucaucacauguaucuucugcaaggccuuauucuacucccucaucaucauugggacccuggguaagaaaaucaagcaguacagagagcugaagccccagaccugcacgaucugugagaccgcccccgugaaugcgaucgacgcagagaugcacgaucucaagugcagcuacaacaucugcccguacugcgccucccgccugaccucggacgggcuggcccggcacgugacgcaguguccuaagcgcaaggagaaggucgaggagaccgaacucuaccugaaccuggagcggauccccuggaucgugcgcaagcuccuccagguguccgagagcaccggcgucgcgcugaagcgguccuccuggcucaucgugcugcuggugcuccugaccgucucacugucccccgugcagagcgcucccgugggccacgggaagacaaucgagaccuaccagacccgcgagggcuucaccuccaucugccucuuuaugcuggggagcauccuguucaucgucuccugccuagugaagggccugguggacagcgucuccgacagcuucuuucccgggcuuucggugugcaagacguguagcauaggcuccaucaauggcuucgagaucgagagccacaagugcuacugcucccucuucugcugccccuacugccggcacuacagcgcagaucgcgagauacaccagcugcacuuauccaucugcaagaaacggaagaccgggaguaacgugaugcucgcagucugcaagcgcaugugcuucaaggccaccaucgaggcgucccggcgcgcacuguuaauacgcagcaucaucaacaccacguucgugaucugcauccucauccuggccaucuguguggucagcaccagcgccgucgaaauggagaaccugccggccggcaccugggagcgggaggaggaccucaccaacuucugucaccaggagugucaggugacggagaccgagugcuugugcccguacgaggcgcuuguccuccgcaaaccccuguuccuggacucgaccgugaaggggaugaagaaccuccugaacuccaccagccuggagaccucccucucuaucgaggcccccuggggcgcuaucaacgugcaguccaccuucaagccaacagucagcaccgccaacaucgcauuaucauggucuuccguggagcaccgcgggaacaagauccuggugacgggacgcagcgaguccaucaugaagcuggaggagcggaccggcgucagcugggaccuggggguagaggacgcguccgagagcaagcugcucaccguuuccaucauggaccugagccagauguacucccccgucuucgaguaccugagcggcgaccgccagguagaggaguggcccaaggcgaccugcacgggggacugccccgagcggugcggcugcaccagcagcacgugccuccauaaggaguggccgcacucccgcaacuggcggugcaaccccaccuggugcuggggcguggggaccggcugcacgugcugcgggguugacgugaaggaccuguucaccgaccacauguucgugaaguggaaggucgaguacaucaagaccgaggccaucguuugcguggagcugaccucccaggagcgccaaugcagccucaucgaggcaggcaccagauucaaccuggggcccgucaccaucacucuguccgagccccgcaacauccagcaaaagcucccgcccgagaucaucacccugcaccccaaaaucgaggagggcuucuucgaccugaugcacgugcagaaggugcucagcgccuccacggucugcaagcugcagagcugcacccacggcauccccggggaccugcagaucuaucacaucggcaaccuccugaagggggaccgagugaacggccaccuaauccacaaaaucgagccgcacuucaacaccuccuggaugagcugggacggaugcgaccucgacuacuacugcaacaugggcaacuggcccaguugcaccuacacgggcgucacccagcacaaccaugccgccuucgugaaccugcugaacaucgagaccgacuacaccaagacguuccacuuccacucgaagagggugacggcccacggggacacgccccagcucgaccugaaggcccgcccgaccuacggcgcgggggagaucaccgucuuaguggagguggccgacauggagcuccacaccaagaaggucgagauuuccggccugaaguucgcgagccuggugugcaccgggugcuacgccugcuccagcggcaucucuugcaaggugcgcauccacgucgacgagcccgacgagcucaccgugcacguaaaguccucggaccccgacgugguggccgcgagcacgagccucauggcccggaagcucgaguucggaaccgacuccaucuucaaggccuucagcgcgaugcccaagaccucccucugcuucuacaucguggagcgcgaguacugcaagagcugcuccgaggacgacaccaagaagugcgucgacacgaagcuggaacaaccccagagcauacucaucgagcacaaggggaccaucaucggcaagcagaacgauacgugcaccgccaaggcguccugcuggcucgagagcgugaaguccuucuucuacgggcugaagaacaugcugggcaguguguuugggaacuucuucgucggcauccuccuauuccuggccccguucgugcuacucgugcuauucuucauguucggcuggaagauccuguucugcuucaagugcugccggcgcacccggggccucuucaaguaccgccaccugaaggacgacgaggagaccggguaccgccggauuaucgaacgccugaacuccaagaaggggaagaaccggcuccuggacggcgagcgccuggccgaucggaagaucgccgagcuguucagcacuaagacccacaucggcuga

SEQ ID NO: 15321 - RNA, 5052 nt, Artificial Sequence
  derived and/or modified CDS sequence (opt11) from CCHFV(Drosdov)__DQ211630.1__GP
augcacgcccugcucguguguuucauccuguaccugcagcucuccgggcucgggggcgcgcaccgacaguccaacgcgacugagcauaacgggaccaacacgaccaccgcccccggcaccagccaguccccgaagccgccagucagcacgacccugccccacaccccagaagccuccaccaucaagcugacgacccccaccagcgagaccgagggguccggagagacgaccccgccgcccaacacuacccagggccugccccuacccgggacgacccccgaacgguccgccaccacugcuacgucuaccagcuccaccgacgacaugaacagcaccacacagaugaccgacaacacccccaccuccacggugagcaucggccucuccagcuccccuagcaugcccuccaccagccaagggauccacuaccccguacgcagccugcugucugucagcuccccgaagaccgcgaccacgcccacccccaugagccccggcgagguguccccggagacgagcucccagcacagcgccaugucccggauccccacccucuacacggccacccaggugagcaccgagaacaccaaucgcuccaucccccggcagagugaauccucaguccagcccgccacucagaguccgaucacgagccccgcgcagaccauccugcugaugucagccgcccccaccgccauccaggacaugcaccccagcccgaagaaccgcuccaagcggaaccucgaaguggagaucauccugaccuuaagccaggggcucaagaaguacuacggcaaaauacugaaacugcuccaccugacgcuggaggaggacaccgagggccuccuggaguggugcaagcgcaaccuggggagcaacugcgacgacgacuucuuccagaagcggauagaagaguucuucaucaccggcgagggauacuucaaugaggugcuccaguucaagacccccuccacguuaagccccaccgagcccucccacguccgccugcccaccgccgagcccuucaagagcuacuucgcgaagggcuuccucucuaucgacagcggcuacuucuccgccaagugcuacccccggagcuccaccagcgggcugcagcugaucaacgugacgcagcacccggcccgcaucgccgagacccccggccccaagaccaccucccucaagacgaucaacugcaucaaccugcgugcuagcguguucaaggagcaccgcgaggucgagaucaacguacugcucccccaaaucgcggugaaccuguccaacugucacgucgugaucaacagccacgugugcgacuacucgcuggacaccgacgggccgguccggcucccccguauccaccacgagggcgccuuuauccccgggaccuacaagaucgugaucgacaagaagaacaagcugaacgaccggugcagcuuggugaccaacugugucaucaagggccgagaggugcggaaaggccaguccgugcuccgccaguauaagacugagaucaagaucggaaaggcuagcaccggcagccggaagcugcuguccgaggagcccggggaugacugcaucucgcgcacccagcuuuuaaagaccgagacggccgagauccacgacgacaauuacggcgggccgggggacaagaucaccaucugcaacggcuccaccaucgucgaccagagacugggcagcgagcucgggugcuacaccaucaaccgggugaagucauucaagcugugugaaaacagcgccacggggaagaccugcgaaaucgacuccacccccgucaagugcaggcagggcuucugcuuaaagaucacccaggaggggcgcgggcacguuaagcugagccgcggcuccgaggugguccucgacgcgugugacagcuccugugaggugaugauacccaaggggacgggcgacauccugguggacugcagcgggggccagcagcacuuccugaaggacaaccucaucgaucuaggcugcccccacaucccgcugcucgggaagauggccauuuacauuugccggauguccaaccacccccgcaccaccauggccuuccuguucugguucagcuucggcuacgucaucacgugcaucuuuugcaaggcgcuguucuacucccucaucaucaucgggacccuggguaagaagaucaagcaguaccgggagcugaagccccagaccugcaccaucugcgagaccgcccccgugaacgcaaucgacgccgagaugcacgaccucaaaugcagcuacaacaucugcccguacugcgccucccgccugaccagcgacgggcuggcgcggcacgugacgcagugcccgaagcgcaaggagaaggucgaagagaccgagcucuaccugaaccuggagcgaauccccuggaucgugcgaaagcuccuucagguguccgagagcaccggcgucgcgcugaagcggagcuccuggcugaucgugcugcuggugcuccugaccgucagcuugucccccgugcagagcgcccccgugggccacgggaagacgaucgagacuuaccagacccgcgagggcuucaccuccaucugccucuucaugcuggggucgauccuguuuaucgucuccugcuuagugaagggcuugguggacagcgucuccgacagcuucuuccccgggcuguccgugugcaagacgugcagcaucggcuccauuaacggcuucgagaucgaaagccacaagugcuacugcucccucuucugcugccccuacugucggcacuacagcgccgaccgcgagauccaccagcugcaccuguccaucugcaagaagcggaagaccgggagcaacgugaugcucgccgucugcaagcgcaugugcuuuaaggccaccaucgaagcgucccgucgcgcccugcugauccgcagcaucaucaacaccacauucgugauaugcauccucauccuggcgaucugcguggucagcacauccgccguggagauggagaaccucccggccggcaccugggagcgggaggaggaccucaccaacuuuugccaccaggagugccaggugacggaaaccgagugccugugccccuacgaggcgcugguccucaggaagccccuguuccuggacagcaccgugaaggggaugaagaaccuucugaacuccaccagccuggaaacuucccucagcaucgaggccccguggggcgccaucaacgugcaauccaccuuuaagccgaccguuucgaccgccaauaucgcccuguccuggucauccguggagcaccgugggaacaagauccuggugacgggccgcucggaauccaucaugaagcuggaggaacggacuggcgucagcugggaccugggggucgaggacgccuccgagucaaagcugcucaccguguccaucauggaccugucacagauguacucccccgucuuugaguaccugagcggcgacagacagguggaggaauggcccaaggcgaccugcacgggggacugccccgaacggugcgggugcaccagcagcacgugccuccauaaggaguggccacacucccgcaacuggcggugcaaccccaccuggugcuggggcguggggaccggcugcacgugcugcggcgucgacgugaaggaccuguucaccgaccacauguucgugaaguggaaggucgaauacaugaagaccgaggcuauugugugcgucgagcugacgucacaggagcgccagugcagccucaucgaggccgguacccgguucaaccuggggcccguaaccaucacccuguccgagccccgcaacauccagcagaagcucccgcccgagaucaucacccugcaccccaagaucgaggagggcuucuucgauuuaaugcacgugcagaaggugcucagcgccuccacggucugcaagcugcagagcugcacccacggcauccccggggaccugcagaucuaccacaucggcaaccuccugaagggggaccgggugaacggccaccugauccacaagaucgagccgcacuuuaacaccuccuggaugagcugggacgggugugaccucgacuacuacugcaacauggggaacuggcccuccugcaccuacacgggcgucacccaacauaaccacgccgccuucgugaaccuguugaacaucgagacugauuauaccaagacguuccacuuccauagcaagcgcgugaccgcccacggggauacgccccagcucgacuugaaggcccggcccaccuacggggcgggagaaaucaccguccugguggagguggccgauauggagcuccacaccaagaaggucgagaucuccggccugaaguucgccagccuggugugcaccgggugcuacgccugcuccagcggcaucucaugcaagguccgcauccacgucgacgagccagacgagcucaccgugcacgucaagaguuccgaccccgacgugguggccgcgagcacgagccugauggcacggaagcuggaguucggcaccgacuccaucuucaaggccuucagcgccaugcccaagaccucccucugcuucuacauuguggaacgcgaguacugcaagucuugcuccgaggaugacaccaagaagugcgucgauacgaagcuggagcagccccagagcauccugaucgagcacaaagggaccaucaucggcaagcagaacgacacgugcacugccaaggcguccugcuggcucgagagcgugaaguccuucuucuacgggcugaagaacaugcugggcagcguguucgggaacuucuucgucggcaucuugcuguucuuggcgccguucgugcugcucgugcuguucuucauguucggcuggaaaauccuguucugcuucaagugcugccggcgcacccggggccuguucaaguaccgccaccugaaggacgacgaggagaccggguaucgccggaucaucgagcgccugaacuccaaaaagggcaagaaccggcuccuggacggcgagaggcuggccgaccggaagaucgccgagcuguucagcaccaagacccacaucggauag

SEQ ID NO: 15322 - RNA, 5052 nt, Artificial Sequence
  derived and/or modified CDS sequence (opt11) from CCHFV(44-ST-2010)__KR814859.1__GP
augcacacccuguuagugugcuucauccucuaucugcagcucagcggccucgggggagcccacggacaguccaaugcgaccgagcacaacggcacgaacaccacaaccguccccgggacgagccagagcccgaagcccccggcgagcaccacccugccccacaccccggaguccagcacugugaagcugaccacacccaccagcgagacggagggcagcggcgagaccacgcccccgcccaacaccacgcagggccugccuccacccggcaccaccccugagcgccccgccacuacagccaccuccaugagcuccaccgacaacaugaauagcaccacccaggugaccgauaacacccccaccagcacggucucaauaucccccagcuccagcccuuccaugcccagcaccucgcaggggauccacuauccugugcggucccugcucagcgucuccagucccaagaccgucaccacgccgaccccaaugucccccggcgagaugagccccgagaccuccagccagcacuccgccaugagccgcaucccgacccuguacacggccacccagguguccaccgagaacaccaaucggagcacuccccgacaguccgagagcuccgcgcagcccgccacgcagagccccaccaccuccccgacccagacuauccuucucaugagcgccgcacccaaggcgauccaggauaugcaccccuccccgaccaaccgaagcaagcgcaacuuggagguggagaucauccugacccucagccaggggcuuaagaaguacuacgguaagauccugaaacuccugcaccugacccucgaggaggacacggagggcuuacuggaguggugcaagcgaaacuuaggguccaacugcgacgacgacuucuuccaaaaacgcaucgaggaguucuucaucaccggcgagggguacuucaacgagguccugcaguucaagacucuaagcacgcucucccccacggagcccagccacgugcggcugcccaccgcagagccguucaagucauacuucgccaagggauuccugagcaucgacuccggcuacuucagcgccaagugcuacccgcgcuccagcaccuccgggcuccagcugaucaacgugacccagcaucccgcccggaucgcugagacgcccggaccgaagaccaccagccugaagaccaucaacugcaucaaccuccgcgccuccgucuucaaggagcaccgggagguggagaucaacguucugcugccucaaaucgccguuaaccuuucaaacugccacguggucaucaacucccacguaugugacuacagccuggacacggacgggcccgugcgcuuaccccggauccaccacgagggcaccuucaucccggggaccuacaagaucgugaucgacaagaagaauaagcucaacgaccgcugcucccuggugaccaacugcgucauaaagggccgggaggugcgcaagggccagagcguccugcggcaauacaagacggagaucaagaucgguaaggccuccaccggcucccgcaaacuccugagcgaggagccuggcgacgacugcauuucacggacccagcugcucaagacggaaacggccgagauccacgacgacaacuacggcgggcccggcgauaagaucaccaucugcaacggcagcaccaucguggaccagcgccucggcuccgagcugggcugcuacaccaucaaccgagucaagagcuucaaacucugcgaaaacuccgccacggguaagaccugcgaaaucgacagcaccccuguaaagugccggcagggcuuuugccuaaagaucacccaggaggggcgcggccacgugaagcugucccggggaucugaggugguguuggacgccugcgacuccagcugcgagaucaugaucccgaaaggaacgggcgacauccucguggacuguuccgggggucagcagcauuuccugaaggacaaccugaucgaccucgguugcccccacaucccccugcugggaaagauggcaaucuacauaugccgcaugagcaaucacccccggacuaccauggcguuucuccuuugguucuccuucggcuacguuauuaccugcaucuucuguaaggcccuguucuacagccucaucaucaucgggacccugggcaagaagaucaagcaguaccgcgagcugaagccgcagaccugcacuaucugcgagacugcgcccgugaacgccaucgacgccgagaugcacgaccucaacugcuccuacaacaucugcccauauugcgccucacggcugaccagugauggacuggcccgccacgucacgcagugccccaaacggaaggagaaagucgaggagaccgagcucuaccugaaccuggagcgcaucccuuggaucgugcgaaagcuccugcaggucagcgagagcaccggagucgcacuuaagcgcuccucguggcucaucguucuguuagugcuccugaccgucucccugagccccgugcaguccgcgcccgugggccacggcaagacgaucgagaccuaccaaacgcgggagggguucaccaacaucugccuuuucaugcuggggagcauucuguucaucgucuccugcuuagugaaaggauugguggacucagucuccgacucguucuucccggggcuguccgugugcaagacgugcagcuucggcuccaucaacggcuucgagaucgagagccauaaauguuacugcucccucuucugcugccccuacugcaggcacugcagcgcggaucgggagauccaccagcugcaccuggggaucugcaagaagcggaagaccggcaguaacgugaugcucgccgucugcaagcggaugugcuuuaaggcgaccaucgaagccuccaggcgggcccuccugauccgcuccaucaucaacacuacguucguuauuugcauccucaccuuggcuaucugcguggucagcaccucggccguggagauggagaaccugccggccgggaccugggagcgcgaagaagaccucacgaacuucugccaccaggagugccaaguguccgaaacggagugccugugccccuacgaggccuuaguccuucggaaaccgcuguuccuggacucuauagugaagggcaugaagaaccuccugaacucaacaagccuggaaaccucccucagcaucgaggcccccuggggcgccaucaacgugcaguccacguuuaagcccaccgucagcaccgccaacaucgcgcugucauggagcuccguggagcaccgcgggaacaagauccuggugaccggccggagcgagagcaucaugaagcucgaggagcgcacggggguuagcugggaccugggcguggaggacgccuccgagagcaaacuauuaacuguuuccaucauggaccugagccagauguacucccccgucuucgaguaccuuagcggggaccgccagguggaggaguggccgaaggcgaccugcacuggcgacugccccgaacggugcgggugcaccagcuccacgugucuccauaaggaguggccucauagccggaacuggcgcugcaaccccaccuggugcuggggcgugggcaccgggugcacgugcugcggcgucgacgugaaagaccuguucaccgaccacauguuuaucaaguggaagguugaguacaucaagacggaggccaucgucugcguggagcucaccucccaggagcggcagugcagccucaucgaggccgggacccgcuucaaccucggcccgguuacgauaacccuguccgagcccagaaacauacagcagaagcucccgcccgagaucaucacccugcaccccaagaucgaggaggguuucuucgaccugaugcacguccagaagguccucagcgccuccaccgugugcaagcugcagagcugcacgcacgggauccccggcgaucugcagaucuaccacauugggaaccuccugaaaggcgaccgccugaacgggcaccucauucauaagaucgagccccacuucaacacauccuggaugagcugggacggcugcgaccuggacuacuacugcaacaugggcgauuggcccuccugcaccuauaccggggucacgcagcacaaccacgccgccuucgugaaccugcucaauaucgagaccgacuauaccaagacauuccacuuccauagcaagcgggucacggcccacggcgacaccccgcagcuggaccugaaggcgaggccuaccuacggggccggcgagauuacggugcucguggaggucgccgacauggaacugcacacaaagaagguggagaucuccggucugaaauucgccagccucgcauguacuggcugcuacgcgugcucaagcggcaucuccugcaaggugcggauccacgucgacgagcccgacgagcugacggugcacgugaagucaucagaccccgacgucgucgccgccagcaccagccugauggcgcgcaaacucgaguucgggaccgacuccaccuucaaagccuucagcgcaaugccgaagaccucccugugcuucuacaucguggagcgggaguacugcaagagcuguuccgaggacgacaccaagaagugcgucgacacgaagcuggaccaaccccagagcauccucaucgaacauaagggcaccauuaucggaaagcagaacgacaccuguaccgccaaggccucguguuggcuggagucagucaagagcuucuucuacggccugaagaauaugcucggcagcguguucggcaacuucuucgugggcauccugcuguuccuggcccccuucgugcuccuggugcuguucuucaugugcggguggaagauccucuucugcuucaagugcugccgccggacgcgcggccuguucaaguaccggcaccuaaaggacgaugaggagaccggguaccgccgcaucaucgagcggcucaauuccaagaaggguaagaaccgccugcuggauggagagcggcuagcugaccgcaagaucgcggagcuguucagcaccaagucccacaucggcuag

SEQ ID NO: 15323 - RNA, 5052 nt, Artificial Sequence
  derived and/or modified CDS sequence (opt11) from CCHFV(3756-ST-2007)__KR814866.1__GP
augcacacccugcucgugugcuucauccuguaccugcagcucagcggccucgggggcgcccacgggcaguccaacgccaccgagcacaaccgcacgaacaccaccaccguccccggcacgagccaguccccgaaaccgcccgcgagcaccacccugccccacacccccgaguccagcacggugaagcugaccacccccaccuccgagacggaggggagcggcgagaccaccccgccgcccaacaccacgcagggccugccccugcccgggaccacccccgagcgguccgccacaacggccaccagcaccuccagcaccgacaacaugaacacgaccacccagguaacggacaacacgcccaccuccaccgucagcaucucccccagcuccagccccuccaugcccagcaccagccagggcauccacuacccggugcgcucccuccuuagcgucuccagccccaagacggucaccacccccacccccauguccccgggggagaugagccccgagacguccagccagcacuccgccaugagccggauccccacccuguacaccgccacccagguguccaccgagaacaucaaccgcagcacgccccggcaguccgagucauccgugcagccggcgacccagagccccaucaccucccccgcccaaaccauccuccugaugagcgccgcccccaaggcgauucaggacaugcacccuucccccacgaaucgcagcaagcguaaccuggaggucgagaucauccucacccugagccagggccugaagaaguacuacgggaagauccucaagcugcugcaccucacccuggaggaggacacagagggccugcucgaguggugcaagcguaaccugggcuccaacugcgacgacgacuucuuccagaagcggaucgaggaguucuucauaacgggggagggcuacuucaacgaggugcugcaguucaagacgcucucaacccugucccccacagagccgagccacgugcgccugcccacggccgagcccuucaaguccuacuucgccaagggguuccucagcaucgacuccggcuacuucagcgccaaguguuacccccgguccagcaccuccggccugcagcugaucaacgucacccagcacccggcccggaucgcggagacccccgggcccaagacgaccagccucaagaccaucaacugcaucaaccugcgggccucuguguucaaggagcacagagagguggagaucaacguccugcuuccccagaucgccgugaaccugagcaacugccacguggucaucaacucccacgugugcgacuacagccuggacacagacggcccggugagacucccccgcauccaccacgaggggacguucauccccggcaccuacaagaucgucaucgaccggaagaacaagcugaacgaccgcugcucccugguuacaaacugcgugaucaaggggcgggagguccgcaagggccagagcgugcuccggcaguacaagaccgagaucaagaucggcaaggccagcacggguucgagaaagcugcugagcgaggagcccggcgacgacugcaucucccgcacccagcuccuaaagaccgagaccgcagagauccacgacgacaacuacgggggcccgggggacaagaucacgaucugcaacggcagcaccaucgucgaccagcggcugggcuccgagcucggguguuacaccaucaaccgaguuaagagcuucaagcugugcgagaacuccgcaaccggcaagacgugcgagaucgacagcaccccggugaagugucggcagggguucugccugaagaucacccaggagggccgcgggcaugucaagcugucccggggcagcgagguggugcucgacgccugcgacuccaguugcgagaucaugauccccaagggcaccggggacauccuggucgacugcuccggcgggcagcagcacuuccugaaggacaaccucaucgaccugggcugcccccacaucccguuacucggcaagauggcgaucuacaucugccgcaugagcaaccauccacggaccaccauggccuuccuguucugguucuccuucggguacgugauuaccugcaucuucugcaaagcccuguucuacagccucaucaucaucggcacccuggggaagaaaaucaagcaguaccgcgagcugaagccccagaccugcacgaucugcgagaccgcgcccgugaacgccaucgacgccgagaugcacgaccucaacugcuccuacaacaucuguccguacugcgccagccgacuuaccuccgacggccuggcccgccacgucacccagugccccaagcggaaggagaagguggaggagacggagcucuaccugaaccuggagcgcauccccuggaucgugcggaaacuucugcaggucagcgagagcaccgggguggcguugaagagguccagcuggcucaucguucugcugguccuccugaccgugucccugagcccagugcaguccgcuccggucggccacggcaagaccaucgagacguaccagacccgggagggguucaccagcaucugccucuucaugcugggcuccauccuguucaucgugagcugccuggugaaggggcuggucgacuccgugagcgacuccuucuuccccggccugagcgugugcaagacaugcuccaucgggagcaucaacggcuucgagaucgagucccacaagugcuacuguagccucuucugcugccccuacugccgccacugcuccgccgaccgggagauccaucagcugcaccugagcaucugcaagaagcgcaagacaggcuccaacgucaugcucgccguguguaaacggauguguuucaaggcgaccaucgaggccagccgccgcgcccugcugauccggagcaucaucaacaccaccuucgugaucugcauccugacgcuggccaucugugucguguccaccagcgccguggagauggaggaccugccggcggggaccugggagcgcgaggaggaccucaccaacuucugccaccaggagugccaggucacggaaaccgaaugccugugucccuacgaggcccuggugcuccggaaaccccuguuccuggacuccaucgugaagggcaugaagaaccuccuaaacagcaccucccuggagaccagccucuccaucgaggcccccuggggcgccaucaacguccagagcacguucaagccgaccguguccaccgccaacaucgcgcugagcugguccagcguggagcacagagggaacaagauccuggucaccgggcgguccgagagcaucaugaagcucgaggagcgcacgggcgugagcugggaccugggcguggaggacgccagcgaguccaagcugcucaccgucagcaucauggaccugagccagauguacagccccguguucgaguaccugagcggggaccgccagguggaggaguggcccaaggcgaccugcaccggcgacugccccgagcggugcgggugcacguccuccaccugucuccacaaggaguggccucacagccggaacuggcgcugcaacccuaccuggugcuggggcgucgggaccggcugcacgugcugcggcguggacgugaaggaccuguucaccgaccacauguucaucaaguggaaggucgaguacaucaagacugaggccaucgugugcguggagcugacgagccaggagcggcagugcucccucaucgaggccgggacccgcuucaaccugggccccgucacgaucacccugagcgagccccggaacauccagcagaagcucccgcccgagaucaucacccugcaccccaagaucgaggagggguucuucgaccugaugcacgugcagaaggugcucuccgccagcaccgucugcaagcugcaguccuguacgcacggcauccccggcgaccugcagaucuaccacaucgggaaccuccugaagggcgaccgcgugaacgggcaccugauccacaagauagagccgcacuucaacaccagcuggauguccugggacggcugcgaccucgacuauuacugcaacaugggggacuggcccucgugcaccuacaccggcgucacgcagcacaaccacgccgccuucgugaaccugcugaacaucgagaccgacuacacuaagaccuuccacuuccacuccaagcgggugacggcccacggcgacaccccacagcucgaccugaaggcacgccccaccuacggggccggcgagaucaccguccugguggagguggccgacauggagcuccacacgaagaaggucgagaucagcggccugaaguucgccucccugaccugcaccggcugcuacgccugcucauccgggaucagcugcaaggugcggauccacguugacgagccggacgagcucaccguccacgugaaguccagcgaccccgacguggucgcggccagcacgucccugauggcccgcaagcuggaguucggcaccgacagcaccuucaaggccuucuccgccaugcccaagaccagccucugcuucuacaucguggagagagaguacugcaaguccugcagcgaggacgacacgaagaagugcguggacaccaagcuggaacagccccaguccauccugaucgagcacaagggcaccaucauugggaagcagaacgacacgugcaccgcgaaggccagcugcuggcucgaguccgucaagagcuucuucuacggccugaagaacaugcugggguccguguucggcagcuucuucguggggauccuccuguuccugaccccguucguccugcucgugcuguucuucauguuuggcuggaagauacuguucugcuucaagugcugccgccggacccgcggccucuucaaguaccgccaccucaaggacgacgaggagaccggguaccggcgcaucaucgagcggcugaacuccaagaagggcaagaaccgccuacuggacggggagcggcuggccgaccgcaagaucgccgaacucuucagcacgaagacucacaucggcuaa

SEQ ID NO: 15324 - RNA, 5052 nt, Artificial Sequence
  derived and/or modified CDS sequence (opt11) from CCHFV(47-ST-2013)__KR814861.1__GP
augcacacccugcuggccugcuucauccuguaccugcagcucagcggccucggcggggcccacgggcaguccaacgcgaccgagcacaacgggaccaacacgaccacagugcccgggaccagccaguccccgaagccgcccgccagcaccacccugccccacacccccgaguccagcaccgugaagcucaccaccccgacguccgagaccgagggcagcggcgagaccaccccgccgcccaacaccacccaggggcugcccccgcccggaaccacccccgagcguuccgccaccaccgccaccagcaccuccagcaccgacaacaugaacuccacgacccagaugaccgggaacacccccacgcccaccgucaacaugagccccuccagcuccccgagcaugcccuccaccagccagggcauccacuacccggugcggagccugcucuccguccccagccccaagaccgccacgacccccacccccgugucccccggcgagaugagucccgagaccuccagccaacacuccgcgacgagccgcauccccaccuuauacaccgccacccagguguccaccgagaacacgaaccggagcacuccccgccaguccaagagcuccguccagcccgccacccagagccccaucacgccgcccgcccaaacgauccugcucaugucagcggccccgaaggccauccaggacaugcaccccucacccaccaaccggucuaagcgcaaucuggagguggagauaauccugacccucagccagggccugaagaaguacuacggcaagauccugaagcuccugcaccugacccucgaggaggacacggaggggcuguuggaauggugcaagcggaaccucggcuccaacugcgacgacgacuucuuccagaagcgcaucgaggaguuuuucaucaccggggagggcuauuucaacgaggugcugcaguucaagacccugagcacucucagccccacggagccgucccacguccggcugccaaccgccgagcccuucaagagcuacuacgccaagggcuuccugucccucgacagcggguacuucuccgcgaagugcuacccccgcagcuccaccagcggccugcagcugaucaacgugacccagcauccggcccggaucgccgagacgccggggcccaagaccaccucccucaagaccaucaacugcaucaaccugcgcgccagcguguuuaaggagcaccgggaggucgagaucaacgugcugcucccccagaucgccgugaaccuguccaacugccacgucgugaucaacucucacgugugcgacuacccgcucgacacggacggccccguccgccucccccggauccaccacgaggggaccuucauccccggcaccuacaagaucgugaucgacaagaagaacaagcugaacgaccgcugcucccuggugaccaacugcgucaucaagggucgggaggugcgcaaggggcagagcgugcuccggcaauauaagacggagaucaagaucggcaaggcguccaccgggagccgcaagcugcuguccgaggagccgggcgacgacugcaucagccggacccagcuccugaagaccgagacggccgagauccacgacgacaacuacgggggccccggcgacaagaucaccaucugcaaugggagcaccaucgucgaccagcgccugggcuccgagcucgggugcuacaccaucaaccgcgucaaguccuucaagcugugcaagaacuccgccacgggcaagaccugcgagauagacagcacccccguaaagugcagacagggguucugccugaaaaucacccaggagggccgcggacacgugaagcugucccggggcagcgaggugguccucgacgccugcgacuccagcugcgagaucaugauccccaagggcacgggggacauccugguggacugcuccggcggccagcagcacuuccugaaggacaaccucaucgaccuugggugcccgcacaucccccuguuaggcaagauggccaucuacaucugccgcaugagcaaccacccccggaccaccauggcguuccuguucugguucuccuucggguacgugaucacgugcaucuucugcaaggcccuguucuacagccugaucaucaucggcacccuagggaagaagaucaagcaauaccgcgagcugaagccccagacgugcaccaucugcgagaccgccccggucaacgccaucgacgccgagaugcacgaccucaacugcuccuacaacaucugccccuacugcgcgagccggcugaccuccgacggccuggcccgccacgugacgcagugucccaagcguaaggagaagguggaggaaaccgagcucuaccugaaccuggagcgcaucccguggaucguccggaaacuccuccaggugagcgaauccaccggcguggcucugaagcgcagcuccuggcucaucguccugcuggugcuccugaccguuagccugagccccguacaguccgcacccguggggcacggcaagacgaucgagaccuaccagacccgggagggguucaccagcaucugccucuucaugcugggcuccauccuguucaucgugagcugccucgucaaggggcugguggacucuguaagcgacagcuucuuccccggccugagcgucugccgcacgugcuccaucggcagcaucaacggguucgagaucgagucccacaagugcuacugcagccucuucugcugcccguacugccggcacugcuccgcggaccgcgagauccaccagcugcaccugagcaucugcaagaagcggaagaccggcuccaacgugaugcucgccguuugcaagcgcaugugcuucaaggccaccaucgaggccagucggcgcgcccuguucauccgcuccauuaucaauaccacguucgugaccugcauccugacccucgcgaucugcguggugagcaccuccgccgucgagauggaggaccugcccgccgguacgugggagcgggaggaggaucugaccaacuucugccaccaggagugccaggugaccgagaccgagugccucugccccuacgaggcccuggugcugcgcaagccccucuuccuggacagcauagucaagggcaugaagaaccugcucaacucuacgucccuggagaccagccuguccaucgaggccccguggggcgcgaucaacgugcagagcaccuucaagcccaccguguccacggccaacaucgcccucagcugguccagcgucgagcaccggggcaacaagauccuggugaccggccgcuccgagagcaucaugaagcuggaggagcggaccgggguguccugggaccucggcguagaggacgccagcgaguccaagcugcugaccgugagcaucauggacuugucccagauguacagccccguguucgaguaccuguccggcgaccgccagguugaggaguggcccaaggccacgugcaccggagagugcccggagcggugcgggugcaccagcagcacaugccugcacaaggaguggccccacagccgcaacuggcggugcaaccccacuuggugcuggggcgugggcaccgggugcacgugcugcggcguggacgucaaggaccucuucaccgaccauauguucaucaaguggaagguggaguacaucaagaccgaggcgaucgugugcgucgaacugacgagccaggagcgccagugcucccugaucgaggccgggacccgguucaaccucggccccgugaccaucacgcugagcgagccgcgcaacauccaacagaagcugccgcccgagaucaucacgcuccaucccaagaucgaggagggcuucuuugaccugaugcacgugcagaaggucuuauccgccagcaccgugugcaagcuccaguccugcacccacgggauaccgggcgaccugcagaucuaccacaucgggaaccugcucaagggcgaccgggugaacgggcaccugauccacaagaucgagccccacuucaacaccagcuggauguccugggacggcugcgaccuggacuacuacuguaacaugggcgacuggcccagcugcacguacaccggggucacccagcacaaccacgccgcguucgugaaccuccugaacaucgagaccgacuacacgaagaccuuccacuuccacuccaagcgcgucaccgcccacggcgacacgccacagcuggaccucaaggcccggccgaccuacggggccggcgagaucaccgugcugguggaggucgccgacauggagcugcacaccaagaagguggaggugagcgggcucaaguucgcguccuuggccugcaccgguuguuacgccugcagcuccggcaucucuugcaagguccgcauccacguggacgagcccgacgagcugacggugcacgucaaguccagcgaucccgacgugguggccgccuccaccagccucauggcgcggaagcuggaguucgggaccgacuccaccuucaaggccuucagcgccaugcccaagacgagcuuaugcuucuacaucgucgaacgcgaguacugcaaguccugcagcgaggacgacaccaagaagugcguggacaccaagcucgagcagccgcaguccauccugaucgagcacaagggcaccaucaucgggaagcagaacgacacgugcaccgccaaggccagcugcuggcuggagucagucaagagcuucuucuacggacugaagaauaugcuggggagugucuucggcaacuucuuugugggcaucuuguuguucuuggcucccuucgugcugcugguccucuucuucauguucggguggaagauccuguucugcuucaagugcugccggcgcacccggggccuguucaaguacaggcaccucaaggacgacgaggagaccggguaucgccggaucaucgagcgccugaacagcaagaagggcaagaaccggcugcucgacggcgagcgccuugccgaccggaagaucgccgagcuguucucuacgaagacccacaucggguga

SEQ ID NO: 15325 - RNA, 5052 nt, Artificial Sequence
  derived and/or modified CDS sequence (opt11) from CCHFV(1-CR/HU-2015)__KU161584.1__GP
augcacacucugcucguguguuucauccuuuaucuucagcuccugggacuaggcggggcccacgagcaaagcaaugccaccgaccacaaccgcacaaacacuaucaccgcgcccagcaccucgcagaacccgaaaccgccugccuccacuacgccuccccacaccccggagagcuccaccaucaaacuuaucaccagcaccggggaggccgagggguccggggagaccacaccgccccugaacaccacccagggcccauucccgcccgaaaccaccagcgagcaccccgccuccaccgcuaccaacaccagcuccacaaacagcaugaacucaaccacacagaugaccgacaacacccugacgagcacggucuccaccagccucuccauaagcccguccaccccaagcacgucccagggcauccauuaccccguacggucccugcugagcguguccagucccaaaaccgcggccacccccacccccaugucuacgagagagaugagcuccgagaccagcucacaacauagcgccaugucccggacacccacuuuccacacagccacacaggucagcaccgagaacgcgaaccgcucgacgccccgccagagcgaguccagcgcccagcccgccacccaaagccccaugacgagccccgcccaguccaucuuccucgugagcgccgcgccgaccacaauccagaacauccaucccucucccacuaaccgauccaagcggaacuuagaaauggagaucauccugacgcucccccaggggcugaagaaauacuacggcaagaucuuaaagcuccugcaccugacucucgaggaggacaccgaggggcugcuggagugguguaagcgcaacuuaggcucuaacugcgaugacgaguucuuccagaagcguauugaggaguucuucaucaccggggaggguuacuucaacgaggugcugcaguuuaagacgcuguccacccucagcccaaccgagcccucucacgcccggccgcccaccgccgagccguucaaaagcuacuuugccaagggcuuccuguccaucgacaguggguacuucuccgccaagugcuacccccggagcuccacgagcggccugcagcucaucaacaucacccagcacccugcgcggaucgccgagacccccgggccgaagacgacgucccugaagacaaucaacugcaucaaccugagggccagcgucuucaaggagcaccgcgaagucgagauaaacguauugcugccccagauugccgucaaccuguccaacugccauguggugauaaacagccaugucugcgacuacucccucgacacugacggccccguuagacucccccgcauuuaccacgagggcaccuucaucccggggacguacaagaucgugaucgauaagaagaacaagcugaacgaucggugcaccuuggucaccaacugcgugaucaagggccgcgaagugcggaaagggcagagcguccugcgccaguacaaaaccgagaucaagaucgggaaggcuagcacugggucccgcaagcugcucucagaggagcccggagacgacugcaucucccgcacucagcugcugcgcaccgagaccgcggaaauccaugacgacaacuauggcgggcccggcgacaagaucacgaucugcaacgggagcaccaucguggaccagcggcucggcuccgagcuggggugcuacaccauuaacagagucaagucauuuaagcugugcgagaacuccgccaccggcaagacgugcgagaucgacagcacacccgucaagugcagacagggcuuuugccucaagaucacccaggaggggcgcggccacgugaagcugucuagagguucugaggugguccuggacgccugcgacaguagcugugaggugaugauucccaagggcaccggugacauccuggucgacuguuccggcggccagcagcauuuccucaaggacaaccugaucgaccuggggugcccccacauaccucuccuggguaagauggccauauacaucugccgcaugagcaaccacccccggacaaccauggccuuccuguucugguucuccuucggguacgugauaaccugcaucuucugcaaagcccuguucuacagccugaucaucaucggcacccugggcaagaagaucaagcaguaucgcgagcuuaaaccgcagaccugcacgaucugcgagaccgccccugugaacgccauagacgccgaaaugcacgaccugaacuguuccuacaacaucugccccuacugcgcgagccggcugaccagugacgggcucgcccgccaugucacccagugccccaagcgaaaggagaagguggaggagacggagcuguaccugaacuuagagcgcaucccguggauagugcggaagcugcugcaggucagcgaaagcaccggcguggcccucaagcgcuccucguggcugaucguccugcucguacugcugacagugucccucucacccgugcaauccgcccccgucggucacggcaagaccaucgagacguaccagacacgggagggguucaccagcaucugccuguucauguuaggcuccaucuuauucaucgugucgugccuaguaaagggccuggucgacagugugucggacuccuucuuccccgggcucagugugugccggaccugcuccaucggcagcauuaauggguucgagaucgagucccacaagugcuacugcagccuguucugcugcccguacugccggcacugcuccgccgaccgcgaaauacaucagcugcaucucagcauaugcaagaaacgcaagaccggcuccaacgucaugcuggcggucugcaagcgcaugugcuuccgcgccaccauggaggccagucggcgcgcccugcucauacggagcaucaucaacacaaccuucgugaucugcauccugacgcugaccauuugcgucguguccaccagcgccguggagauggagaaccuccccgccgggaccugggagcgcgaggaggaccuaacgaacuucugucaccaggaaugccaggucacagagaccgagugccugugucccuacgaggcccucguguugcggaagccguuauuccucgacuccaucgugaaaggcaugaagaaccuccugaacagcaccucccucgagacuagccuguccaucgaggcccccuggggcgccaucaacguucagagcacauucaagcccaccguguccaccgccaacaucgcucugagcuggucuagcguggaacaccgagggaacaaaauccucgucacgggccgguccgagagcaucaugaagcuggaggaacgcaccgguguguccugggaccuggggguggaggacgccagcgagucaaagcuccucaccgucucgaucauggacuugucccagauguacagcccgguguucgaguaccucucaggggaccgccagguggaagaguggccgaaggcgaccugcacgggcgacugccccgagcgcugcggcugcacuuccuccacgugucugcacaaggaguggccccacucccggaacuggcgcugcaaccccaccuggugcuggggagugggcacagggugcacgugcugcggcguggacgugaaggaccuguucaccgaccacauguucgucaaguggaagguggaguauaucaagacugaggccaucgugugcguggagcucaccagccaggagcggcagugcucccugaucgaggcggggacgcgcuucaacuugggaccugugaccauaacucucagcgagccgcggaacauccagcagaagcugccgcccgagaucaucaccuugcauccuaagaucgaggagggcuucuucgaccucaugcacgugcagaagguccuuuccgccagcacggugugcaagcugcaguccugcacccacgggauaccaggcgaucuccagguguaccacaucgggaaccucuugaagggcgaccgcgucaacggccaccugauccacaagaucgagccccacuucaacaccuccuggauguccugggacgggugcgaccuggacuacuacuguaauaugggggacuggcccagcugcacuuacacgggugugacccagcacaaccacgcugccuucgugaaccugcucaacauugagaccgacuacaccaagacuuuccacuuccacuccaagagggucaccgcccacggcgacaccccgcaacuggaccugaaagcgcgccccaccuacggggccggagagaucacggugcucgucgagguggcggauauggagcugcacaccaagaagguggaaaucagcgggcugaaauucgccucccuagccuguaccgggugcuacgcgugcagcuccggcauaagcugcaaggucagaauccacguggacgagcccgacgagcugaccgugcacgugaaguccagcgaccccgacgugguggccgccagcacaucccugauggcucgcaaguuagaguucggaaccgauagcaccuucaaggccuucucugcgaugcccaagacuagccugugcuucuacaucgucgaacgggaguacugcaaguccugcagcgaggacgacacgaagaagugcguggacaccaagcuggagcagccccagaguauccucaucgagcacaagggcaccaucaucgggaagcagaacgacacgugcacagccaaggccuccuguuggcuggagagcgucaagagcuucuucuacggccugaagaacaugcucggcuccgucuucgggaacuucuucaucggcauccugcuguuccucgcccccuucgugcugcuggugcuguucuuuauguuuggauggaagauccucuucugcuucaaguguugccgccgcacccggggccuguucaaguaccgccaccugaaggacgacgaagagaccggauauaggcgcaucaucgagcggcucaacaauaagaaaggcaagaaccgccuauuggacggugagcggcuggcggaccgcaagaucgccgaacuguucagcaccaagacacacauuggguga

SEQ ID NO: 15326 - RNA, 5049 nt, Artificial Sequence
  derived and/or modified CDS sequence (opt11) from CCHFV(3820-ST-2007)__KR814868.1__GP
augcacacccugcucgugugcuucauccuguaccugcagcucagcgggcuugggggcgcccacgggcaguccaacgccaccgagcacaacggcaccaacaccaccaccguccccgggacgagccaguccccgaagccacccgcgagcacgacccugccccacacccccgaguccucgacugugaaacucaccacccccacauccgagacggaggguagcggcgagaccaccccgcccaacacaacgcaggggcugccccugcccggcaccacccccgagcgcuccgccaccacggccaccagcaccuccagcaccgacaauaugaacuccacgacccaggugacggacaauacccccacgucaaccgucuccaucagcccauccagcuccagcagcaugccguccaccagccaggggauccaccaccccgugcggucccuccugagcgugucgagccccaagaccgucacgaccccgaccccaaugucccccggcgagaugagccccgagaccuccagccagcacuccgccaugagccgcguaccgacgcuguauaccgccacccagauauccacugagaacaccgaccggagcacgccccgccaguccgagagcuccgugcagcccgcgacccagagcccaaucaccuccccagcccagaccauccuccugaugagcgccgcccccaaggcgauccaggacaugcaucccagccccacgaaccggucgaagcgcaaucuggaggucgagaucauucucacccugagucaggggcugaagaaguacuauggcaagauccucaagcugcugcaccucacccuggaagaggacaccgagggccugcuggaguggugcaagcggaaccugggguccaacugcgacgacgauuucuuccagaagcgcaucgaggaguucuucaucacgggcgagggguacuucaacgagguguugcaguucaagacccucagcacccugaguccgaccgagcccagccacgugcggcuaccuacggccgaaccguucaaguccuacuucgccaaaggauuccucagcaucgacuccggcuacuucagcgccaaauguuacccccgcuccagcacguccgggcugcagcugaucaacgucacccagcaccccgcccggaucgcggagacccccggcccaaagacgaccucacucaagaccaucaacugcaucaaccugcgcgccuccguguucaaagagcaccgggagguggagaucaacguccuucucccccagaucgccgugaaccugagcaacugccauguggucaucaauucccacgucugcgacuacagccuggacacugacgggcccgugcgccucccccggauccaccacgagggcacguuuaucccggggaccuacaagaucgucaucgaucgcaagaacaagcugaacgaccggugcucccuggugaccaacugcgugaucaagggcagggagguccggaagggccaguccguccuccgccaguacaagaccgagaucaagaucgggaagacgagcaccggcucccggaagcugcugagcgaggagcccggggacgacugcauuucucgcacccagcuccugaagaccgagacggccgagauccacgacgacaacuacggcucgcccggggacaagaucaccauuugcaauggcaguaccaucgucgaccagcggcucggcagcgagcucgggugcuauacaaucaaucgggugaaguccuucaagcugugcgagaacagcgcuacgggcaagaccugcgagaucgacuccacccccgugaaaugccgccagggauucugccugaagauaacccaggagggccgggggcacgucaagcugucccgcggcuccgagguggugcucgacgcaugcgacagcucgugcgagaucaugaucccgaagggcacuggggacauccuggucgacugcagcggcgggcagcagcacuuccugaaggacaaccucaucgaccugggcugcccccacaucccgcugcucggcaagauggccauuuacaucugccggauguccaaccacccccgcaccaccauggccuuccuguucugguucagcuucggguacgugauuaccugcaucuucugcaaggcccuguucuauuccuugaucaucaucggcacccuggggaagaagaucaagcaguaccgggagcuaaagccgcagacgugcaccaucugcgagacagcccccgugaacgcgaucgacgccgagaugcaugaccucaacugcagcuacaacaucugccccuacugcgcgagccgccugaccuccgacggccuggcccggcacgucacgcagugccccaagcgcaaggagaagguugaggagaccgagcucuaucugaaccuggagcggauaccauggaucgugcgcaagcuccuccaggucagcgagucuaccggaguggcccugaagcggagcuccuggcucaucgugcugcugguucuccuggcaguuagccugucccccgugcaaagcgcccccgucggccacggcaagacgaucgagacguaccagacccgcgagggguucacguccaucugccuauucaugcugggcucuauccuguucaucgugagcugccucgugaaggggcuggucgacagcguguccgacucauucuuccccggccugucggugugcaagaccugcagcaucggguccaucaacggcuucgagaucgaaagccacaagugcuacugcucccucuucugcugcccguacugcagacacugcagcgccgaccgcgagauccaucagcugcaccuguccaucugcaagaagagaaagacaggcuccaaugucaugcucgccgugugcaagcgcaugugcuucaaggcgaccaucgaggccagcagacgcgcccugcugauccgcuccaucaucaacaccaccuucgugaugugcauauuaacacuugccaucugcgucgugagcaccuccgccguggagauggaggaccugcccgcggggaccugggagcgggaggaggaccucaccaacuucugccaccaagagugccaggucacggagaccgagugccugugccccuaugaggcccuggugcuccgcaagccacuguuccuggacagcaucgugaaggggaugaagaaccuccugaacuccaccagccuggagaccagccucucaaucgaggcucccuggggcgccaucaacguccaguccacguucaagcccaccgugagcaccgccaacaucgcacucuccuggucuuccguggagcaccgggggaacaagauccuggucaccgggcgcagcgaguccaucaugaagcucgaggagcggacgggcgugagcugggaccugggcguagaggacgcauccgaaagcaagcugcucaccgucuccaucauggaccugucccagauguacucgcccguauucgaguaccuguccggggaccgccaaguggaggaguggccgaaggcuaccugcaccggcgauugccccgagcggugcgggugcacgagcuccacaugccuccacaaggaguggccccacagccgcaacuggcggugcaaccccacuuggugcuggggcgucgggaccggcuguacgugcugcggcguggaugugaaggaccuguuuaccgaccacauguuuaucaaguggaaggucgaguacaucaagaccgaggccaucgugugcguggagcugaccucccaggagcgccagugcagccucaucgaggccgggacccgguucaaccugggcccgguaacgaucacccuguccgagccccgcaacauccagcagaagcucccgcccgagaucauaacccuccaucccaagaucgaggagggguucuucgaccugaugcacguacaaaaggugcucagcgcguccaccguuugcaagcugcaaagcugcacgcacgggauccccggcgaccugcagaucuaccacauugggaaccuccugaaaggcgaccgggugaacgggcaccugauccacaagaucgagccccacuucaacacuuccuggaugagcugggacggcugcgaccucgacuacuacugcaacaugggggauuggcccuccugcaccuacaccggcgucacgcagcacaaccaugccgccuucgugaaccugcugaacaucgagaccgacuacaccaagaccuuccacuuccacagcaagcgcgugacagcccacggcgauaccccgcagcucgaccuuaaggcgagacccaccuacggggccggagagaucaccguccugguggagguggccgacauggagcuccacacgaagaaggucgagaucuccgggcugaaguucgccagccugaccugcaccggcugcuacgccugcagcagcgggaucagcugcaaagugcgcauccacguggacgagcccgacgagcucaccguccacgugaaguccagcgaccccgacguggucgcggcguccacuagccugauggcccggaagcuggaguucggcaccgacuccaccuucaaggccuuuagcgccaugccgaagaccucccucugcuucuacaucguggagcgcgaguacugcaagagcugcuccgaggacgacacgaagaaaugcguggacaccaagcucgagcagccccagaguauccugauagagcacaaaggcaccaucaucgggaagcagaacgacaccuguacggcuaaggccuccuguuggcucgaaagcgucaagagcuucuucuacggccugaaaaacaugcuggggagcguguucggcuccuucuucguggggauacuccuguuccuggcccccuucguccugcucgugcuguuuuucauguucgguuggaaaauccuguucugcuucaaguguugccggcgcacccggggccucuucaaguaccgccaucugaaggacgacgaggagacaggcuaccgccggauuaucgagcgccugaacagcaagaagggcaagaacagacuucuggacggggagcgccuggccgaccggaagaucgccgaacucuucucgaccaagacccacaucggcuga

SEQ ID NO: 15327 - RNA, 5052 nt, Artificial Sequence
  derived and/or modified CDS sequence (opt11) from CCHFV(Ast199)__KX056051.1__GP
augcacacccugcuggugugcuucauccuguaccugcagcucuccggucucgguggggcccauguccagagcaaugcaaccgagcacaacggcaccaacaccaccaccgugcccggcaccagccagucgccaaagccgcccgcaagcaccacgcugccccacacccccgaguccagcaccgugaagcugaccacccccaccuccgaaacggaggguucaggugagaccacuccgccacccaacaccacccagggccugcccccgcccgggaccacccccgaacggcccgccaccacggccaccaccacuucuucgaccgacaacaugaacuccaccacccaggucaccgacaacacacccaccuccaccguguccauaagccccucgagcaacccguccaugcccucgaccucccaaggcauccacuaccccguucggucccugcucucggucucgaguccuaagacggugacaacucccacucccaugucgcccggagagaugagccccgagacguccucgcaacauuccgccaugucgcggaucccgacgcuguacacugccgcccagguguccacugagaauacgaaucggagcacgccucgucaguccgagagcuccgcacagccugccacccagagccccaccaccuucccggcccaaacgaucccccuuauguccgcggccccaaaggcuauccaggacaugcacccgagcccaaccaaccgcuccaagcgcaaccuggagguagagaucauccugacccugagucagggccucaagaaguacuacgggaagauacugaaacuucuccaccugacccuggaggaggacacggagggccuccuugaguggugcaaacgaaaccugggcuccaacugcgacgacgacuucuuucagaaacgaaucgaggaguucuucauaaccggcgaggguuacuucaaugaggugcuccaguucaagacccccagcacccugagccccacggagcccucccaugugcggcugccgaccgcagagccguucaagagcuacuucgcaaagggguuucucuccaucgacagcggcuacuucuccgcaaagugcuacccccgcagcuccaccagcgggcugcagcuaaucaacgugacccagcacccugcccggaucgccgagaccccagggcccaagaccacgucgcucaagacaaucaacugcaucaaccugagagccagcguguucaaagagcaccgggagguggagaucaacguccuacucccccaaaucgccgugaaucuguccaacugccacguggucauaaacagccacgugugcgacuacuccuuggacacggacggcccggugagacucccccggauccaccacgaagggacuuuuaucccgggcaccuacaagaucgucaucgacaagaagaauaagcuaaacgaccgcugcagccuuguaaccaacugcgugaucaaagggcgggaggucagaaagggacaguccgugcuccggcaguacaagacggaaauuaagauugguaaggcgagcacugggucccgcaaacugcugagcgaggaacccggcgacgacugcaucagccggacccagcuccugaagaccgagacggccgagauccacgaugacaacuacgggggcccgggggacaagaucaccaucugcaacggcuccacaauugucgaccagcgucugggcagcgaacucgggugcuauaccaucaaccgcgugaaguccuucaaauuaugugagaacagcgcgacgggcaagaccugcgagauagacuccacccccgucaagugccgucagggguucugcuuaaagaucacccaggaaggccgcgggcacgucaagcucagcagaggcucggaggugguucuggacgcaugcgacagcucgugcgaaauuaugauccccaagggcaccggugacauccuaguagacugcagcggcgggcagcagcacuuccugaaagacaaccucaucgaccugggcugcccccauaucccgcuguugggaaagauggcuaucuacauaugccgcaugaguaaccacccccgaacuaccauggcguuccuguucugguuuagcuuuggguacguuauuacaugcaucuucugcaaggcguuguuuuacucccuuaucauaaucggcacccugggaaagaagauaaaacaguaccgcgagcuaaaaccccaaacgugcaccaucugcgagaccgcgcccgugaacgcuaucgacgccgagaugcacgacuuaaacugcagcuacaacaucugcccguacugcgcgucucgguuaaccagcgacggccuggcccgccaugucacacaguguccaaagagaaaggagaagguggaggagacugagcuguacuuaaaccuggagcgcauccccuggaucgugcggaagcuauugcaagucuccgagagcacagguguggcguuaaaacgcugcuccuggcucaucgugcugcugguccuccugaccgugagccugaguccagugcaguccgcccccgucggccacgggaagacgaucgagaccuaccagacccgggagggguucaccaacaucugccucuuuaugcuuggcagcauccuguucauaguuagcuguuuggugaaggggcuggucgacagcguguccgacucauucuuccccgggcucucaguguguaagacuugcagcauugggucaaucaauggauucgaaaucgaaagccacaagugcuacugcucgcucuuuugcugcccguacugccgccacuguagcgcggaccgggagauccaccagcugcaccugggcaucugcaagaagcgcaagaccggguccaacgucaugcucgcggugugcaagcgaaugugcuucaaggccacaaucgaggccagccgccgggcccugcugauccgcuccauuaucaacacuacguucgucauaugcauccucaccuuagcgauaugcguugugagcaccuccgccgucgaaauggagaaccuuccggccgguaccugggagcgcgaagaggaccucacgaauuucugccaccaggagugccaggucaccgagaccgagugcuuguguccguacgaggcccuggugcuccggaagccccuguucuuagacuccaucgugaaagggaugaagaaccuccugaacuccaccagccuggagaccagccuaagcaucgaggcccccuggggcgcgaucaauguacaaagcaccuucaagccgaccguguccaccgccaacauugcccugagcuggucaucuguagagcaccgcgggaacaagauccuggucacgggccgguccgagagcauaaugaaacuugaagaacguaccggcgucucaugggaccugggggucgaggacgccucugaguccaagcugcucaccgucagcaucauggaccugucccagauguauagccccguauucgaguaccuguccggcgaccgccagguggaggaauggcccaaggcgaccugcacaggggacugccccgaacgcugcggauguaccagcucuaccugccuccacaaggaguggccgcacagccggaacuggcgcugcaaccccaccuggugcuggggcgucggcaccggcugcacuuguugcgggguggacguaaaagaccuguucacugaucauauguucaucaaauggaaagucgaguacaucaagaccgaggcgauuguguguguggaacugaccucccaggagcggcagugcucacuuaucgaggcugguacacgcuuuaaccugggacccgucaccaucacccuuagcgagccacgcaacauccagcaaaagcucccgcccgagauuaucacccugcaccccaagauugaggagggauuuuucgacuugaugcacgugcagaaggugcuguccgccagcacggucugcaagcugcaguccuguacccacggcauccccggggaccugcaaaucuaccacaucggcaaccuccugaagggggaccggcugaacggccaccucauacauaaaaucgaaccgcacuucaauaccucuuggaugagcugggacggcugcgaccuggacuacuauugcaacaugggcgacuggccuagcugcaccuacacuggcgugacacagcacaaucacgccgcauuugucaaucugcucaacauagagaccgacuacaccaagacguuucacuuccacuccaagcgugugacggcccacggggauacgccacagcuggaccugaaggcccgacccacauacggcgccggagaaaucacgguacucgucgagguggccgauauggagcugcacacuaaaaagguggaggucucuggccugaaguucgcgucucuagccuguaccgggugcuacgcgugcagcuccggcaucagcuguaaggugcggauccacguggacgagccugacgagcugacaguccacguuaaaucaagcgaccccgauguggucgccgccuccacgagccugauggcgcggaagcucgaguucggaaccgacuccaccuucaaggccuucucggccaugcccaagacuucccuguguuucuauaucguagagcgggaguacugcaagucgugcagcgaggacgacacgaagaagugcguagacaccaagcuggagcagccccagucgauccucauagagcacaaggggaccaucaucggcaagcagaacgacacgugcacggccaaggccagcugcuggcuggagucggucaagagcuucuuuuaugggcuuaagaacaugcucggguccguguucgggaacuucuuugugggcauacugcuguuccucgcgccguucguucugcugguccuguucuuuaucuuuggcuggaagauacucuucugcuucaagugcugccgccggacacgcgggcuguucaaguaccggcaccucaaggaugacgaggagaccggcuaucgcaagaucaucgagcgccucaacagcaagaaggggaagaaccggcugcuggacggcgagcgcuuagccgaccguaagaucgccgagcuguuuucgaccaagacgcauaucgguuga

SEQ ID NO: 15328 - RNA, 5052 nt, Artificial Sequence; identical to SEQ ID NO: 12042
  derived and/or modified CDS sequence (opt11) from CCHFV(Turkey200310849)__DQ211636.1__GP

SEQ ID NO: 15329 - RNA, 5052 nt, Artificial Sequence
  derived and/or modified CDS sequence (opt11) from CCHFV(5170-R-2011)__KR814873.1__GP
augcacacccugcucgugugcuuuauccuguaccugcagcucagcggccucgggggcgcccacggacaguccaacgagaccgagcacaacgguacgaauacgaccacugucccaggcacgagccaguccccgaagccgcccgccagcaccacccugcagcacacccccgaauccagcacggugaagcucaccacccccaccucugaaacugagggcagcggcgagaccaccccgccgcccaacaccacgcaggggcugcccccacccggcaccacccccgagagguccgcgacgacggccacaagcacuuccagcacagacaacaugaacuccaccacacaagugaccgacaacacccccacuagcaccgucagcauaagccccuccagcucccccagcaugcccagcaccucccaggggauacacuaccccauccggagcuugcucuccgugaguuccccuaaaaccgugacgacccccacccccauaucaccgggcgaaaugucccccgagaccagcucccagcacagcgccaugucacguauccccacguuauacaccgcaacccaggucagcaccgagaacaccaacagauccacgccccgccaaagcgaguccagcgugcagccggccacgcagucccccauuaccucgcccgcucagaccauacugcucauguccgccgcccccaaggccauccaggacaugcauccgagucccacgaaccggagcaaacgcaaccuggagguagagauaauacugacccuuagucagggucugaagaaguacuacggcaagauccuuaaacuccugcaccugacacucgaggaggacaccgagggccugcuggaguggugcaagcggaacuuagggagcaacugcgacgacgacuucuuucagaagcgcaucgaggaguucuucauuacaggcgagggguacuuuaaugagguucugcaguucaaaacucugucaacccuaagcccgaccgagcugucacacgugcggcuaccgacggccgagcccuucaaaagcuacuucgccaagggcuucuuauccaucgacagcgguuacuuuuccgccaagugcuacccccgcagcuccaccagcggacugcagcugaucaacgugacccagcaccccgcccggaucgccgagaccccgggcccaaagacgaccucccucaagaccauuaacugcaucaaccugcgagcaucuguauucaaagagcaucgggagguggagaucaacguguugcucccccagaucgccgucaaccuguccaacugucacguggugaucaauagccacgucugcgacuauucccuggacaccgaugggccagugcgcuugccgcggauacaccacgaaggcacguucauccccgggaccuauaagaucgugaucgacaagaagaacaagcugaacgaucggugcucgcuggugaccaauugcgugaucaagggacgggaggugcgcaagggccaguccguccucaggcaguacaagacagagaucaagaucgggaaagccuccacgggcagcaggaagcuccuguccgaggagcccggggacgacugcaucagccggacccaguugcugaaaaccgagaccgccgagauacacgacgacaacuacggcggacccggcgacaagauuacgauuugcaacgguuccaccaucguggaccagcgccuggggagcgagcucggcugcuacaccaucaaccgcguaaaguccuucaagcugugcgagaacucugcgaccggaaagacgugcgagaucgacuccaccccggugaaguguaggcagggcuuuugccucaagaucacccaagaggggcgcggccacgugaagcuaagccggggguccgaggucguccucgacgugugcgauucuuccugugagaucaugauccccaaggggaccggcgacauuuugguugacugcagcgggggccaacagcauuuccugaaagacaaccuuaucgaccugggcugcccucacaucccccugcuagggaagauggcaaucuacaucugccgcauguccaaccacccgcggacgacaauggccuuccuguucugguucagcuucggcuaugucaucaccuguauauucugcaaagcccucuucuacucccucaucaucaucgggacguugggcaagaaaaucaagcaauaccgugagcuuaagccccagaccuguacaaucugcgagaccgccccuguuaaugccaucgacgcggagaugcacgaucucaacugcagcuacaacaucugccccuacugugccagcagacugaccucggaggggcuugcacgccacgucacccagugcccgaagcguaaggaaaaaguugaagagacggagcucuaccugaacuuagagcgcauaccauggauaguucggaaacuccugcaggucagcgagucgaccggcguggcucucaaacgcucguccuggcucauuguacugcugguccuccugacggucagccugagucccgugcagagcgcccccgugggccacgggaagaccaucgagacguaccagacccgugagggcuucacauccaucugccucuucaugcuggggagcauuuuauucauuguguccugccucgugaagggccuggucgacucgguuucugacagcuucuucccgggccugucggugugcaagaccugcagcaucggauccaucaacggcuuugagaucgagucccacaagugcuacugcucccucuucugcugccccuacugccgccacugcagcgcugaccgggagauccaccagcugcaccuguccaucuguaagaaacgcaagacggggagcaacgucaugcucgccgugugcaagcggaugugcuucaaggccaccauagaagccagccgccgggcguuacugauccgcucuauuaucaacaccaccuuugugaucugcauccucacgcuggccaucugcguugugagcaccuccgccguggaaauggaggaucugcccgccgggaccugggagcgcgaggaggaccucaccaauuuuugccaccaggagugccaggucacggagaccgagugccugugcccauaugaagcccuggugcugcggaagccacuguuccuagacagcaucgugaaagggaugaagaaucuccuuaacuccaccagcuuggagacaucgcugagcaucgaggcgcccuggggcgccaucaauguccaauccacguucaagcccaccgugagcaccgccaacaucgcccugaguuggagcuccguggagcaucgcgggaauaagauccucgucaccggacggagcgaguccaucaugaagcucgaggaacgcacgggcgugagcugggacuuagguguggaggacgccuccgaguccaagcugcucaccgucuccaucauggaucugagccagauguacagcccgguguucgaguaccuguccggcgaccgacagguggaggaguggcccaaggcgaccugcaccggggacugcccagagcggugcgggugcacgagcucuaccugccuccacaaggaguggccccacucccggaacuggcgcuguaaccccaccugguguuggggcgucggcaccggcuguacgugcugcgggguggacgugaaggaucuuuucaccgaccacauguucaucaaguggaaggucgaguacaucaagacugaggcuaucgugugcguggagcugaccucccaagaacggcaauguagcuuaaucgaggccgguacccguuucaaccugggccccgucacaauaaccuugucagagccccggaacauacagcagaaguuacccccggagaucaucacccugcaccccaagaucgaggagggcuucuuugaccugaugcaugugcaaaaagugcucagcgccuccacagucugcaagcuccagagcugcacgcacggcauucccggggaccugcagaucuaccauaucggcaaccuccugaaaggggacagggugaacggccaccugauccauaagauugagccccacuucaacaccucuuggaugucuugggacgggugcgaucucgauuacuacugcaacaugggcgacuggccgucauguacguacaccggcgucacacagcacaaccacgccgcguuugugaacuugcugaacaucgagaccgacuacacuaaaaccuuucacuuccacagcaagcgggucacggcucacggugacacgccccagcucgaucugaaagcccgccccaccuacggugccggggagauaaccguccuuguggagguggcggacauggagcuucacaccaagaagguagaaaucuccggacugaaguucgccagccugaccugcacggggugcuacgcuugcucaucggggaucuccugcaaggugcggauccacguggacgagccugacgaacucaccguccacguuaagagcagcgauccggauguggucgccgccuccacgagccugauggcgcgcaaacuggaguucggcaccgacucaaccuuuaaggcuuuuagcgccaugcccaaaaccucccucugcuucuacaucguggaacgggaauauugcaagagcuguuccgaggacgacacgaagaagugcguggacaccaaguuagagcagccccagagcaucuuaaucgagcacaaggggaccaucaucgggaagcagaacgauaccugcacggccaaggccuccugcuggcucgaaagcgucaaguccuucuucuacgggcucaagaauaugcugggcagcguuuucggguccuucuuugugggcaucuugcuguuccuggcgcccuucguccuccucgugcuguucuucauguucggcuggaagauccuguucuguuucaagugcugccgcagaacccguggucucuucaaguaccggcaccucaaggacgacgaggaaaccggguaccgccgcaucaucgagcggcugaacagcaagaaggggaagaaccgccuccuggacggcgagcgacuggccgaccgcaagauagccgaacucuucuccacgaagacgcacaucggcuga

SEQ ID NO: 15330 - RNA, 5055 nt, Artificial Sequence
  derived and/or modified CDS sequence (opt11) from CCHFV(SCT ex Afghanistan)__KC344856.1__GP
auguacacccugcucgugugcgccauccugugcccccagccauggagccuggagggcacccacguuccccucaacgggacgaagcacaacggcaccggaaucacagccgcaccgggcgggucccagggccccacgagcccggcuuccacggccgugagccugacucccgauccuuucacaacugagcccacggcauccgccguggagcuggagagcuccggcgaagggcacaccagccucuccgucacuacacagggucucacgagcccggagaccacucccggguuacccaccgugacggauaccggcguuucaucaaccuccaucuucgggauaggcauccgcgucgcgggcgacacccccacgagcaccacccacacagggcucccgucaucucccuccaugcccagcacggcgcagggaccacaccacgccguacgggggcugcuuagcgugagcagcacgcgcccgggcgaggccagcaccauaacuguacccggcgaggcggggacggaggcgaacagcuccagcucagccaucagcaagaagccggccccauccccgacugcugaagcgaucaccgaggccaacaacagcuccaacccucggcagcccgagcucaguacccagccagcaauuccaggccuggugacuuccagcgcccagcccauccugcuucaguccgccaccagcaccgcggcccaggacaucuauccaucccccaccaaccgcagcaagcggaaucuggagauggagaucauccugacgcucucccaggggcugaagaaauauuacgggaagaucuuaagaauccucgaccugacgcuggaggaggauaccgagggacuacucgaguggugcaagcggaaccugggccugaccuguaacgacaacuucuuucaggagcgcauugaggaguucuuuuugaccggggaggggcacuuuaacgaagugcugcaguuuaaaacgcccagcacccuaucccccaccgaacccacccacacgcggacuccgacugucaagcccuuuaagagcuacuucgcucgcggcuuccugucgaucgacuccggguacuucagugccaaaugcuacuccaagaccagcaacucaggacugcaacucaucaauaucacacagcaccccgcccggaucgccgacaccccaggaccgaagaucaccaaccugaaggcaaucaacugcaucaaccugaaggccagcguguucaaggagcaucgcgagaucgaaaucaacgugcuccugccccaagucgccgugaacuuauccaacugccaugugcucauaaagagccaugucugcgacuacucccuagacaucgacggugccgugcggcugccccacgugcaucacaagggcaccuucauccccggcacguacaagaucgugaucgacaagcgcaacaagcagaacgaccggugcacccuagugaccaacugcgugaucaagggcaaggagauccgcaaggggcagagcgcccuacgacaguaccgcaccgagauccggaucggcaaggccuccgccggcagccgcagacuucuuuccgaggagucaggcgacgacuguaucucccgcacacagcugcugcgcacugagaccgcagaggugcacaaugacaauuacggcggcccgggcgacaagaucaccaucugcaacgggagcacgauaguagaccagcgccucggcuccgagcugggcugcuacaccaucaaccgcgucaagagcuucaaacugugugagaauagcgcgacaggcaaauccugcaagauagacagcacccccgugaagugccggcagggcuucugccugaagaucacgcaggagggccgaggccacgugaagcucucccggggcagcgaggucgugcuggacgcgugcgacuccagcugcgaaaucaugauccccaagggcaccggcgacauccuggucgacugcuccgggggccagcagcacuuccucaaggauaaccugaucgaccugggcugccccaacaucccgcuacugggcaagauggcaaucuacaucugccgcaugagcaaccauccuaagaccacaauggccuuucuguucugguucuccuucggguacguuaucacguguaucuucugcaaggugaucuucuaccuccugauaguggucggcacccucggcaaaaaguucaagcaguacagagaacucaagccccagaccugcacuaucugcgaaaccacccccaccaacgccaucgacgcggaaaugcacgaucugaacuguagcuacaacauaugcccguacugcgcgucccgccucacuagcgacggguuggcucggcaugugacucagugccccaagaggaaggagaagguggaagagaccgagcuguaccugaaucucgagcggauacccuggaucgucaggaagcugcuccaggugagugagagcaccggcguugcccuuaaacgguccucaugguugaucguccugcucguacugcugaccgugucccucucccccguccaguccgcuccgaucggacauggcaagacaaucgagacguaccagaccagagagggguacaucagcgugugccuguucgugcuggguggcauccucuucgucgugagcugccugauaaaaggccuggucgauuccgucggcaacagcuuuuuccccgggcucuccaucugcaagaccuguagcaucggcucagugaaugguuucgagaucgagucucacaagugcuauugcagccugcucugcugcccuuacugccggcacuguuccaccgaccgcgagauccaccagcuccaccugucaauaugcaagaagcggcgcacugggggcaacgugaugcuggcggucugcaagcggauguguuuccgcgcgaccauggaagugucaaacaagguccuguucauccgcaacaucaucaacaccaccuucguaaucugcauccugauccuggccgugugugugguuuccacgagcgcuguggagauggaguccuugccggccgggacuugggagcgugaagaggaccugaccaacuuuugccaucaggagugccaagucaccgagacggagugccugugcccguaugaggcacugguucugcgcaagccccuguuccucaacagcaucgugaagggcaugaaaaaccugcugaacuccacaaaccucgagaccagucuguccaucgaggccccauggggcgcaauaaaugugcagaguaccuucaagccgacggucucuaccgcaaacaucgcgcugagcuggagcuccguggaacaccgggggaauaagauucuagugagcggccgcuccgagaguaucaugaaauuggaggagcggaccggaaucuccugggaccugggugucgaggacgccagcgagucgaaaucacugaccguguccgugauggaccugucccagauguacucccccgucuucgaguaccugagcggggaccgccagguggaggaauggcccaaggccacgugcaccggcgacugucccgagcggugcggaugcaccaguagcacgugccuccacaaggaguggccccacucccgcaacuggcggugcaaccccaccuggugcuggggcguggggaccgggugcacgugcugcggccuggacgucaaagaccuguucacagacuacauguucguaaaguggaaaguggaauauaucaagaccgaggccaucgucugcguggaacucaccagccaggagcgacagugcucccuaaucgaagcagggacccgguucaaccuggggcccgucaccaucacgcucagcgagccucgcaacauccagcagaagcucccgccugagaucaucacccugcacccccggaucgaggagggguucuucgaccucaugcacgugcagaaggugcuauccgcaucaaccgucugcaagcugcagagcugcacccacggugugcccggcgaccuccagguguaccauauugggaaccugcugaaaggagauaagcuaaacgggcacaugauccacaagaucgagccgcacuucaacacgucuuggaugagcugggacggcugcgacuuagacuacuacugcaacaugggcgacuggcccucgugcacauacaccggcguuacgcaacacaaccacgccgcguucgugaaccugcucaacauagagaccgauuacacgaagaauuuccacuuccacucuaagagagugacggcccacggcgauacgccucaguuagaccugaaggcgcggcccaccuacggcgcgggcgagaucaccguccuaguggagguggccgacauggagcugcauacaaagaaaaucgacaucuccgggcugaaauucgccagccugacuugugccggcugcuaugccugcuccagcggcaucuccugcaaggugcgcauccacguugacgagccggacgagcucacugugcacgucaagagcgaggaccccgacaucguugcggccucaacgagccugaucgcccggaaacucgagcugggaaccgauuccaccuuuaaggccuucuccgcgaugcccaagaccucccugugcuucuacaucguggaacgcgaauacugcaagagcugcuccaaggaagacacgcagaagugcgucaacacuaaacuagagcacccccagggcauccugauagagcacaaggggacaauuaucggcaagcaaaacgacacaugcaccgcaaaggcuggguguuggcuggagagcgugaaguccuucuucuacggccucaagaauaugcugagcggaaucuucgggaacguguucaucgguauauuucuguuccuggcuccauucguccuccuaauccuguucuucauguucggguggcggcuccucuucugcuucaagugcugcaggcggacccgcggccuguucaaguaccgccaccucaaagaggacgaggagagcggguaccgacgcaucaucgagcggcugaacaacaagaagggcaagaacaagcugcucgauggcgagcgccuugccgaucggcgcaucgcggagcuguucuccacuaagacccacaucggcuag

SEQ ID NO: 15331 - RNA, 5055 nt, Artificial Sequence
  derived and/or modified CDS sequence (opt11) from CCHFV(SPU 44/08)__KJ682805.1__GP
auguacacgccccugcucugcgccauccugugccugcagcucuggagccuagagggcauuuacgggcuguccaacaacacccagcacaaugacaccagcaccaucaagguuccggaggagucccagaaaacgagccuccccgccaacaccgcuagccccaucacgucugacccgccgccuaccaccccuaccgccuccgccagcggccccgagggguccggcgauacgagcaccuccccgcccgucaccacccagggacccacucccccggagaccacccccgagccccacacgacgauugacaucgacaaguccaguaccgccaucgccgacaucagcacccagaccgugaagaacauccccacgccgaccgcccacaccucccugcccagcacccuguccgcccccacgaugccccaggaggcccaucacaccgcccgcggccuccugagcgugaccuccaccaagcccggcgaggcgagcacucccaccagccccggggaggccuccaccgaagcaagcagcccccagccgaccauccgggaaacgcccuccccgccgcccaccacgcagacaccaacggagaucaacaaccccaacaccucccgccagcccaugcccucuacccaaccggccgccccgucgagcgucacccaccccgcgcagcccacccccucccagucagacgugcccacggcugcccaggacauccacccgucccccaccaaccggagcaagcgcaacuuagagauggagaucauccucacccugucccagggccugaagaaguacuacgggaaggugcuaaagcugcuugaccucacccuggaggaagauacggaggggcugcuugaguggugcaaacgcaaccugggucugaccugcgacgacaacuucuuucaaaagcgcaucgaggaguuuuuccucaccggcgagggccacuucaacgagguccugcaguucaagacccccucaacgcuuuccccgacagagccggcccggguggagagcccgacgguggaacccuuuaaauccuacuucgccaagggguuccuccuuauggacagcggcuacuucuccgcgaagugcuaucccaagagcagcaacagcgggcuccagcucaucaacguaacccagcaucugauccgcaucacggacaccccgggccccaaaaucacaaaccucaagaccauaaacuguaucaaccuuaaggcccugguguucaaggagcaccgggagaucgagaucaacgugcugcucccccaggucgccgugaaccugagcaauugccacguccugaucaagucccacgucugcgacuacagcaucgacaucgacggccccguacgccucccgcggauccaccacgagggcacguucauccccggcaccuacaaaaucgugaucgacaagaagaacaagcagaacgaucggugcaccuuggucacuaauugcgugaucaaggggcgggagauccguaagggccaguccguccugcggcaguaccgaacggaaaucaaaauugggaaggccagcuccggcagccggcgucucuuguccgaggagagcaacgacgacugccugucccggacucaguugcuacgaaccgagaacgccgagauccacagcgacaacuacggugggcccggcgauaagaucaccaucugcaauggguccacgaucguggaccagcggcugggcagcgagcuagggugcuacaccaucaaccgcgugaaguccuucaaacugugugagaacagcgcaaccggcaaguccugcgagaucgacagcacccccgugcgcugccggcagggcuucugccugaagaucacccaggaggggcgcggccacguaaagcugagccggggguccgagguaguccucgacgccugcgacagcuccugcgaaaucaugaucccgaaggguaccggggacauccugguagacugcucgggcggccagcagcacuuccugaaggacaaccuaguggacuuagggugcccgaauaucccgcugcucggcaaaauggcuaucuacaucuguaggaugaguaaccauccgaaaaccaccauggcguuccucuuuugguuuagcuucggguacguaauaacgugcauccugugcaaggccauauucuauuuacugaucguggugggcacccugggaaagaaguucaagcaauaccgggagcucaagccccagaccugcaccauuugcgagacuaaccccguuaacgccaucgacgcugagaugcacgaucugaacuguuccuacaacaucugucccuacugcgccagccgccugaccuccgacgggcucgcccggcaugugaugcagugcccgaagcgcaaggagaagaucgaggagacugaacuguaccugaaccucgagcggauucccugggugguccgcaagcugcuccaggugagcgaguccaccgguguggcgcucaagcggagcuccuggcuggucauccugcucguccugcugaccgucagccucucccccguccagucggcccccaucucccacggagagacgguggaggucuaccagacacgcgagggcuacaccucaauaugcuuauucguccuuggguccauccucuuccucgugagcugccucaugcggggacucguggacuccgucucgaacagcuucuucccgggccugucgaucugcaagacuugcagcauaggcuccaucaacggcuucgagaucgagagccauaagugcuacugcagccuguucugcugcccguacugccgccauugcuccgccgacaucgagauccacaagcuccaccuguccauaugcaagaagcggaagaccgggaguaacgugaugcuugccgugugcaagcgcauguguuuccgggccaccgucgaggucagcaacaaggcgcuccugauccgcaacaucauuaacaccaccuucguggucugcauucugauccucgccgucuguguggucagcacguccgccguggagauggagaacuuaccugccgguaccugggagaaagaggaggaccugaccaacuuuugccaccaggagugccaagucaccgagacagaaugccucugccccuacgaggcccugguccucaggaaaccccucuuccuggauagcaucgugaaggguaugaagaaccugcucaacaguaccagccuggagaccagucugagcaucgaggcgccguggggcgcuaucaacgugcaguccaccuucaagcccacggucagcgccgcgaacaucgccuugagcugguccuccguggagcaccgcggcaacaagauccuggugagugggcgcagcgaguccaucaugaagcuagaggagcggaccggcauaagcugggaccucggggucgaggacgcguccgaaucuaagcuccugaccgugagcgucauggaucucagccaaauguacucccccgucuucgaguaccugaguggcgaucgacagguggaggaguggccgaaggcgaccuguacgggggacugccccgaacggugcggcugcaccuccuccacgugccuccacaaggaguggccccauucccgcaacuggcgguguaaccccaccugguguuggggcguggggaccggcugcacuugcugcgggcucgacgucaaggaccuguucaccgacuacauguucgugaaguggaagguugacuacaucaagaccgaagccaucgucugcguggagcugaccagccaggaacgccaaugcucccucaucgaggccggcacgcgguucaaccuggggccggugaccaucacccugagcgagccccgcaacauccagcagaagcucccgcccgagaucguaacgcugcacccccggaucgaggagggcuucuucgaccugaugcauauccagaagguucucuccgcaucuaccgucugcaaacugcagagcugcacgcacggagugcccggggaccugcagaucuaccacaucggcaaccuucugaagggggacaaggugaacggccaccugauccacaagaucgaaccacacuucaacaccuccuggaugagcugggacggcugcgaccucgacuacuacugcaacaugggggacuggcccuccugcagcuacacuggcgucacccagcacaaccacgccgccuucguuaacaugcugaacauugagaccgacuacaccaagaacuuccauuuccacucuaagcgcguuaccgcacacggggacacgccacaacuggaccucaaagcccggcccacuuacggcgcgggggagaucaccgugcugguggagguggccgacauggaacugcacaccaaaaagaucgagaucagcggucucaaguucgccucgcuuacguguaccggcugcuacgcaugcagcuccgggaucucgugcaagguccgcauccacguggacgagcccgacgagcugaccgugcacgucaaguccgaggacccggauauaguggccgcgagcaguagcuuaauggccaggaagcuggaguuuggcaccgauuccacguucaaggccuucagcgcuaugccaaaaaccucccugugcuucuacaucguugagcgcgaguacugcaaaagcugcuccaaggaggauacucagaagugcguaaacaccaagcucgagcagccccagagcauccugaucgagcacaaggguacgaucaucggaaagcagaacgacacgugcaccgccaaggcaagcugcuggcuggaguccaucaagagcuucuuuuacgggcuaaagaacaugcuguccggcauauucgggaacguguuuaucgggaucuuucuguuccuagcccccuucaucaugcucauccuauucuucauguucggguggcggaucuuguucugcuucaagugcugccgccggacccgcgggcuuuucaaguaccggcaccugaaagacgacgaggagaucggguaccgcaagaucaucgaacggcugaacaacaagaaggggaagaacaagcuccuugacggcgagcgccuggccgaccgcaagaucgccgagcuguucagcacgaagacccacaucggcuga

SEQ ID NO: 15332 - RNA, 5052 nt, Artificial Sequence
  derived and/or modified CDS sequence (opt11) from CCHFV(K323_27)__KX013472.1__GP
augcacacccugcuggugugcuucauccuguaccugcagcuuagcggccucgggggcgcccauggccaguccaacgccaccgagcacaacggcacgaauaccaccaccguccccgggacgagccaguccccgaagccgcccgcaagcaccacccugccacacaccccagaguccagcacugugaagcucaccaccccaaccuccgagacggagggcucgggcgagaccacaccaccgcccaacaccacgcaggggcugccccugcccgguaccacacccgagcgcucugccaccacggccaccucgaccuccagcaccgacaacaugaacuccacgacccaggugaccgauaauacccccacgagcaccgucuccaucagccccuccagcucgcccagcaugcccagcaccucccaggggauccaccacccgguacggagccuccuguccguguccucccccaaaaccgucacgacccccacucccaugagcccgggcgagaugucccccgagaccagcucccagcacagcgccaugucucguauccccacgcuguacacggccacccaggugagcacagaaaacaccgaccgguccacgccccgccaaagcgaguccagcguucaaccggcgacccaaucucccaucaccagcccggcccagaccauccuccugauguccgccgcccccaaggcgauccaggauaugcacccgagccccacgaaccggagcaagcgcaaccuggaggucgagaucauccucacccugucccaggggcuaaagaaguacuacggcaagauccuaaaacuucugcaccucacacuggaggaagacaccgaaggcuuacucgaguggugcaaacggaaccuggggucuaauugcgacgacgacuucuuucagaagagaaucgaggaguucuucaucacgggcgagggguacuucaacgaggugcugcaguucaagacccuauccacccugucccccaccgaguccagccacgugcggcugccgacggccgagccauucaaguccuacuucgccaaaggcuuccucaguaucgacucaggguacuuuuccgccaaguguuacccccguuccucuaccuccgggcugcagcugaucaacgucacccagcaccccgcccggaucgcagagaccccgggacccaagacuaccuccuuaaagaccaucaauugcaucaaccugcgcgccuccguuuucaaagagcaccgggaaguggaaauaaacguccugcucccccagaucgccgugaaccugagcaacugccacgucgucaucaguagccacgugugugacuacagccuggacaccgacggacccgugcggcucccgcggauccaucacgagggcacguucaucccugggaccuacaagaucgucaucgacagaaaggacaagcugaacgauagaugcucccuggugaccaacugcguaaucaagggccgcgagguacgcaagggccaaagcguucuccgccaguacaagaccgaaaucaagaucgggaaggcguccacgggcucccggaaguuacuguccgaggagcccggggaugacugcaucagcaggacccagcuccugaagacagagacagccgagauccacgacgacaauuacggugggcccggagacaagaucacgaucuguaacggcuccaccaucguggaccagcgccuggggucagagcucggcugcuacaccauuaaccgggugaaguccuucaagcugugcgagaacagcgcgaccgggaagacgugcgagaucgacuccaccccggugaaaugccgccagggauucugccugaagaucacccaggaggggcggggccacgucaaacugagcaggggcuccgagguggugcuagacgccugugacagcuccugcgagaucaugaucccgaaagggaccggcgauauccuggucgauuguagcgggggccaacagcacuuccugaaggacaaccuuaucgaccugggcugcccccauaucccccugcucgggaaaauggccauauacaucugucggauguccaaccacccgcgcacgaccauggccuuccucuucugguucagcuuuggcuacgugaucacgugcaucuucuguaaggcccucuucuaccuccucaucaucauagggacccugggaaagaagaucaagcaguaccgggagcucaagccucagaccuguaccauaugcgagacggccccagugaacgccaucgacgccgagaugcacgaucugaauugcuccuacaacaucugccccuauugcgccagccgccugaccagcgacggguuggcccggcacgucacccagugcccgaagcgcaaggagaagguagaggagacggagcuguaccugaaccucgagcggauccccuggaucgugcgcaagcugcugcaagucuccgagaguaccggcguggcccucaagcggucgagcuggcugaccgugcugcucguacugcugaccgugucccucucgcccgugcaguccgcgcccgucggccacgggaacacuaucgagaccuaucagacccgcgaaggcuucaccagcaucugccuguucaugcugggguccauccucuucaucgugagcugccuggugaaaggccuggucgacuccgugagcgacuccuucuucccggggcucagcguguguaaaacaugcuccaucggcagcaucaacggcuucgagaucgagucccauaaguguuacugcagccucuuuugcugcccccauugccggcaccgguccgccgaccgugaaauccaccagcugcaccucagcaucugcaagaagcgcaagaccggguccaacgucauguuggccgugugcaagcggaugugccccaaggcgaccauagaggccucccgcagagcucugccgauucggagcaucaucaacaccacgcucgugaugugcauccugacccuggccaucugcgucguguccaccagcgcuguggagauggaggaccucccggcggguacgugggaacgcgaggaagaccugacgaacuucugccaucaggagugccaggugaccgaaaccgagugucugugccccuacgaggcccuugugcugagaaagccccuguuccucgacuccauagccaaggggaugaagaacuuacugaacagcaccucccucgagacgucguuauccaucgaggccccguggggcgcuauuaacgugcaaagcacuuucaagcccacaguauccaccgcgaacaucgcccucagcugguccucgguugaacaccgagggaacaagauccucguuacgggccgauccgagagcaucaugaagcuggaggaacgcaccggggucuccugggaccugggggucgaggacgccagcgaguccaagcuacugaccgugagcaucauggaccugucacagauguacucccccgucuucgaguaccucagcggugaccgccagguggaggaguggcccaaagcgaccugcacgggggauugcccggaacgguguggcugcacauccagcacgugccugcauaaggaguggccccacucccggaauuggcgcugcaaucccacauggugcuggggcguggggaccggcuguacuugcugcggggucgacgugaaagaccuguucacagaucacauguuuaucaaguggaagguggaguacaucaagaccgaggccaucgucugcguggagcucaccggccaggagaggcagugcagccugaucgaggccgggacccgcuucaaccugggccccgugaccauaacgcucuccgagccgcggaacauccagcagaagcucccgcccgagaucaucacccugcaccccaagaucgaggagggcuucuucgaucucaugcacguucaaaaagugcugagcgcuuccacggugugcaagcugcagaguuguacccacgggauccccggagaccuccagauuuaccauaucgggaaccugcugaagggcgaccgcgucaacgggcaccucauccacaagaucgagccucacuucaacaccuccuggaugagcugggacggcugcgaccuggacuacuacugcaacaugggcgacuggcccucauguaccuacacgggggugacccagcacaaccacgccgccuucgucaaccugcucaacaucgagaccgauuacaccaagacguuucacuuccacagcaagcgggucaccgcgcacggcgacacaccgcagcuggaccuaaaggcccgaccgaccuacggggccggcgagaucaccgugcucgucgagguugccgauauggagcugcauaccaagaagguggagaucucuggguuaaaguucgcuagccugacguguacgggcugcuacgcgugcuccucuggcaucuccugcaagguccggauccacguugaugagcccgacgagcugacggugcacgucaagagcuccgaccccgacgugguggccgcguccaccagucugauggcccgcaagcucgaguucggcacggacuccaccuucaaagccuucagcgcgaugcccaagacgucccugugcuuuuacaucgucgagcgcgaauacugcaaaagcugcuccgaggacgacaccaagaagugcguggacaccaagcuggagcagccgcagagcauccucauugagcacaagggcaccaucaucgggaagcagaacgacacgugcacugcgaaagccuccugcuggcuggagagcgugaaguccuucuuuuacggccuuaagaacaugcucgggagcgucuucggcuccuucuuugugggcauucuucuguuucuggcccccuucgugcuccugguucuuuucuucauguucggguggaagauccucuucugcuucaagugcugccgucggacccgcggccuguuuaaguauagacaccugaacgacgacgaggagacuggguaccggcgcaucauugagcggcucaauagcaagaagggcaaaaaccgccugcuggacggagaacgacucgcggaccgcaagauugcggagcuguuuuccacgaagacccacaucggguga

SEQ ID NO: 15333 - RNA, 5052 nt, Artificial Sequence
  derived and/or modified CDS sequence (opt11) from CCHFV(1231-CR/TI-2015)__KU161585.1__GP
augcacacccugcucgugugcuucauucuguaccugcagcuccugggccuagggggcgcccacgagcagagcaaugccaccgaccacaaucgcacgaacacuaucaccgcgccuuccacuagccagaacccgaagccgcccgccuccacgacgcccccacacacccccgagagcuccaccaucaagcucaucacgagcaccggcgaggccgaaggcuccggggagacuacacccccgcugaacacgacccagggcccguucccucccgagaccacaagcgagcaccccgcuuccacggccaccaacaccaguuccaccaacagcaugaacucuacgacccagaugaccgacaagacccugacgagcaccgucuccaccagccucaguaucagcccgucgacccccagcacgagccagggaauccacuaccccauccggucccugcugagcgugucgucaccccgcaccgcugccacgccgacccccauguccacgcgggagauguccuccgaaaccaacagccagcacuccgccgugagccgcacccccaccuuccacacggccacccaggucuccaccgagaacgacaaccggucaacaccccgccagagugagagcuccgcgcagccggccacccagagccccaugacgucgcccgcccagagcauccuccugguuuccgccgcacccaccaccauacagaacauccacccgucgcccaccaaucggagcaaacgcaaccuggagauggagaucauccucacgcugccgcaggggcugaagaaguacuacggcaagauccugaagcugcugcacuuaacccuggaggaggacaccgaggggcugcucgaguggugcaagcggaaccugggguccaacugcgacgaugaguucuuccagaaacgcaucgaggaguucuucaucaccggggagggcuacuucaacgaggugcugcaguucaagacguuaagcacccugucccccauggagccgagccacgcccggccacccaccgccgagccguucaagucuuacuucgccaagggcuuccugagcaucgacuccggguacuucagcgccaagugcuacccccgcuccagcuccagcggccuccagcugaucaacaucacccagcaccccgcccggauugcugagacgcccgggccgaagaccaccucccugaagaccaucaacuguaucaaccuccgcgccagcgucuucaaggagcaucgggaagucgagaucaacgugcugcugccccagaucgccgucaaccucuccaacugccacguggugaucaacagccacgucugcgacuacucccuggacacggacggccccguucgccugccccggaucuaucacgagggcaccuucauuccggggaccuacaaaaucgugaucgacaagaagaacaagcucaacgaccgcugcacccuggucacgaacugcgugaccaagggccgggaggugcgcaaggggcagagcgugcugcggcaguacaagaccgagaucaagaucgggaaggccucuaccgggucccgcaagcuccugagcgaggaacccggggacgacugcaucucccgcacgcagcugcuccgaaccgagaccgccgagauccacgacgacaauuauggagggcccggcgacaaaaucaccaucugcaaugggagcaccaucguggaccagcggcugggcuccgagcuggggugcuacaccaucaaccggguaaagagcuucaagcucugcgagaacuccgcgaccggcaagaccugcgagaucgacagcacccccgucaagugccgccagggcuucugccugaagaucacccaggaggggcggggccacgugaagcucucccgcggaagcgaggugguccuggacgccugcgacuccucuugcgaggugaugauccccaaaggcacgggggacauccucgucgacugcuccggcggccagcagcacuuccucaaggacaaccugaucgaccucgggugcccccacaucccgcugcugggcaagauggccaucuacaucugucggaugagcaaccacccccggaccacgauggccuuccuguucugguucuccuucggauacgugauaaccugcaucuucugcaaggcccuguucuacagccugauaaucaucggcacccucggcaagaagaucaagcaauaccgagaguugaagccgcagaccugcaccauuugcgagaccgcccccgugaacgccaucgacgccgagaugcacgaccugaacugcuccuacaacaucugccccuacugcgccucgcgccucaccuccgacggguuagcgcggcacgucacccagugccccaagcgcaaggagaagguggaagagaccgagcuguaccucaacuuggagcgaaucccguggauugugcgcaagcugcuccaggucagcgagagcacggggguggcccugaagagauccucguggcugaucguccuccugguccugcucaccgugucccugagccccgugcaguccgcccccgucgggcacggcaagaccaucgagaccuaccagacgcgcgagggguucaccagcaucugccuguucaugcucggcuccauccuguucaucgugagcugccuggugaagggccucgucgaguccgugagcgauuccuuuuuccccgggcugagcgugugccggaccugcuccaucggcagcaucaacggguuugagaucgagucccacaagugcuacugcagcuuauucugcugcccguacugccgccacugcuccgccgaccgggagauccaccagcuccacuuaagcaucugcaagaagcguaagaccggauccaacgucaugcuggccgugugcaagcgcauguguuuccgggcgacuauggaggccagccgucgggcccuccugauccgcucaaucaucaacaccaccuucgugaucugcauccugacucucacgaucugcgucguguccaccagcgccguggagauggagaaccugcccgccggaaccugggagcgggaggaggaccugaccaacuucugccaccaggagugccaggucacggagaccgaaugccucugccccuaugaggcgcuggugcugcgcaagccacucuuccuggacuccaucgugaagggcaugaagaacuuacucaacagcaccucccuggagaccagccugagcaucgaggcccccuggggcgccauaaacguccagagcacguucaagccuaccgucuccaccgccaacaucgcccucagcugguccagcguggagcaccgcgguaacaagauacuggugaccggccgcuccgagagcaucaugaagcuggaggagcggacgggggucuccugggaccucggcguggaggaugcgagugaguccaaacugcugaccgucagcaucauggaucucucucaaauguacagccccgucuucgaguaccugagcggggaccgacagguggaggaguggccgaaggcaaccugcaccggcgacugccccgagaggugcggcugcacguccaguaccugccugcacaaagaauggccccacagccguaacuggcgguguaaccccaccuggugcuggggagucggcaccgggugcacgugcugcggcguggacgugaaggaccucuuuaccgaccacauguucguuaaguggaagguggaguacaucaagaccgaggccaucgugugcguagagcugaccagccaggagcgccagugcucccugauagaggccgggacgcgguuuaaccucggcccggugacgaucacccugagcgagccccgcaacauccagcagaagcugccacccgagaucaucacucuccacccgaagaucgaggagggcuucuucgaccugaugcacgugcagaagguccuguccgcgagcaccgugugcaaguugcaguccugcacgcacgggauccccggcgaccuacagguguaccacaucgggaaccugcucaagggcgaccgggucaacggccaccugauccacaaaaucgagccccacuucaacaccucauggauguccugggacgggugcgaccuggauuacuacugcaacaugggcgacuggcccagcugcaccuacaccggggugacgcagcacaaccacgccgcguucgugaaccuccugaacaucgagaccgacuacaccaagaccuuccacuuccacuccaagcgcgucacggcccacggcgacacaccccagcuggaccucaaagcccggcccaccuacggggcgggcgagaucaccguacuggucgagguagccgacauggagcugcacacgaaaaagguggagauaagcggccuuaaguucgcgucccuggccugcaccggcugcuacgccugcaguuccggcaucagcugcaagguacgcauccacguggaugagcccgacgagcugaccgugcacgucaagucuagcgaccccgacgugguggcggccagcaccucccucauggcccggaagcuggaguucgggacggacagcacguucaaggccuucuccgcaaugccaaagaccagccugugcuucuacaucgucgagcgcgaguacugcaagucuugcucagaggacgacaccaagaaauguguggacacgaagcucgagcagccccaguccaucuugaucgagcacaaggggaccaucaucgggaagcagaacgauaccugcaccgcgaaggccagcugcuggcuggaguccguaaagagcuucuucuacggccucaagaacaugcuggguuccgucuucgggaacuucuucaucggcauccuacucuucuuggcccccuucguguuacugguacucuucuucauguucggauggaagauacuguucugcuucaagugcugccgccggacgcgcggucuguucaaguaccggcaccucaaggacgacgaggaaaccggguaccgccggaucaucgagcgccugaacaacaagaagggcaagaaccggcugcucgacggggagcgccuggccgaccggaagaucgcggagcuguucagcaccaagacccacaucggguga

SEQ ID NO: 15334 - RNA, 5052 nt, Artificial Sequence
  derived and/or modified CDS sequence (opt11) from CCHFV(K229_194)__KX013463.1__GP
augcacacucuccucgugugcuucauacuuuaucugcagcucagcggacucgguggggcccacgggcagagcaacgccaccgagcacaacgggaccaauaccaccaccguccccgggaccagccaguccccgaaaccgcccgcaagcaccacccugccccacaccccugaguccagcaccgugaagcucaccacccccaccuccgagaccgagggcagcggcgagaccacgccgccgcccaacacuacccaggggcugccgccacccggcaccacccccgagcgcccagccaccacggccaccucgaccagcuccaccgacaacaugaacagcacgacgcaaguuaccgacaacacacccaucuccacggugagcauuucccccagcagcagcccgucgaugcccucgaccagccaggggauccacuaccccgugcggucccuccuaagcgugaguagccccaaaaccgucaccacgccgacccccaugagcccuggcgagaugagccccgaaaccuccagccaacauagugccaugagccgcauaccgaccuuauacacggccacccagguguccacugagaacaccaaccggagcacgcccagacaguccgagaguuccgcccagcccgccacgcaaucacccaccaccuccccgacccagacgauccugcucaugagcgccgcccccaaggcuauccaggacaugcaccccuccccuaccaaccggucaaagcgcaaccuggaaguggagaucauccugacccucucccaggggcugaagaaguacuacggcaagauccugaagcuccugcaccugacacucgaggaggacacggagggccuguuggaauggugcaaacggaaccugggcucgaacugugacgacgauuucuuccagaagcgcauagaggaguucuucaucaccggggagggguauuucaacgaaguccugcaguuuaagacccugaacacccucagccccacugagcccucccauguucggcugcccaccgccgagccguucaagagcuacuucgccaagggcuuuuuaucgguggacagcggcuacuucuccgccaaaugcuacccccgcagcuccaccagcgggcuccagcucaucaacgucacgcaacaccccgcucggauagccgagacgccuggaccgaagaccaccucccugaagaccauaaacugcaucaaccuacgcgccagcguauucaaggagcaccgagaggucgagaucaauguccugcugccccagaucgcggugaaccucuccaauugccacgugguaaucaacagccacgugugcgacuacucccuugacacggacggucccgugagauuaccccggauccaccacgagggcaccuucauuccggggaccuacaagauaguuaucgacaagaaaaacaagcucaacgaccgcugcagccuggugacuaacugcguaaucaagggccgggagguccgcaaaggccaguccgugcugcggcaauacaagacggagaucaagaucgggaaggccagcaccggcagccgaaagcuccuguccgaggagcccggggaugacuguaucagccggacccagcugcucaagacugagacggccgagauacacgacgacaauuacggcgggcccggcgauaagaucaccaucugcaacggcucaacuaucgucgaccagcgccugggcagcgagcugggcugcuacaccaucaaccgcgucaaguccuucaaacuuugcgagaacucugcgacggggaagaccugugaaaucgacucgaccccagugaagugccgacagggcuucugccugaagauaacucaggaggggaggggccacgucaagcugagccggggcuccgaggucguguuggacgccugcgauagcuccugcgaaauaaugaucccgaaggggacgggcgacauccucguggauugcagcgguggccagcagcacuuccuaaagggaaaccugaucgaccucggguguccgcacaucccccugcugggaaagauggcgauuuacaucugccgcauguccaaccacccccggaccacgauggccuuccuguucugguucagcuucgguuacgugaucacgugcaucuucugcaaggcccuguucuacucacugaucaucaucggcacccucgggaagaagauuaagcaguaucgcgagcugaagccgcagacgugcaccaucugcgagaccgcgcccgugaacgccaucgacgccgagaugcacgaccugaauugcagcuacaacauaugccccuacugugccagucggcucaccucggacggccuggcccggcacgucacgcagugccccaagaggaaggagaagguggaagagacagagcuguaccucaaccuggagcgcauaccguggaucgugcggaagcuguuacaggucucugagagcaccggcguugcgcugaagcgcagcucuugguugauagugcuccugguccugcuaaccgugagccuguccccggugcagagcgcccccgucgggcacgggaagacgaucgagacguaucaaacccgggagggguucaccaacaucugccuguucaugcucggauccauccuguucaucgugagcugccuugugaaggggcucgucgacuccgugagcgacuccuucuucccgggccugagcguaugcaagacgugcucgauuggcagcaucaacggguucgagaucgagucacacaagugcuacuguucucuguucugcugccccuacugccgccauugcuccgccgaccgggagauccaccaguugcaucugggcaucugcaagaagcgcaagaccgggagcaacgucaugcucgccgucugcaagcggaugugcuucaaggcgaccaucgaggcgucccgccgggcccuccugaucagaagcaucaucaacaccacauucgugaucugcauccugacccuagccaucugcgucguguccaccuccgccguggagauggaaaaccugcccgcaggcaccugggagcgcgaggaagaccugacgagcuucugccaccaagagugucagguaaccgagaccgagugccucugcccuuacgaggcccucgugcugcggaagccacuguuccuggacucuauagugaaggggaagaagaaccugcucaacagcaccagucuggagacgagccugucaaucgaggcacccuggggcgcaaucaauguccagagcaccuucaagcccaccguguccacagccaacauugcgcuuagcugguccagcguggagcaccgcggcaacaagauccucgucacggggcgguccgagucaaucaugaagcuggaggagcgcaccggcguguccugggaccucgggguggaggacgcguccgaguccaagcugcugaccgucucgaucauggaucucucccagauguacagcccuguguuugaguaccuguccggcgaccgccagguggaggaguggccgaaggcgaccugcacgggggacugccccgagcgcugcggaugcaccagcuccacgugccugcacaaggaauggccccacucgcggaacuggcgcugcaacccaaccuggugcuggggcgucgggaccggcugcacuugcugcgggguggaugugaaggaccucuucacggaccauauguucauaaaauggaaggucgaguacaucaagacugaggccaucguuugcguggagcugaccagccaggagcgccagugcucccugauugaggccggcacgcgcuucaaccucggcccggucacuaucacccuuuccgagccccggaacauccagcagaagcugccgcccgagaucaucacacuccaccccaagaucgaggagggguucuuugacuuaaugcacguccagaaggugcuguccgcgagcacggucugcaagcugcagucgugcacccacgggauccccggggaccugcaaaucuaccacauaggaaaccugcucaagggagaccgccugaacggucaccugauccacaagauagagccccacuuuaacacuagcuggauguccugggauggcugugaccucgacuacuauuguaacaugggagacuggcccagcugcaccuacacgggaguaacgcagcacaaccacgccgccuucgucaaccugcugaacauagagacugacuacaccaagacguuccacuuucacuccaagcgggugaccgcccauggggacaccccgcagcucgaucugaaagcucgccccacuuacggcgccggggagaucacgguucuggucgaggucgccgacauggagcuucacaccaagaagguggagaucucuggcuugaaguucgccucccuggccugcaccggaugcuacagcugcuccagcgggaucuccuguaagguccggauucacguagacgagcccgacgagcucaccgugcacguaaagagcuccgaccccgacguuguggcggccagcacgagccugauggcacgcaagcuggaguucggcaccgacucgaccuucaaggcguucagcgccaugccgaagacaucccucugcuucuacauugucgagcgggaguacugcaagucgugcuccgaggacgacacuaaaaaguguguggacaccaaguuggaacaaccccagagcauccugaucgagcacaaggguaccaucaucggcaagcagaacgacacgugcacagcgaaagccuccugcuggcucgagagcgugaaauccuucuucuacgggcugaagaacaugcugggcagcguauucggcaacuucuucguggggauccuccuguuucuggcccccuucguacuguuaguccuguucuucauguucggcuggaagaucuuauucuguuucaaguguugccgacggacccgcggccucuucaaguacagacacuugaaggacgaugaggagaccggcuaccgcaagaucaucgagcgccugaacuccaagaagggcaagaaccggcuccuggacggggagcgccuggccgaccggaagaucgccgagcuguucagcaccaagacgcacauuggguag

SEQ ID NO: 15335 - RNA, 5052 nt, Artificial Sequence
  derived and/or modified CDS sequence (opt11) from CCHFV(K315_14)__KX013469.1__GP
augcacacccugcucgugugcuucauacuguaccugcagcucagcggcuugggcggcgcccacgggcaauccaacgagacugagcacaacggcacgaacaccaccacgguccccgggacgagccaguccccgaagccgcccgccagcaccacccugcagcacacccccgaguccagcacggugaagcucaccacccccaccucggagacggaaggcuccggcgagaccacucccccgcccaacaccacccagggguugcccccaccgggcacgacacccgagcgcucugcgaccacggccacgagcaccucuagcaccgacaacaugaacuccacaacccaggugaccgacaacacaccaacaagcacggucucgaucagccccucuaguucccccagcaugcccagcacuucccaggggauccacuaccccauccggucacuccucucugugagcagccccaagacaguaacgacccccacccccaucucgcccggugagaugucccccgagacaagcucccaacacagcgccaugucccgcauccccacgcucuacaccgccacucagguuagcaccgaaaacaccaaccgguccacgccccgccaaagugaauccagcgugcaaccggccacacagucccccaucaccucuccagcccaaacuauccuucucaugagugcggccccaaaggccauccaggacaugcacccgagccccacgaaccggagcaagcgcaaccuggaaguggaaaucauccugacccucucccagggacuuaagaaguacuacggcaagauuuuaaaguugcuccaccugacccucgaagaggacacagaaggccugcucgaguggugcaagcggaaccucgggagcaacugugacgacgacuucuuccagaagcgcaucgaagaguucuuuaucacgggcgagggguacuucaacgagguccugcaguuuaagacccuguccacccucagccccaccgaaccgucccacgugaggcugcccacggcggagcccuuuaagucguacuucgcaaaaggcuuccugaguaucgacagcggcuacuucagugccaaguguuacccacgcagcuccaccagugggcuccagcugaucaacgugacucaacacccugcaagaaucgccgagacccccggccccaaaacuaccucccugaagaccaucaacugcaucaaccuccgcgccagcgucuuuaaggagcaccgggagguggagaucaacguccuucugccccagaucgccguuaaccucucuaacugccacgugguaaucaacagccacgucugcgacuacuccuuggacaccgaugggccggugaggcugccccggauccaccaugagggcaccuucauacccgggaccuauaagaucgugaucgacaagaagaauaagcucaacgacagaugcagccuggucaccaacugcguaaucaaaggccgggaggugcgcaagggccagagcguccugcgccaauacaagaccgagauccgcaucgggaaggcauccacgggcagccggaagcuccuguccgaggagcccggcgacgacugcauuagccguacccagcugcuaaagaccgagaccgccgagauccacgacgauaacuacggcggcccgggcgacaaaaucacaauuugcaacggcuccaccguggucgaccagcgccuggggagugagcugggauguuacaccauaaaccgggugaaguccuucaagcucuguaagaauagcgcgacuggcaaaacgugcgaaauugacuccacccccgugaagugccgccagggcuucuguuuaaaaauuacccaggaagggcggggccacgucaagcugagccgcggcuccgaggugguguuagacgucugugacucuuccugcgagaucaugauucccaaggggaccggcgauauccucguagacugcagcggcgggcagcagcacuuccugaaggacaaccugaucgaccucgggugcccccacauaccgcugcugggcaagauggcgaucuacaucugucggauguccaaccacccacgcacgaccauggccuucuuguucugguucucauucggcuaugugauuaccugcaucuucugcaaagcccuguucuacucacugaucaucaucgggacccucggcaagaagaucaagcaguaccgggagcuuaagccacagaccugcacuaucugcgaaaccgcccccgucaacgccaucgacgcggagaugcacgaccugaacugcuccuacaauaucugcccauacugcgcuucccgccuuaccagcgaggggcuagcccggcacguuacccagugccccaagcgcaaggagaagguggaggagacggagcucuaccuuaaccuggagcggauccccuggaucgugcgcaagcugcuccagguuagcgaguccacaggcgucgcccuaaaaaggucuuccuggcuuaucguccuccugguacugcucacaguaucgcuuagccccguccagucagccccggugggccacgggaagaccaucgaaacauaccagacccgcgagggguucacauccaucugccuguucaugcucgggucaauccuguucaucguguccugccugguuaaggggcugguguacagcguguccgacagcuucuuccccgggcugucuguuuguaagaccugcuccaucggcuccaucaacggcuucgagaucgagagucacaagugcuacugcucccuguucuguugccccuacugccgccacugcagcgcggaucgcgagauccaucagcuccaccuguccauuugcaagaagcguaaaaccgggagcaacgugaugcucgccgugugcaagcgcaugugcuucaaggccacuaucgaggcuagccgccgcgcgcuccuuauccgcuccaucauaaacaccacguucgugaucuguauccuaacgcucgcaaucuguguggugagcaccucugccgucgaaauggaggaccugccggccggcaccugggagcgggaggaagaccugaccaacuucugccaccaggagugccaggugacugagaccgagugccucugcccguaugaggcccuggugcugcgcaagcccuuauuccuggacagcaucgucaaggggaugaagaagcugcucaacuccaccucccuggagaccuccuugagcaucgaggcacccuggggcgccaucaaugugcaguccacguucaagccaacagugagcacugccaacaucgcucucuccuggagcuccgucgagcaccgagggaauaagauccuggugaccggccgcagcgaguccaucaugaaacucgaggagcguacgggcguguccugggaccucggggucgaggacgccuccgagaguaagcugcugacgguguccauuauggaucucagccaaauguacagccccguauucgaguaucuguccggugaccgccaggucgaggaguggcccaaggcaaccugcacaggggacugccccgagcguugcggcugcacgagcagcacuugccugcacaaagaguggccgcacagccgcaacuggcggugcaaccccaccuggugcuggggagugggcaccggcugcacaugcugcgggguggacgucaaggaccucuucaccgaccauauguucauaaaguggaagguugaguacaucaaaaccgaggccaucgugugugucgagcugaccucacaggagcgccagugcagcuuaaucgaggcgggcacccgguucaaccucgggcccgugacuaucaccuugucugagccccgcaacauccagcaaaagcugccgccggaaaucaucacgcuccaucccaagaucgaggagggcuucuuugaccucaugcacguucaaaagguccugagcgccuccaccguaugcaagcuccagucuugcacgcacggcauccccggcgaccugcagaucuaccacaucggcaaccugcucaagggggaccgagucaacggucaccucauacacaagauugaaccgcauuucaacaccuccuggaugagcugggacgggugcgaccuggacuacuauugcaacaugggcgauuggcccuccugcaccuacaccggcgugacgcaacacaaccacgccgcguucgugaaccuccugaacaucgaaaccgacuacacaaagaccuuccacuuccacagcaagcgggucacggcccacggggacacuccccagcuggaccucaaggcccggcccaccuacggugccggggagauuaccgugcugguggagguagcggacauggaguugcacacgaagaagguggagaucuccggccucaaguucgccucccugaccugcaccgggugcuacgccugcuccagcggcaucaguuguaagguucgcauacacgucgacgaaccggacgagcugaccgugcacguaaaguccagcgauccggacgucguggccgccuccacgucucucauggcccggaagcuggaguucggcaccgacuccaccuucaaggcuuucagcgccaugcccaagaccucucugugcuucuauauuguggagcgcgaguacuguaaaagcugcuccgaggaugacaccaagaaaugcgucgacaccaagcucgagcagccucagagcauccuuaucgagcacaaaggcaccaucaucggcaagcagaacgacacgugcacggcaaaggccuccugcuggcuggagagugugaagucauuuuucuacgggcuaaagaacaugcugggcagcguguucggguccuucuucgucggcauccuccucuuccuggcgccguucguacugcuggugcuguucuucauguucggcuggaaaauccuguucugcuucaaaugcugccggcgcaccagagggcuguucaaauaccgccaccucaaggacgacgaggagacgggcuaccgccggaucaucgagcgccugaacagcaagaaagguaagaaccggcugcucgauggcgagcgccuggccgaucggaagaucgccgagcuguucuccaccaaaacgcacaucgguuga

SEQ ID NO: 15336 - RNA, 5055 nt, Artificial Sequence
  derived and/or modified CDS sequence (opt11) from CCHFV(BA8402)__AF350449.1__GP
auguacacgccccugcucugcgccgugcugugccugcagcucuggagccuggagggcucccacgggcugagcaacaagacccagcauuccaauaccagcaccaccaaggccccggaagucucccaggagcucgggcugccagugagcaccguguccaccaucaccagcgaaccgcccucaauuaccagcgcggucuccgugucuggguccgagggcagcggggacaccaacacuuccccgagcgucaccacccagggcccaacccugcccgagacgacccuugagccccugaccaccacggacaccgacgccuccagcacggucgugguggacgucuccacgcagacggugaaggauaccccgaucucuaccaccuacaccagccugcccucaacccccagcgagcccaccaccccgcagggaacccaccacaccgcgcgcgggcuccuguccgugacgagcaccaagcccgaggaggcgagcccccaggccaaucccggcaagaucagcauggagacgaacggaccgcggcuggcgaucucugagacccccuccuucucccccaccacccaggcccccacggagaacagcaauccgaucacguccaagcagcucaugcugagcgcccagccagucacccccaaccccaugaccuccccggugcagcccgcccugagccaauccgacaccagcacggcgauacaggacgugcaccccucccccaccggccgcucuaagcggaaccucgagauggagaucauccugacccuaucccaggggcucaagaaguacuacggcaagauucugaagcugcucgaccugacccuggaggaggauacggagggccuccuggaguggugcaagcgcaaccuaggccuagucugcgacgacaacuucuuccagaagcggauagaggaguucuuccugaccggcaaggggcauuucaacgaggugcugcaguucaagaccccgagcacccucagccccacgggccccgcccgcaccggcucgccgaccguggagccuuucaaaagcuacuucgccaagggguuccuguccauggacuccggguacuucuccgccaagugcuauccccgagccagcaacuccgggcugcagcucaucaacgucacccagcacagcacacgcaucaccgacacccccggcccgaagaucaccaaccugaagacgaucaacugcaucaaccugaaggcgucaguguucaaggagcaccgggagaucgagaucaacgugcuccugccccaggucgccguuaaccuaagcuccugucacgugcuuaucaagagccacgugugcgacuacucccuggacaucgacgggcccguucgccugccccggauccaccaugagggcacuuucaucccgggcaccuauaagaucguaaucgacaagaagaacaagcagaacgaccgcugcaccuuggugacgaacugugugaucaaggggcgggaaauccgcaagggacaaagcguccugcggcaguaccgaaccgagaucaagaucgggaaggccuccucgggcucccggcgccugcucagcgaggaaagcggugacgacugcaucucgcggacccaguuacugcgcaccgagacggcggagauccacaacgacaacuacggcggccccggggauaagaucaccaucugcaauggcagcaccgugguggaccagcggcuaggguccgagcucggcugcuacaccaucaaccgcgucaauaguuucaaccugugcgagaacacggccacggguaaguccugugagaucgacagcaccccugugaagugucgccagggcuucuguuuaaagaucacucaggagggccgggggcacgugaagcucucccgcggcagcgaggucgugcuggacgcgugcgaguccagcugcgagaucaugauccccaaagggacgggcgacauccugguggacugcuccggcgggcagcagcacuuccucaaggauaaucugaucgaccugggcuguccgaauaucccccuccuggggaagauggccaucuacaucugcaggaugagcaaccaucccaagaccaccauggccuuccuguucugguucuccuucggcuacgucgugaccugcauccucuguaaagugaucuucuaccugcugaucgucgugggaacacucggcaagaaguucaaacaguaucgcgagcugaagccccaaaccugcaccaucugcgagaccaccccgguuaacgccaucgacgcugagaugcacgaccugaacugcagcuacaacaucugccccuacugcgcaucccggcccacgagcgacggccucgcccgccacgucaugcagugcccaaagcggaaggagaagaucgaggagaccgcccuguaccucaacuuggagcgcaucccguggguggugcggaagcugcugcaggucuccgagagcaccgguguugcacucaaacgcuccagcuggcuggugguccugcucgugcugcugaccgugagccucucccccguccaauccgcccccaucggccaugggaagacaguggagaccuaccaaacccgggagggcuacaccuccaucugccuguucgugcuggggagcauccucuucaucguguccugucugaugaagggccuugucgacagcgugggcaacuccuucuucccuggguuaagcauaugcaaaacgugcuccaucggcagcgucaacggguuugagaucgagucccacaagugcuacugcagcuuauucugcugcccguacugccgccacugcuccgcggaccgggagauacaccgccugcacuugagcauuugcaagaagcggaagaccggcuccaacgugaugcuggccgugugcaagcgcauguguuucagagccaccgucgaggugagcaacaaggcccugcucauacgcaacaucaucaacaccacguucgugcugugcauccugauccucgcggugugcgugguguccacgagcgcugucgagauggagagccugcccgccgggaccugggagcgugaggaggaccugaccaacuucugccaccaggagugccaggugacggaaaccgagugccucugucccuacgaggcccugguccugcgcaagccccucuucagcgacagcaucgucaagggcaugaaaaaccugcugaacuccaccucucucgagaccucccugagcaucgaggcccccuggggcgcgaucaacgugcaguccacguucaagccgaccgugagcgccgccaacauugcccugucuuggagcagcgucgagcaccgcgggaacaagauccucgugagcggccgguccgagagcaucaugaagcuggaggagcgcaccgggaucuccugggaccugggcguggaggacgccagcgaguccaaacuuuugaccgucagcgucauggaccugucacagauguauagccccgucuucgaguaccucuccggggaccgccagguugaggaauggccgaaggcgacgugcaccggcgacugucccgagcggugcggcugcaccagcagcacgugccugcacaaggaguggccccacucccgcaacuggcgcugcaaucccaccuggugcuggggcgugggcaccggaugcacgugcugcggccuggacgucaaggaccucuucacagacuauauguucaucaaguggaaaguagaguacaucaagaccgaggccaucgugugcgucgaacugaccagccaggagcggcagugcacucugaucgaggccggcacccgcuucaaccucgggccggugacgaucaccuuguccgagccccggaacauccagcagaagcugccgcccgaaaucgugacccuacacccccgcaucgaggagggcuucuucgaccugaugcacguccagaaggugcuuagcgcguccaccgugugcaagcuccagagcugcacccacgggguccccggcgaccuccaaguguaccacaucgggaaccugcucaagggcgacaaggugaacggccaccugauccacaagaucgagccccacuucaacacguccuggaugagcugggacgggugcgaccugcacuauuacugcaauaugggugacuggcccuccugcaccuacaccgggguaacccagcacaaucacgccgcguucgucaacaugcucaacaucgagacggacuacaccaagaauuuccacuuccacagcaaacgggugaccgcccacggcgacaccccgcagcuagaccugaaggcccggcccacguacggggccggcgagaucaccguccucguggagguggcggacauggagcugcacaccaagaagaucgagaucuccggccugaaguucgccagcuuaaccugcacggggugcuacgccugcuccagcggcaucuccugcaagguccggauccacguggacgagcccgacgagcugaccgugcacgucaaguccgaggaccccgacaucguggccgccuccagcucccucauggcgcgcaagcucgaguucgggaccgauagcaccuucaaggccuuuagcgcaaugccgaagacgucccugugcuucuacaucguggagcgggaguauugcgagagcugcuccaaggaggacacccagaagugcgucaacaccaagcuggagcagccccagagcauucucauagagcacaagggcaccaucaucgggaagcaauccaacacuugcaccgccaaggcaagcugcuggcuggaguccgucaagagcuucuucuacggccugaagaacaugcuguccggcaucuucgggaacguguuuaucggcguguuuuuauucuucgcgcccuucauccugcugauccucuucuucauguucggguggcgcauccuguucuguuucaagugcugccggcgcacccggggccuguucaaguaccgccaucucaaggacgaugaggagaccggcuaccggaagaucaucgaacgccugaacaacaagaaggggaagaacaagcugcucgacggcgagcgccuggccgaccggaaaaucgccgagcuguucagcacgaagacccacaucggguga

SEQ ID NO: 15337 - RNA, 5055 nt, Artificial Sequence
  derived and/or modified CDS sequence (opt11) from CCHFV(UCCR4459)__KY484032.1__GP
auguacacgccccuccucugugccgugcugugccugcaguuauggagccuggagggcucccacgggcugagcaacaagacccagcacucgaacaccagcaccacgaaggccccggaggucucccaggaguucggccuccccgucagcaccguguccacgaucaccuccgauccgcccagcaucaccagcgcggucuccgugagcggguccgaaggcagcggggauaccaacacgucccccagcgugaccacccagggccugacgcugcccgagacgacccucgagcugcuaaccaccacggacaccgacgccuccagcaccgucgugguggacgucuccacgcagacggugaaggacacccccaucagcacuacccauacgagccuccccaguaccccgagcgccaccaccacgccccagggaacccaccacacagcccgcgggcugcuguccgugaccagcacgaagcccgagggcgccuccacccaggcgaaccccgagaaaaucagcauggagaccaacucaccgcggcucgccaucagcgagacccccuccuucagccccacuacccaagcccccacggagaacuccaacccgaucacuagcaagcagcugauauucuccgcccagcccgucacccccaaucccgugacgccgcccgugcagcccgcgcuuucucaauccgacacgagcaccgccauccaggacauccaccccuccccgaccagccgcucaaagcggaaccucgagauggagaucauccugacgcugagccaggggcucaagaaguacuacggcaagauccugaagcugcucgaccugacgcuggaggaggacaccgaggggcuccuggaauggugcaagcgcaaccugggccucgucugcgacgacgacuucuuccagaagcggaucgaggaguucuuccugacuggcgaggggcacuucaacgaggugcugcaguucaagacgcccaguacccucucacccaccggccccgccagaaccgggagcccgacgguggagcccuuuaaguccuacuucgccaagggauuccugagcauggacucaggcuacuucagcgccaagugcuacccccgggcguccaacucugggcugcagcucaucaacgucacucagcacuccacccgcaucaccgacacgccgggcccgaaggugacuaaccugaaaaccaucaacugcaucaaccugaaggcgucaguguucaaggaacaccgggagaucgagaucaacguccucuuaccccagguggccgugaaucuguccagcugccacguccucaucaagagucacgugugcgacuacagucuggacaucgacgggcccguccgccugccgcggauccaccaugagggcaccuucauccccgggacauacaagcucgugaucgacaagaagaacaaacagaacgaccgcugcacccugaucaccaacugcgugaucaagggccgggagauccgcaagggccaguccguccugcgacaguaccgcaccgagaucaagaucgggaaggccucgucuggcagccggcgccuccugagugaggaguccggcgacgacugcauuagccggacgcagcugucccgcaccgagaccgccgagauccacagcgacaacuacggcggccccggugacaagaucaccaucugcaacggcuccacuaucguggaccagcggcuggggagcgaacuuggcugcuacaccaucaaccgcgugaaguccuucaaacugugcgagaacagcgcgaccgggaaguccugcgagaucgacagcacccccaucaaaugccgacagggcuucugccugaagaucacgcaggagggccggggccacgucaagcucucccgcggcagcgagguggugcuggacgccugcgacuccucaugcgagaucaugaucccaaaagggaccggcgacauacucgucgacugcuccgggggccagcagcacuuccucaaggacaaccugaucgauuugggcugccccaacauaccccuucuggggaagauggccaucuacaucugucggaugagcaaccaccccaagaccaccauggccuuccuguucugguucuccuucggcuacgugaucacgugcauccucugcaaggugaucuucuaccugcugaucgucguggggacccucgggaagaaguucaagcaauaccgcgagcugaagccgcagaccugcaccaucugugagaccacgcccgugaacgccaucgacgcggagaugcacgaccugaacugcucuuauaacaucugccccuacugcgccucacggcucaccagcgacgggcuggcccgacacgucaugcagugccccaagcgcaaggagaagguggaggagaccgagcuguaccucaaccuggaaaggaucccaugggugguccggaagcugcuacaggugagcgaguccaccggcguggcccugaaacgcagcuccuggcuggucgugcucuuagugcugcucacugucagccugucccccgugcagagcgcccccaucggccacgggaagacaguggagacguaccagacccgggagggcuacacguccauaugcuuguucguccucgggagcauccuguucauagugucgugccugaugaagggccucguggacagcguuggcaacagcuucuuccccggccugagcaucugcaagaccuguuccauaggcagcaucaacggguucgagaucgagucucacaagugcuacugcagccuguucugcugcccguacugccgccacugcuccgcggacagagagauccauaagcuccaccuaagcaucugcaagaagcgcaagaccggguccaacgugaugcuggcggugugcaagcgaaugugcuuccgcgccaccgucgaggugagcaacaaggcccugcugauccggaacaucauuaacacgaccuucguagucugcauccugauccucgcggugugcguggucagcaccuccgccguggagauggagagccugcccgcugggaccugggagcgcgaggaggaccugacgaacuucugccaccaggagugccaggugaccgagaccgagugccucugccccuacgaggcccugguccugcggaagccccucuucuccgacagcaucgugaaggguaugaagaaccugcugaacuccaccagccucgagacgucccugagcaucgaggccccguggggcgcgaucaacgugcaguccaccuucaagccaaccgucagcgccgccaacaucgcccuguccuggucuuccguggaacaccgcgggaacaagauccucgugagcggccgauccgagagcaucaugaaacuggaggaacggaccgggaucuccugggaccugggcgucgaggacgccagcgaguccaaacuccugacagugagcaucauggaccuaagccagauguacucccccgucuucgaguaccucucgggggaccgccagguagaggaguggccgaaggcgaccugcaccggcgauugccccgagcggugcgggugcaccuccagcacgugcuuacauaaagaguggccccacucccgcaacuggcggugcaaccccaccuggugcuggggcgugggcaccgggugcacgugcugcggccuggacgucaaggaccuuuucaccgacuacauguucgugaaguggaagguggaauacaucaagaccgaggccauugucugcguggagcugaccagccaggagcgccaguguucccugaucgaggccggaacccgguucaaccucggcccgguaacgaucacccugagcgagccucgcaacauccagcagaagcugccgcccgaaaucgucacccuccacccucggaucgaggagggcuucuucgaccugaugcacgucaagaaggugcuguccgccagcaccgucugcaagcuccaguccugcacgcacggagugcccggcgaucuccagguguaccacaucgggaaccugcucaagggcgacaaggucaacgggcaccugauccacaagaucgagccccacuucaacacgagcuggauguccugggacggcugcgaccuggacuacuacugcaacaugggcgacuggcccagcugcuccuacaccggggugacccagcacaaccacgccgcauucgugaacaugcucaauaucgagaccgacuacacgaagaucuuccacuuccacagcaagcgcgucaccgcccacggggacaccccgcagcuggaccugaaggcccggcccaccuacggggccggcgagaucacggugcucgucgaggucgcggacauggagcuccacaccaagaagauagagauauccgggcugaaguucgccagccugaccugcaccggcugcuacgccugcuccagcgggauuagcugcaaggugcgcauccacgucgacgagcccgacgagcugacgguccacgugaaguccgaggacccagacauuguugccgccaguuccagccugauggcgcggaagcucgaguucgggaccgacuccaccuucaaagccuucagcgccaugccgaagaccucccugugcuucuacaucgucgagcgcgaguacugcaagagcugcuccaaggaggacacgcagaagugcguaaacaccaagcuggaacagccccagucaauccucauagagcacaagggcaccaucaucgggaagcagaacgacacgugcaccuccaaggccggcugcuggcuggagagcgugaaguccuucuucuacgggcugaagaacaugcugagcggcaucuuuggcaacgucuucaucgggaucuuccucuuccuggcccccuucauccugcucauccuguucuucauguucggcuggcguauucucuucuguuucaagugcugccgcagaacgcgcggccucuucaaguacaggcaccugaaggacgaugaggagaccggcuaccgcaaaaucaucgagcgccugaacaauaagaagggcaagaacaagcuccuggacggggaacgccuggcggaccgcaagaucgcugagcuauucuccaccaagacgcacauuggcuga

SEQ ID NO: 15338 - RNA, 5052 nt, Artificial Sequence
  derived and/or modified CDS sequence (opt11) from CCHFV(Ast149)__KX056054.1__GP
augcauacccugcuagugugcuucauccuguaccugcagcucagcggccucgggggcgcccaugggcaguccaacgccacggagcacaacggcacgaacaccaccaccgcgcccgggacgucgcaguccccgaagccgcccgccagcaccaccccgccucacacccccgaguccagcacggucaagcugaccaccccgaccuccgaaacggaggggagcggcgagaccacacccccgcccaacaccacgcaggggcugccgccgcccggcaccacccccgagcgccccgccacgacggcaaccuccaccagcuccaccgacaacaugaacagcacgacccaggugaccgacaacacgcccacuuccaccgugagcacaucccccagcuccagccccuccaugcccagcaccagccaggggauccacuaccccguccggucccugcugagcguguccagccccaagacggugaccacccccacccccaugucgcccggcgagaugagcccggagacguccagccagcacuccgccaugagccgcauucccacccucuacaccgcggcccaggucucgaccgagaacgccaaccggagcacaccccgccagucagagagcuccgcccagcccgcgacgcagagcccgaccaccuuccccgcgcagacgauccugcugauguccgccgcucccaaggcgauccaggacaugcacccgagcccaacgaacagauccaagcgcaaccucgagguggagaucauccucacccugagccaggggcucaagaaguacuacggcaagauccugaagcugcuccaccugacccuugaggaggacaccgaaggccuccuggaguggugcaagcggaacuuggguagcaacugcgacgacgacuucuuccagaagcgcauagaggaguucuucaucacgggcgagggcuacuucaacgaggugcuccaauucaagaccuuauccacccugagccccaccgagcccucccacguccggcuuccgacggcggagccauucaagucguacuucgccaagggcuuccuguccaucgacagcgguuacuucuccgccaagugcuacccccguagcuccaccagcgggcugcagcucaucaacgugacccagcaccccgcccggaucgccgagaccccgggccccaagacgaccagucugaagaccaucaacugcaucaaccugcgcgcgagcguguucaaggagcaccgggaggucgagaucaacguacuccugccccagaucgccgucaaccuauccaacugccacgucgucaucuacagccacgugugcgacuacucccucgacaccgacggacccguccgucugccucggauccaccacgagggcacguucauccccgggaccuacaaaaucgugaucgacaaaaagaauaagcugaacgaccgcugcagccucgugaccaacugugugauuaagggccgggaggugcgcaagggccaguccgugcugcggcaguacaagaccgagaucaagauugggaaggccagcacgggcagccgcaagcugcucagugaggagccaggggacgacuguaucagccggacccagcugcugaagaccgagaccgccgagauacacgacgacaacuacggcgggcccggcgacaagaucacgaucugcaacggcuccacgaucguggaccagcgccucgggagcgaacugggcuguuacaccaucaacagagugaaguccuucaagcugugcgagaacucggccaccgggaagacgugcgagaucgacuccaccccggucaagugccgccagggcuucugccucaagaucacccaggaggggcgcggccacgugaaacugagccggggcuccgaggugguccuugacgcgugcgacagcuccugcgagaucaugauccccaaggguaccggcgacauccugguggacugcagcgggggucagcaacacuuucucaaggacaaccugaucgaucugggcugcccacacaucccccuccuggggaagauggccaucuacaucugucgcaugucuaaccacccgcggacgaccauggccuuccuguucugguucagcuucggauacgugauuaccugcaucuucuguaaggcccucuucuacucccucaucaucauugggacccugggcaagaagaucaagcaguaccgcgagcucaagccccagacuugcacgaucugcgagaccgcuccggucaacgccaucgacgcagagaugcacgaccugaacugcagcuacaacauaugccccuacugcgccucccggcugaccagcgacgggcucgcccgccacgugacccagugcccgaagagaaaggagaagguggaggagacggaacuguaccuaaaccucgagcgcauucccuggaucguccggaaacuucuccagguguccgagagcaccgggguggcgcugaagcgcagcuccuggcuaauuguacuacucgugcugcugaccgugagccucucgcccguccagagcgccccggugggccacgggaagaccaucgagacguaccagacccgggaaggcuucaccaacaucugccuguucaugcuggggagcauccucuucaucgugucuugccuggucaagggauuaguggacuccgugagcgacuccuucuuccccgggcucagcgugugcaagaccugcuccauuggcagcaucaacggcuucgagauugagucccacaaaugcuacuguagccuguucugcugcccuuacugccgccacugcuccgccgaccgggagauccaccagcugcaccucgggaucuguaagaagcgcaagacgggcagcaacgugaugcuggccgugugcaagcggaugugcuucaaggccaccaucgaggcgucccgccgggcccugccgauaagaucgaucaucaacaccaccuucgucaucugcauccucacgcuggccaucugcgugguguccaccagcgccgucgagauggagaaccugccggccgggacgugggagcgcgaggaggacuugaccaacuucugccaccaggagugccaggucacggaaaccgagugccugugccccuacgaagcucugguacuccggaagcccuuguuccuugauagcaucguaaagggcaugaagaaucuccugaacuccaccagccuggagaccucccucagcaucgaggcccccuggggcgcaaucaacgugcagaguacguuuaagccgaccgugagcaccgccaauaucgcccuguccuggagcuccgucgaacaccgcgggaacaagauucuugugaccggccggagcgaguccaucaugaagcucgaggaacgcacgggggugagcugggaccugggcgucgaggacgcguccgagagcaagcugcucaccguguccauaauggaccugagccagauguauuccccaguguucgaauaccugagcggggaccggcaggucgaggaguggcccaaggcgacgugcacgggcgacugucccgagcgcugcgggugcacguccuccaccugucuccacaaggaguggccgcacagccggaacuggcgcugcaaccccaccuggugcuggggcgugggcaccgggugcacgugcugcggcguggacgucaaggaccuguucaccgaccacauguucaucaaguggaagguggaauacaucaagaccgaggccauagugugcgucgagcugaccagccaggagcggcagugcagccucaucgaggccgggacccgcuucaaccugggccccgugacgaucaccuuguccgagccccguaacauccagcagaagcucccgcccgaaaucaucacccugcacccaaagaucgaggagggcuucuucgaccugaugcacgugcagaagguccucagcgcguccaccgugugcaagcugcagagcugcacucacgggauccccggggaccugcagaucuaccacaucgggaaccuccugaagggcgaccgccugaacgggcaccucauccacaagaucgagccgcacuuuaacaccuccuggaugagcugggauggcugcgaccuggacuacuacugcaauaugggcgacuggccauccugcacguacaccggagugacgcagcacaaccacgccgccuucgucaaccugcucaacaucgagaccgacuacaccaagacuuuccacuuccacagcaagcgggugacggcccacggcgacacgccccagcuagacuugaaggcccgccccaccuacggagcgggcgagaucaccguccucguggagguggccgacauggagcugcacaccaagaaggucgagguguccgggcugaaguucgccagccucgccugcaccggcugcuacgccugcuccagcggcauauccugcaaggugcggauccacgucgacgagccggacgaguuaacugugcacgugaagucuuccgacccggacgucguggcugccagcaccucccugauggcccgcaagcucgaguucgggacggacagcaccuucaaggccuucagcgccaugcccaagaccucccugugcuucuacaucguggagagagaguacugcaagagcugcuccgaggacgacaccaaaaagugcgucgacacgaagcuggagcagccccaguccauucucaucgagcacaagggcacaaucaucgguaagcagaacgauaccugcacagcgaaggccuccugcugguuggagagcgugaagaguuucuuuuacggccuuaaaaacaugcuagggagcguguucggcaacuucuucgucggcauccugcuguuccucgccccguucgugcugcuggcccuguucuucaucuucggguggaagauccucuucugcuucaagugcugccgccggacgcgcggccuguucaaguaccggcaccuuaaggacgacgaggagaccggguaccgcaagaucaucgagcgacucaacuccaagaaaggcaagaaccggcuguuagacggcgaacgccucgcggaccggaagaucgccgagcuguucagcaccaagacccacaucggguga

SEQ ID NO: 15339 - RNA, 5052 nt, Artificial Sequence
  derived and/or modified CDS sequence (opt11) from CCHFV(Ast137)__KX056057.1__GP
augcacacccuccucgugugcuucauacuguaccuccagcucagcggccucggcggggcucacgggcagagcaacgcuaccgagcacaacgguaccaacacaacgaccgucccagggacaagccaguccccgaagccgcccgcgucaaccacccucccccacacccccgaguccagcaccgugaaacucaccacucccaccuccgagaccgaggguucuggcgaaaccacgccuccgcccaacaccacccagggacugcccccacccggcaccaccccagagcgccccgccaccacggccaccuccacuagcuccaccgauaacaugaacagcacgacccaggugacagacaacaccccuaccuccaccgucucaauauccccuagcuccagcccguccaugccgagcaccagccaggggauccacuaucccgugcggucauugcucagcgugucuagccccaagaccguuacgacccccaccccgaugucacccggugagaugagccccgagaccaguagccagcauuccgcuaugagccgcaucccgacucuguauaccgccgcccaaguguccaccgaaaacaccaaccggucaacaccccggcaguccgaaagcagcgcacagcccgccacgcagagccccaccaccuucccggcccagaccauccugcuuauguccgcggcucccaaggcuauccaggacaugcaucccagcccgaccaaucgguccaagcgcaaccuggaaguggagauuauucugacccucagccaggggcugaagaaguacuacggcaagauccugaagcuccugcaccugacccucgaggaggacaccgagggccuccuggaguggugcaagcggaaccuugggagcaacugcgacgacgacuucuuccagaagcgcaucgaggaguucuucauuacuggggagggauauuucaacgagguccugcaguucaagacccuguccacacucagccccaccgagcccucccacgugcggcugcccacagccgagccguucaaauccuacuuugccaaaggcuuccuguccaucgacagcgguuacuucuccgcgaagugcuacccccgcuccucuacgagcggccuccaacugauuaacgugacccagcauccggcccggauagccgagacccccggcccgaagacgaccucgcugaagaccaucaauugcaucaaccucagggccagcguuuucaaggagcaccgcgagguugagaucaacguguuacugccccagaucgccguaaaccucuccaacugccacguugugaucaacagccacgucugcgacuacucccuggacaccgacggacccgugcgccugccccggauccaccaugaaggcacguucauuccgggcaccuacaaaaucgugaucgacaaaaagaacaagcucaacgaccgcugcagccuggucaccaacugcguuaucaagggucgcgagguaagaaagggccaguccguccugcggcaauacaagaccgaaaucaagauugggaaggcgagcacgggcagccgcaagcuacuguccgaggagccuggggacgacugcaucagccggacccagcugcucaagaccgagaccgccgagauccacgacgacaacuacggcgggccuggcgacaagaucacgaucugcaacggcuccacuaucguggaccagcgccuggggagcgagcugggcugcuacaccaucaaccgcguaaaguccuucaaacuuugcgagaacuccgccacagggaagacgugcgagaucgacucuacacccgugaagugccggcagggcuucugccugaagaucacccaggaggggaggggccaugugaagcugagccggggcucggaggucguguuagaugccugcgacucuuccugcgagaucaugaucccaaagggaaccggcgacauccucguggacugcuccgggggacagcagcauuuucugaaggacaaccugaucgaccucggcuguccccacaucccccugcuggggaagauggccauccacauuugucgcaugucgaaccacccccggacgaccauggcguuccucuuuugguucaguuuuggcuacgucaucacgugcaucuucuguaaggcacuguuuuauucacugaucauuaucgggacccucggcaagaagaucaagcaguaccgcgagcugaaaccgcagaccugcacgauuugcgagaccgcccccgugaacgcaaucgacgccgagaugcacgaccugaacugcagcuauaacaucugccccuacugcgcgagccggcugacuagcgacgggcuggcccgccacgugacccagugccccaagcggaaggagaaggucgaggagacagagcucuaccucaaccuggaacgcaucccguggaucgugcggaagcugcuccaggugucagaaaguaccgguguagcccugaagcgcagcuccuggcugaucgugcuucucgugcugcuaaccguaagccugucacccgugcagagcgcccccgugggccaugggaagaccauagagacguaccagacucgggagggcuucaccaauauaugucuguucaugcucggcuccauccuguucaucgucaguuaccuuguaaagggucucguggacuccgucagcgauuccuucuucccggggcucagcgugugcaagaccugcuccaucggcagcaucaacggcuucgagaucgagucccacaaguguuacugcagccuguucugcugccccuacugccgccauugcuccgcggaccgagagauccaccagcuccaccuggggaucugcaagaagcgcaagacgggcagcaaugugaugcuggcggucugcaagcggaugugcuucaaggccaccaucgaggccucccggcgggcccuccugauucguuccaucaucaacaccaccuucguuaucugcauucuuacguuggcgaucugcguggucucgaccucugccguggagauggagaaccugcccgcagggaccugggagcgagaggaggaccugaccaacuucugccaccaggagugucaggugacggagaccgaaugccucugccccuacgaggcccugguccugaggaagccucuguuccuggacaguaucgugaagggcaccaagaaccugcucaacuccaccagccuggagacgucccugagcaucgaggcccccuggggcgcgaucaauguacagucuaccuucaagcccaccguaagcaccgccaacauugcccucuccuggagcucaguggagcacaggggcaacaaaauccuggugacgggccggagcgaguccaucaugaagcuggaggaacgcaccggggucucuugggaccucgggguggaagaugccucugaaagcaagcugcugaccguauccaucauggaucucagccaaauguacuccccggucuucgaguaucugagcggggaccgccagguggaggaguggccgaaggcgaccugcacgggcgacugccccgagcgcugcgggugcaccuccuccacgugccuacacaaggaguggccucacagcaggaacuggagaugcaacccuaccuggugcuggggcgugggcaccgggugcacgugcugcggcguagacgugaaggaccucuucaccgaccacauguucaucaaguggaagguggaguacaucaagacagaggccaucgucuguguggagcugaccucccaggagcgucagugcagccugauagaagccgggacgcgcuucaaccucggcccggugacaaucacacuuuccgagccgcggaacauccagcagaagcugccucccgagaucaucacccuccacccgaaaaucgaagagggcuucuuugacuuaaugcacguccagaagguucugagugccuccacggugugcaagcuccaaagcugcacccacgggauccccggcgaccugcagaucuaccacaucgguaaccugcucaagggcgaccgccuaaacgggcaccugauccacaagaucgagccacacuuuaacaccuccuggaugagcugggaugggugcgaccucgacuacuacugcaacaugggcgacuggcccuccuguaccuacacgggggucacccagcacaaccacgccgcguucguaaaccugcugaacauagagaccgacuacaccaagacguuucacuuccacagcaagagggucacagcccacggagacaccccgcagcucgaucugaaggcccgcccuaccuacggggccggagagaucacugugcugguggaggucgccgacauggagcuccacaccaagaagguggaggucuccgggcugaaauucgcaagccuggccugcaccggcugcuaugcgugcuccagcggcaucuccuguaaggugcgcauccacgucgacgagcccgacgagcucaccgugcacgucaagagcuccgaccccgacguaguggccgccagcacgucccugauggcgcgcaagcuggaguucggaacagacagcacauucaaagccuucagcgccaugccgaagaccucccuuugcuucuacaucgucgagcgggaauacuguaaaagcugcuccgaggacgacaccaagaagugcguggacaccaagcuggagcagccccagucaauccugaucgagcacaagggcaccauuaucgggaagcagaacgacacuugcacagccaaagccuccuguuggcucgagagcgugaaguccuuuuucuacgggcugaagaacaugcuggggucagucuuuggcaacuucuucgucggcauucuccuguuccuggcgccuuucgugcugcucguccuguucuucaucuucggguggaagauccuguucugcuucaagugcugccgccgcacccgcggccucuucaaguaccggcaucuaaaagacgacgaggagaccggguaucgcaagaucaucgagcgccugaacuccaagaagggcaagaaccggcuccuggacggcgagaggcuggccgaccggaagaucgcagagcuguucagcacaaagacgcacaucggguga

SEQ ID NO: 15340 - RNA, 5055 nt, Artificial Sequence
  derived and/or modified CDS sequence (opt11) from CCHFV(C-68031)__DQ211629.1__GP
auguacacgccccugcucugcgccgugcugugccugcagcugugguccuuagaggguucccacgggcugaguaacaagacccagcacucuaacaccucgaccaccaaggccccggaagucucccaggaguucggccuccccgugucgaccguguccacgaucaccagcgauccgcccuccaucaccucagcugucuccgugagcgguuccgagggcagcggugacaccaacacgucccccagcgugaccacccagggccugaccuugcccgagacgacccucgagcugcugaccacaacggacaccgacgccuccagcaccgucgugguugacgucuccacccaaacgguaaaggacacccccauaagcaccacccacacgagccuccccuccaccccguccgcccccacgacgccccagggcacccaccacaccgcccgcgggcugcuguccgucaccagcaccaagcccgagggcgccuccacgcaggcgaacccggagaagaucaguauggagaccaauagcccccggcucgccaucuccgaaacccccucguucagccccaccacgcaggcgccgaccgagaacuccaaccccaucacuagcaagcagcugauccuguccgcccaacccgucacgcccaacccagugaccccgcccgugcagccagcgcugagccaguccgacacgagcaccgccauccaggacauccacccuucccccaccagccgcagcaagcggaaccuggagauggagaucauccugaccuuaagccagggucugaagaaguacuacgguaagauccugaagcuccuugaucugacgcucgaagaggauacugagggacugcuggagugguguaagcgcaaccucggccuggugugcgacgacgacuucuuccagaagcggaucgaggaguucuuucugaccggcgaggggcauuucaacgaggugcuccaguucaaaacacccagcacgcugucccccaccggcccggcccgcacggggagcccgaccguggagcccuucaaguccuauuucgccaagggcuuccugagcauggacaguggguacuucagcgccaagugcuacccgagggcguccaacagcgggcuccagcugaucaacgucacgcagcacuccacccgcaucaccgacacuccgggccccaaggucacgaaucugaagaccaucaacugcaucaaccucaaggcuagcgucuucaaggagcaccgggagaucgagaucaacguccugcugccccagguggccgugaaccucuccagcugccauguccugaucaagucccaugugugcgauuacagccuggauauugacggucccguccgccucccccggauccaccacgagggcacauuuauccccgggaccuacaagcuggugaucgacaagaagaacaagcagaacgaccgaugcacgcugaucaccaacugcgugaucaaaggucgggagauccgcaagggccaguccguccuccggcaguaccguaccgagaucaagaucgggaaggccucauccggcagccgccggcugcugagcgaggaguccggggacgacugcaucagccggacccaacugagcaggaccgagaccgccgagauacacagcgacaacuacggcggucccggcgacaaaaucacaauuugcaacggaucgacgauaguggaccagcgucuagggagcgagcugggcuguuacacgaucaaccgagugaagucguucaagcugugcgagaacagcgcgaccgggaaguccugcgagauugacagcaccccgauuaaaugccgccagggcuucugccucaaaaucacucaggaggggagaggccacgucaagcugucccgcggcagcgaagucguccuugacgccugcgacuccagcugcgagaucaugauccccaaggggacgggcgacauacucgucgauugcuccggcgggcagcagcacuucuugaaggacaaccugaucgaccuagggugccccaacaucccccugcugggcaagauggcaaucuacauuugcaggaugagcaaucacccgaagaccaccauggccuuccucuuuugguucucuuucggauacgucaucacgugcauccugugcaaggugaucuucuaccugcucaucgucguggggacccuggggaagaaguucaagcaguaccgcgagcugaagccccagaccugcaccaucugcgagaccacccccgugaaugccaucgacgccgagaugcaugaccuaaacugcagcuacaacaucugccccuauugcgccucccgacugacgagcgaugggcuggcccgccacgucaugcagugcccgaagcggaaggaaaagguggaggagaccgagcucuaccuaaacuuagagcgcauccccugggugguccggaaacuccuccaggugagcgaguccacaggcguagcccugaaacgcagcuccuggcucguagugcugcugguguugcugaccguaucgcuguccccagugcagagcgcacccaucggccacggaaagacgguggagaccuaccagacccgggagggcuacaccuccaucugccucuucguccuggggagcauuuuauuuaucguguccugcuuaaugaaggggcuaguggacagcgucgggaacuccuucuucccugggcuuagcauaugcaagacgugcuccaucggcagcaucaacggguucgagaccgaaagccacaagugcuacuguagccucuuuugcugccccuacugccgccacugcuccgcggaccgugagauccacaagcugcaccugagcaucugcaagaaacgaaaaaccggcuccaacgugaugcucgccguaugcaagcggaugugcuuccgcgccaccgucgagguaagcaacaaggcccugcugauccggaacaucaucaacacuaccuucguggucugcauccucauccuggcagugugcguggucagcacuucugccguggagauggagagucugcccgccggaaccugggagagagaggaggaccucacgaacuucugccaccaggagugccagguuaccgagacggagugccugugccccuacgaggcccugguccuacggaaaccgcuguucuccgauagcaucgugaagggcaugaagaaccugcucaauucuaccagccuggagacgucccuaagcaucgaggcccccuggggagcgauuaacgugcaguccaccuucaagcccacugucagcgccgccaacaucgcccucuccuggagcuccguagagcaccgcgggaacaagauccuggugagcggccgcuccgagucgaucaugaagcuggaggagcggaccgggaucuccugggaccucggcgucgaggaugccagcgaguccaagcuacugacggugagcaucauggaccucagccagauguacuccccgguguucgaguaccuguccggggaccgccaggucgaggaguggcccaaggcgaccugcaccggcgacugucccgagagaugcgggugcaccuccagcacgugccugcacaaggaguggccccauucucgcaacuggcggugcaauccgaccuggugcuggggcgugggcaccgggugcacguguugcggccuggacgucaaggaccuguucaccgacuacauguucgugaaguggaagguggaguacaucaagacugaggccaucgucugcguugagcuaaccagccaggagcgccagugcucccucaucgaggccgggacucgguuuaaccugggacccgugaccaucacccugagcgagccccgcaacauccagcagaagcugcccccggagaucgucacccugcaucccaggaucgaggagggcuucuucgaucugaugcacgugaagaaagugcuuuccgccagcaccgugugcaaacuucaaucuugcacccacggggugcccggcgaucuccaaguguaccacaucggaaaccugcugaagggcgacaaggucaacgggcaccugauccacaagaucgagccccacuucaacacgucauggauguccugggacggcugcgaccucgacuauuacugcaacaugggcgacuggccgucguguaguuacaccggcguaacccaacacaaccacgccgcguucgugaacaugcugaacaucgagaccgauuacacgaagaucuuccacuuccacagcaagcgcgucaccgcccacggggacacgccccagcuggaccucaaggcccggcccaccuacggggccggagaaaucaccgugcugguggaagucgcggacauggagcuacacaccaagaagauagagaucuccggacucaaguucgccagccugaccugcacgggauguuacgccugcuccagcggcaucagcuguaaggugcgcauccacgucgacgagcccgaugagcugacgguccacgugaaguccgaggacccggacaucguagccgccucauccucgcucauggcgcggaagcuggaguucgggaccgacuccacauucaaggccuucagcgccaugccuaagaccucccucugcuucuacaucgucgagagggaguauugcaagagcugcuccaaggaggauacgcagaagugcgugaacaccaagcuagagcagccccagagcauacugaucgagcacaagggcaccauuaucgggaagcagaaugacacgugcaccuccaaggcagguugcuggcuggagagugugaaguccuucuucuaugggcugaagaacaugcucagcggcaucuucgggaacgucuucaucgggaucuuccuguuccuggcccccuucauccuccugauacuguucuucauguuuggcuggcggaucuuauucugcuucaagugcugccggcggacccggggccuguucaaguaccggcaccugaaagacgacgaggaaacgggcuaccgcaagaucaucgagcggcucaacaacaagaagggcaagaacaagcugcuggacggggagcgccucgcggaccgaaagaucgccgagcuguuuuccacgaagacgcacaucggguaa

SEQ ID NO: 15341 - RNA, 5052 nt, Artificial Sequence
  derived and/or modified CDS sequence (opt11) from CCHFV(K340_6)__KX013475.1__GP
augcacacgcuacuugucugcuucauccuuuaucuccaacuaagcggacuaggaggcgcccacguucaaagcaacgccacugaacacaacggaaccaauacaaccacggcaccgggcaccucucaguccccuaaaccuccagcguccacgacacuaccacacaccccggagucgucuacaguaaaaccaaccaccccaaccuccgagacagaaggcucuggcgaaacaaccccaccacccaacacaacccaagggcuuccucccacaggaaccacccccgaacgcucagccacuaccgcuaccagcaccagcaguacagacaauaugaacucuaccacgcaaguaacagacuccacccccaccuccacugugucaaccucccccucguccaguagcuccaugcccagcacaagucaaggcauacaccaccccguccgcucucuacuuagcguaucuucacccaaaacaguaacaacgcccaccccaauguccccaggugaaaugucccccgaaacaucaucccagcacuccgccaugucccgcguacccacucuauacacugcaacucaagucuccacagaaaacacagauagaucaacuccacgccaaucagaaucgaguguccaacccgccacacaauccccaauuaccagcccggcacagaccauauuacuuaugagcgccgcccccaaggcgauacaagacaugcaccccuccccgaccaaccgaucuaagagaaaucuggagguagagaucauccuuacgcugucacagggcuugaagaaauauuacggcaaaauccucaaacuucuccaccucacacucgaggaagauacggaaggccuacucgaaugguguaaacggaaccucggauccaacugcgacgaugacuuuuuccagaaacgcaucgaggaguucuucauuacgggcgaaggauauuucaacgaaguccuacaauucaaaacccuauccacgcuuucaccaacugaacccucccacgugcgucuaccaacggcagaaccguuuaaaaguuacuucgcgaaaggcuuccuaagcauugacuccggauauuucagcgccaaaugcuacccacgcuccucuacauccggucuacaacuaauaaacgucacacaacaccccgcccguaucgcagaaacccccggccccaagacuacaucccucaagaccaucaacugcaucaaccuccgugcgagcgucuucaaagaacaccgugagguugagaucaacgugcuacuaccacaaaucgccgucaaccugagcaacugccacguuguaaucaauucccacgucugcgacuacucccuagacacugacgggcccguaagacugccgcgcauccaccacgaaggcaccuucauaccgggcaccuacaaaaucgucauugaccgaaagaacaagcucaaugaccgcugcagccuugugaccaauugcgucaucaagggacgagaaguccgaaagggccaaagcguccuccgccaauacaagacugagauaaaaauuggcaaagccucaaccgggucucgaaaacuacuaagugaggaaccaggcgacgauugcaucagccgcacacaguuacuuaaaacggaaacugcagaaauccaugacgacaauuacggaggacccggagauaaaauaacaauaugcaacgguagcacuauaguagaucaacggcugggcuccgaacuaggcugcuacacgauaaaucgcgucaaauccuuuaaacucugcgagaacagcaccacaggaaagaccugcgaaauagacuccaccccuguuaaauguaggcaaggauucugucuaaagauaacccaagaaggucgcggacacguuaagcuaucccgcggcucagaagucguauuagacgccugcgauagcuccugcgaaauaaugaucccuaaaggcaccggagacauacuggucgauugcagcggaggccagcaacacuuucucaaagauaaucuaaucgaccuaggaugcccucacauaccaccccuugguaagauggcaaucuauaucugccguaugucaaaccacccccguaccaccauggcuuucuuauucugguucagcuucggauacgucauaacaugcauauucugcaaagcgcuuuucuacucacucauaauaaucggcacucucggaaagaaaaucaagcaauaccgggagcugaaaccccagacaugcaccaucugugaaacagcaccuguaaacgccaucgacgcugaaaugcaugaucuaaacugcagcuacaacaucugccccuacugcgcuagccgccucacaucugacggccucgcccgucauguaacccaaugucccaaacggaaagagaaagucgaagaaacagaacucuacuuaaaccucgaacgcaucccauggauaguccgaaaacuacuccaagucucagaaagcaccggcguagcacuaaagcguucuuccuggcucaucguccugcuggugcuucuuacgguuucacuaucuccgguccaaagcgcgcccgucggccacgggaaaacgaucgaaaccuaccaaacacgcgaaggauucaccucuaucugucuuuucaugcuaggcuccauucucuucaucguaagcugccucgucaaaggccuugucgacucagucucugauuccuucuucccuggucugucggugugcaagaccuguucgaucggcucaauuaacggcuucgagauagaaagccacaaaugcuacugcucccuguucugcugcccauacugccgacacugcagcgccgauagagaaauccaucaacugcauuuaucaauuugcaagaaacgcaaaaccgguagcaacguaaugcucgcgguaugcaaacgcaugugcuuuaaagccaccaucgaggcuucacgccgcgcacuccucauccguuccaucauuaacacuacauuuguaaugugcauauuaacccuagccauuugcgucgucagcacaucugcagucgaaauggaggaccuucccgcaggaaccugggaacgcgaggaagaccugaccaauuucugccaccaggagugccaaguaacugaaaccgaaugucucuguccguacgaagcgcuaguccuacgaaaaccacuuucacuugauagcauuguaaaagguaugaaaaacuuacucaauagcacgagccuagagacaucgcucuccaucgaggcaccauggggugcaauaaacguacaaagcaccuucaaacccaccgucucuaccgcaaacaucgcacucucauggucuucaguagagcaccgcgggaacaaaauccuuguaacaggacgaagcgaaucuaucaugaaacucgaagaacgaacuggaguauccugggaccuaggcgucgaggacgccucugaauccaaacuauuaaccguaagcaucauggaccucucucagauguauuccccagucuuugaauaccucucuggcgaccgccaaguugaagaguggcccaaagccacauguacgggcgacugccccgagcgaugugggugcacaucuucaaccugccuacacaaggaauggccccacucgcggaacuggcggugcaacccaacuuggugcuggggcgucggaacgggauguaccugcugcgguguugacguaaaagaccucuucacugaccacauguucaucaaguggaaagucgaauauaucaaaacagaagccaucguaugcguggagcucacgucccaggagcggcaaugcucccuaaucgaggcugguacgagauucaaccucgggcccguaaccauaaccuuaucagaaccuagaaacauacaacaaaaguuaccaccggaaaucauuacucuccaucccaaaaucgaagagggguuuuucgaccucaugcacguccagaagguacucucugcauccaccgucugcaaacuccagucuugcacccauggcauaccuggggaucuccaaauauaucacaucggcaaccuacucaaaggcgaucgcguaaacggccacuuaauacacaagaucgaaccucacuucaacacaucuuggaugagcugggacggaugcgaccuggacuacuacugcaacaugggugacuggccaucgugcacuuauaccggugucacacagcacaaccacgccgccuucguuaaccuuuuaaacaucgagacggacuauaccaagacauuccauuuucacagcaaacgggucaccgcacauggcgacacaccccaauuagaucuaaaggcacgccccaccuauggcgccggagagauaaccguacuggucgaggucacagacauggaacuccacaccaagaaaguagaaaucucuggucucaaauuugccagucuuaccuguaccggaugcuacgccugcuccuccggcaucucuuguaaaguccguauacacgucgacgagcccgacgaacugacaguccacguaaagagcagcgacccagacguggucgcugccagcaccucacucauggcgcgcaaacucgaguucggaaccgacuccaccuucaaggcauucucagccaugcccaaaacaucacucugcuucuacauagucgaaagagaauauugcaaauccuguagugaagacgacaccaagaaaugcgucgauaccaaacucgaacaaccacagaguauccucaucgaacacaaaggaacaauaaucggcaaacagaacgauaccugcacugccaaggccucauguuggcucgagagcgugaaaucauucuucuacgggcuuaaaaauaugcuaggaagugucuucggauccuucuucguaggaauccuccuauuccuagccccauucgugcuccucguccucuucuuuauguucggcuggaaaauacuuuucugcuucaaauguugccgccgcaccagaggacucuucaaauacagacacuucaaggacgacgaggagaccggcuacaggagaaucaucgaaagauugaacucgaagaaagggaaaaaccgucugcuugacggagagcgacuugccgaccgcaaaauugccgagcuguucucaaccaaaacacacauaggauaa

SEQ ID NO: 15342 - RNA, 5055 nt, Artificial Sequence
  derived and/or modified CDS sequence (opt11) from CCHFV(Hy13)__AY900145.1__GP
auguacacgccccugcucugcgccgugcugugccuacaguuguggagccuggaggggucccacgggcugagcaacaagacccaacacuccaacaccagcaccaccaaggccccggaggugucccaggaguucggccuccccgugucgaccguguccacgaucacgagugacccgcccuccaucaccagcgccgucuccgugagcggguccgaggggagcggggacaccaacacgucccccagugugaccacccagggccugacccugccugagacgacccucgagcugcugacgaccacggacaccgacgccuccagcaccgucgugguggacguauccacccagacggugaaagacacccccaucagcaccacccacacgagccuccccuccaccccgagcgccaccaccacgccccagggcacccaccacacggcccgcgggcugcuaagugugaccagcacgaagcccgagggcgccuccacccaggcaaaccccgagaagaucagcauggagaccaacuccccgcggcucgcuaucagcgagacccccuccuucagccccacgacccaggcccccaccgagaacucgaacccuaucaccagcaagcagcugaucuucuccgcccagcccgucacacccaaccccgugaccccgcccgugcagcccgcgcugagccaguccgacaccagcacagccauccaggacauccaccccuccccgaccagccgcuccaagcggaaccucgagauggagauuauccugacgcugagccaggggcucaagaaguacuacggcaagauccugaagcugcucgaccugacacuggaggaggauaccgaggggcuccuggagugguguaagcgcaaccugggccucguuugcgacgccgacuucuuccagaagcggaucgaggaguucuuccugaccggcgaggggcacuucaacgaggugcuacaguucaagacccccagcacccucucccccaccggccccgcccgcaccgggucaccgacgguggaacccuucaaguccuacuucgccaagggcuuccugagcauggacuccgguuacuuuagcgcaaagugcuacccccgggccuccaacaguggacugcagcucaucaacgucacccagcacuccacccgcaucaccgacacgccgggcccuaagguuaccaacuugaagaccaucaacuguaucaaccugaaggccagcguguucaaggagcaccgggagaucgagauaaauguccuccugccccagguugccgugaaccuguccagcugccacguccuuaucaagucccacgugugugacuacagccuagacaucgacgggccaguccgccugccgcggauccaccacgagggcaccuucauccccgggacguacaagcucgucaucgacaagaaaaacaagcagaacgaccgcuguacccugaucaccaacugcgugaucaagggccgggagauccgcaagggccaaucuguccugcggcaauaccgcaccgagaucaagauagggaaagccagcuccgggagccggcgccuccugagcgaggagucgggggaugacugcaucagccggacgcaguuaucccgcaccgagaccgcggagauccacagcgacaacuacggagggcccggggacaagaucaccaucugcaacggcuccacgaucguggaccagcggcuggggagcgaguuggggugcuacaccaucaaccgcgugaaguccuucaagcugugcgagaacucugccaccgggaaaagcugcgagaucgacagcacccccaucaagugccgccagggcuucugccugaagaucacgcaggaggggcggggccacgucaaacucucccgugggagcgaggucgugcuggacgccugcgacuccagcugcgagaucaugaucccuaaggggaccggcgacauccuggucgauugcuccgggggccagcagcauuuccucaaggacaaccugaucgaccuaggcugccccaacaucccccuacuggggaagauggccaucuacaucugccguaugagcaaccacccuaagaccaccauggccuucuuguucugguucuccuucggcuacgugaucacauguauccucugcaaggugauauucuaccugcugaucguaguggguacccucggcaagaaguuuaagcaguaccgcgagcugaagccgcagaccugcaccaucugcgagaccacgcccgugaacgcaaucgacgccgagaugcacgaccugaacugcagcuacaacaucugccccuacugcgccucccggcucacgagcgacgggcuggcccgccacgucaugcagugccccaagcggaaggaaaagguggaggagaccgagcuguaccucaaccuggagcgcauuccgugggugguccggaaacuucuccaggugagugaguccaccgguguggcucugaagcgcagcuccugguuagucgugcuccugguacugcucacggugagccugagucccgugcagagcgcgcccaucggccacgggaagacaguggagacauaucaaacacgggagggcuacacguccaucugucuguuuguccucggguccauacuguucauaguguccugccugaugaagggucucguggacagcgucgggaacuccuucuuccccggcagcuccaucugcaagaccugcucgaucggcucuaucaacggguucgagaucgagagccacaaaugcuacugcucccuguucugcuguccauauugccgccacugcagcgccgaccgggagauccacaagcugcaccucuccaucugcaagaagcgcaagacgggcagcaacgugaugcuugccgugugcaagcggaugugcuucagagccaccgucgaggugagcaacaaagcgcugcucauccggaacaucaucaacacgaccuucguggucugcauacugauccuggcgguaugcguggucuccaccagcgccguggagauggagucccucccggccgggaccugggagcgcgaggaggaccugacgaacuucugucaccaggaaugccaggccacagagaccgagugccugugcccuuacgaggcgcucgugcugcggaagccacuguuuagcgacaguaucgucaagggcaugaagaaccuccucaacagcaccucgcuggagaccucgcucucaaucgaggccccauggggcgccauaaaugugcagagcaccuucaagcccaccguuuccgccgccaacaucgcgcugagcugguccagcgucgagcaccgcgggaacaagauacugguauccggacgaagcgaguccaucaugaagcucgaggagagaaccgggaucagcugggaccucgguguggaggacgccuccgagagcaagcugcucacggugagcaucauggaccugucccagauguacucgcccguguuugaguaccuguccggggaccgccagguggaggaguggcccaaagcgaccuguacaggcgacugccccgaacggugcgggugcacaagcuccacgugccuccacaaggaguggccccacagccgcaacuggcggugcaaccccaccuggugcuggggcgucgggaccgggugcacguguugcggucuggacgugaaggaccuguucacggaccauauguucgucaaguggaagguggaguacauuaagaccgaggccauugugugcgucgagcucaccucccaggagcgccagugcagccugaucgaggccgggacccgguuuaaucugggcccggugacgaucacacucagcgagccccgcaacauccaacagaagcugccaccagagaucgugacccugcacccccggaucgaggagggcuucuuugaccucaugcacgucaagaaggugcugagcgcauccaccgugugcaagcugcagagcugcacccacgggguacccggcgaccuccagguguaccacaucgggaaccuguugaagggcgacaaggugaacggccaccucauccacaagaucgagccccacuuuaacacgucguggaugagcugggacggcugcgaccuggacuacuacugcaacaugggcgacuggcccuccugcucguacaccggagucacccagcacaaccacgccgccuucgugaacaugcugaacaucgagaccgacuacacgaagaucuuccacuuccacuccaagcgcguuaccgcccacggcgacaccccgcagcucgaucuuaaggcgcggcccaccuacggcgccggugagauaacgguccucguggaggucgccgacauggagcuccacaccaagaagaucgagaucagcggguuaaaguucgccucccugaccugcaccggcuguuacgccugcagcuccggcaucagcugcaagguccgaauccacguugacgaacccgacgaguuaacggugcacgucaagagcgaggaccccgacaucguggcggccucgagcucgcugauggcccggaagcucgaguucgggaccgacagcaccuucaaggccuucuccgcaaugccgaagaccagccucugcuucuacaucgucgagcgcgaguacugcaaguccugcuccaaggaggacacgcagaagugcgucaacaccaagcuggagcagccccaauccauccugaucgagcacaagggcaccaucaucgggaagcagaacgacacgugcaccagcaaagcgggcugcuggcucgaguccgucaagagcuucuucuaugggcugaagaacaugcuguccggcauuuucggcaacguguucaucgggaucuuccuguuccucgcccccuucauccugcugauccucuucuucauguucggcuggcggauccuguucuguuucaaaugcugccgccggacccgcgggcuguucaaguaucggcaccucaaggacgacgaagagaccggcuaccgcaagaucaucgagcggcugaacaacaagaagggcaaaaacaagcugcucgacggggagcgccuggcggaccgcaagaucgcugagcuguucagcaccaagacgcacaucggcuga

SEQ ID NO: 15343 - RNA, 5052 nt, Artificial Sequence
  derived and/or modified CDS sequence (opt11) from CCHFV(4574-ST-2008)__KR814870.1__GP
augcacacccuguuagugugcuucauccuguaccugcagcuccugggccccgggggcgcccacgggcagccgaacgccaccgagcacaaccgaacgaauacuaccaccgcgcccucaacgucucagagccccaagccgcccgucaguaccgccccgccccacgcgcuggagucccccaccaucaagucuaccacgccuaccagcgagaccgagggcaguggggagaccacgagcccgcccaacaccacccagggacccucccuccccgagaccacgccuaagcggccugccaccaccgccaccagcacgcccuccaccgacaacacuaacucuaccacgcacgugaccgacaacaaccccacguccaccauuagcacgucccccagcaguagccccucuacgcccagcaccccgagaggcauccaccaucccgcgcggaaccugcugagcgucuccagccccaagaccgccacgacccccaccccgacuucacccggggagauaagcuccgaaacgagcucccuccacucggcuaugucccgaaccagcacucuguacaccgccacccaggcguccacggaaaaugccaaccacucggcgccucgucaguccgaaagcccggcccagccgacuaccaccucccugaugacgucgcccgcccaguccauccucgucaugagcgcggcucccaccgccauacagaacauccacccgucccccaccaaccgcuccaagcggaaccuagagauggagaucauccugacccucucacagggccuuaagaaguacuacgggaagauccucaagcucuugcaccugacgcucgaggaagacaccgagggucuguuagaguggugcaaacgcaaccucggcaguaauugcgaggacgacuucuuccagaagcggaucgaagaguucuucaugaccggcgagggcuacuucaacgaagugcugcaguucaagaccuuaucgacccucucccccacggagcccagccacgcgcgcccgcccaccgucgagcccuucaaaaguuacuucgcaaaaggguuccugagcaucgacucuggguacuucagcgcgaaaugcuacccccggucaagcaccucggggcugcagcucaucaacgucacgcagcacccugcccgcaucgccgagacucccggcccaaagaccaccucacuaaagacgaucaacugcaucaaccugcgggccucaguguucaaggagcaccgcgaaaucgagaucaacgugcucuuaccccagaucgccguaaaccugucgaacugccauguggugaucaacucccacgucugcgauuacucgcucgacacagacggcccugugcggcugccccacaucuaccacgaggggacauucauccccgggaccuacaagaucgugaucgacaaaaagaacaaguugaaugaccgcugcacgcucgucaccaacugcgugaucaagggucgggaggugcgcaagggccaguccguccugcggcaguacaagaccgagaucaagaucgggaaggugagcaccggcagccgcaaacugcucucagaggagagcggugacgacugcaucuccagaacgcaguuacugcgcacugaaaccgcggagauccacgacgacaauuacgggggccccggggacaagaucaccauaugcaacggcagcacuaucguggaccagcgcuuggguucagagcugggcuguuauacgaucaaccgcgucaagagcuucaagcugugcgagaacuccgccaccggaaaaacaugcgagaucgauagcacccccgugaagugucgccagggguucugccucaagaucacucaggagggaagagggcacgugaagcugucccgcggcucugagguagugcuggacgcaugugacuccagcugcgaggucaugauccccaaggggaccggcgacauccugguggacuguuccggaggacagcagcacuuccuaaaggacaaucugaucgaucugggcugcccccacaucccccuccucgggaagauggccaucuacaucugccguauguccaaucacccgcgcaccaccauggccuuccuguucugguucuccuucgguuaugugaucacgugccucuucugcaaggcgcuguucuacagccugaucauuaucggcacucucggaaagaagaucaagcaguaccgggagcuacgcccccagaccugcacgauaugugagacggcccccgucaacgccaucgacgccgaaaugcacgaccugaacugcuccuacaacauaugccccuacugcgcgagccgucucacauccgacggccuggcccgucacgugccgcagugcccuaagcggaaggagaagguggaggagaccgagcuguaccucaaccuggagcggauccccuggaucguccggaagcugcuccaggugagcgagagcaccggaguagcccugaagcgcuccucuuggcuuaucgugcuguuagugcugcucacggugagucugagcccaguccaauccgcccccgugggccacgggaagaccaucgagacauaccaaacgcgggagggcuucacuagcaucugccuguucaugcucggcucuauccuguuccuggugagcugcuuagucaagggucugguggauucggucagcgacuccuucuuccccggccucagcgucugcaagaccugcucuauugguagcaucaacggcuuugaaaucgagucccacaaaugcuacugcagccuguugugcugccccuacugcaggcauugcucggccgaccgggagauccaccagcugcaccucagcaucugcaaaaagcgcaagaccggguccaacgugaugcuggcggugugcaaacggaugugcuuccgcgccaccauagaggcgagccgucgggcacugcucauccgcagcaucaucaacacgaccuucguaauuugcauacugacccugaccauuugcguuguauccaccagcgccgucgagauggaaaaucuccccuccggcaccugggagaaagaggaggaucucaccaacuucugccaccaggagugccaagugaccgagacggagugccugugccccuacgaggcgcucgugcuccguaagccccuauuccucgacagcaucgucaagggcaugaaaaaccugcugaacuccaccagccucgaaacaucccugagcaucgaagcccccuggggcgccaucaacgugcaguccaccuucaagccgacggugaguaccgccaacaucgcccuauccuggucguccgucgaacaccgcgggaacaagauccucgugacggggcggagcgagucgaucaugaagcuggaggagcgcaccggcgugucuugggaccuggggguugaggacgcgucugagagcaagcuccugaccguguccaucauggaccugagccagauguacucccccguguucgaguaccuguccggcgaccggcaggucgaggaguggccgaaggcgaccugcaccggcgacugccccgagcggugcgggugcaccagcuccacgugccugcacaaggaguggccgcacagccggaacuggcgcugcaaccccaccuggugcuggggcguggggaccggcugcacguguugcgggguggacgucaaagaccuguucaccgaccacauguucgugaaguggaagguugaauacaucaagacggaggcgaucgucugcguggagcucaccucccaagagcggcagugcagcuuaaucgaggccggcacccgcuuuaaccugggcccggugaccaucacgcuguccgaaccccggaacauccagcagaagcuaccucccgagaucaucacccugcaccccaaagucgaagagggguucuuugaccucaugcaugugcagaagguacugagcgcuuccaccgucugcaagcugcaguccugcacccacggcauccccggcgaccuccagguguaccacauuggcaaccuucugaagggugaccgcgugaacgggcaccucauccacaagaucgagccacauuuuaacaccuccuggaugagcugggacggcugcgaucuagauuauuacugcaacaugggugacuggcccuccugcaccuacaccggagucacccagcauaaccacgccgcauuugugaaccugcucaauaucgagacggauuacaccaagaccuuccacuuccacagcaagcgggugaccgcccacggggauacgccccagcuugaccugaaagcacgccccaccuacggcgcaggcgagaucaccguccucguggagguagccgacauggagcuucacaccaagaagguggagaucucugggcucaaauucgccagccucgccugcacuggcuguuacgccuguagcagcgggaucagcugcaagguccgaauccacguggacgagccagacgagcugaccgugcacgugaaauccucugaccccgacgugguggcggcauccaccagccugauggcccgcaaacuugaguucggcaccgacuccacauuuaaggccuucagcgccaugcccaagaccucccugugcuucuauauuguggagcgggaauauugcaagagcugcuccgaggaggacacccaaaagugcgucgacaccaaacuggagcagccccagagcauccucaucgagcacaaggggacgauuauuggcaagcagaacgacacguguacagcaaaggccagcugcuggcuugagucugugaaguccuuuuucuacggccugaagaacaugcucggcagcguuuucggcaacuucuucaucgggauucugcuauuccuggcccccuucguacucuuagugcuguucuucauguucggcuggaagauccucuucugcuucaagugcugccgcagggcccgcgggcuguugaaguaccgccaucucaaggacgacgaggaaacaggcuacaggaagaucaucgagcggcuuaacaacaagaaaggcaagaaccggcugcuugacggggagaggcucgccgaccguaagauagccgagcuguucucaaccaaaacucacauaggcuga

SEQ ID NO: 15344 - RNA, 5052 nt, Artificial Sequence
  derived and/or modified CDS sequence (opt11) from CCHFV(75-ST-2010)__KR814864.1__GP
augcacacccugcucgugugcuucauccuguaccugcaacuccugggccccgggggcgcccacgggcagccgaacgccaccgagcacaaccgcacgaacaccaccaccgcgcccagcacgucccagagccccaaacccccggucuccaccgccccgccccacgcccuggagagccccaccaucaaguccaccacgcccaccagcgagaccgagggcuccggggagaccacgcccccgcccaacacuacccagggccccagccuccccgagacaacgcccgagcggcccgccaccaccgccaccucuacgccgagcaccgacaacaccaacuccaccacgcaugugaccgacaacaacccaaccagcaccaucuccacgagccccuccagcucccccagcacgccguccacgccccgcggcauccaccaccccgcccggaaccugcugagcgugagcucccccaagaccgccaccaccccgacacccaccagccccggggagauuuccagcgagacguccagccuccacuccgccaugucaaggaccuccacccuguacaccgccacccaggcgagcacggagaacgccaaccacuccgcgccccgucagagcgaguccccggcccagcccaccaccaccagccugaugacgucccccgcacagagcauccucgucauguccgccgccccgaccgccauucagaacauccacccuagccccaccaaccgcuccaagcggaaccuggagauggagaucauccugacccucagccagggccugaagaaguacuacggaaagauccugaagcuccugcaccugacgcuggaggaggacacugagggccugcuggaguggugcaagcgcaaccucgggucuaacugcgacgacgacuucuuccagaagcggauugaggaguucuucaugaccggagagggcuacuucaacgaggugcugcaguucaagacccuguccacgcucagccccaccgagccaucccacgcccgcccgcccaccguggagcccuucaagagcuacuucgccaagggguuccuguccaucgacagcggcuacuuuuccgccaagugcuacccccggagcuccaccagcgggcugcagcucaucaacgucacgcagcaccccgcccgcaucgccgaaacccccggccccaaaaccaccucucugaagacgaucaacugcaucaaccugcgugccagcguguucaaggagcaccgcgagauugagaucaacguucuccugccgcagaucgccgucaaccuguccaacugccacgucgugaucaacagccacgucugcgacuacucccucgacaccgacggccccgugcggcugccgcacaucuaccacgaggggaccuucauccccggcaccuacaagaucgugaucgacaagaagaacaagcugaacgaccgcuguacgcuugucaccaacugcgugaucaaggggcgggaaguucgcaagggccagagcguccugcggcaguacaagaccgagaucaagaucgggaagguguccaccggcagccgcaagcugcucagcgaggaguccggcgacgauugcaucucacggacgcagcugcugcgcacggagaccgcggagauccacgacgacaacuacgggggcccgggggacaagaucaccaucugcaacggcuccacgaucguggaccagcgccucgggagcgagcugggcugcuacaccaucaaccgggucaaguccuucaaacugugcgaaaacagcgccaccggcaagaccugcgagaucgacuccacgcccgugaagugucgccagggguucugccucaagauaacccaggagggccgggggcacgugaagcugagccgcggcuccgaggucgugcuggacgccugcgacagcuccugcgaggucaugauccccaaagggaccggcgacauccugguggacugcagcggcgggcagcagcacuuccucaaggauaaccugaucgaccugggcugcccccacauaccccuccuggggaagauggccaucuacaucugccggauguccaaccacccccgcaccaccauggccuuccuguucugguucagcuucggcuacgugaucacgugccucuucugcaaggcgcuguucuacucccugaucaucaucgggacccucgggaagaaaaucaagcaguaccgggagcugcgcccccagaccugcacaaucugcgagacggcccccgucaacgccaucgacgccgagaugcacgaccugaacugcagcuacaacaucugcccguacugcgcgucccggcucaccagcgacggacuggcccgccaugugccgcagugccccaagcggaaggagaagguggaggagaccgagcuguaccucaaccuggagcgcaucccguggauuguccggaagcugcuccagguguccgagagcaccgggguggccuugaagcgcagcuccuggcugaucguccuccugguacugcucacggugagccugucccccguccagagcgcccccgugggccacgggaagaccaucgagaccuaccagacccgggagggcuucacguccaucugccuguucaugcucggcagcauccuguuccugguguccugccucgucaaggggcugguggacagcgugucggacagcuucuuucccggccuguccgucugcaagaccuguagcaucggguccaucaacggcuucgagaucgagagccacaagugcuacugcucccuccugugcugcccguacugccgccacugcucagccgaccgggagauccaccagcugcaccucuccaucugcaagaagcgcaagaccgggagcaacgugaugcuggcggugugcaagcggaugugcuuccgcgccaccaucgaggccucccgccgggcccugcucauccgaagcaucaucaacacgaccuucgucaucuguauccugacccugaccaucugcguggugagcaccuccgccgucgagauggagaaccucccgagcggcaccugggagaaggaggaggaccugaccaacuucugccaccaggagugccaggugaccgagaccgagugccugugccccuacgaggcgcucgugcugcggaagccccuguuccucgacuccaucgucaaaggcaugaagaaccugcugaacagcaccucccucgagaccagucuguccaucgaggccccguggggcgcaaucaacgugcagagcaccuucaagcccacgguguccaccgccaacauugcccugagcuggaguagcgucgagcaccgcgggaacaagaucuuggugacggggcgguccgagagcaucaugaagcuggaggagcgcaccggcguguccugggacuugggggucgaggacgcuagugaguccaagcuccugacggugagcaucauggaccugucccagauguacagccccguguucgaguaccucagcggcgaccggcaggucgaggaguggccaaaggcgaccugcaccggcgacugcccggagcgcugcgggugcaccuccagcacgugccugcacaaggaguggccccacucccggaacuggcgcugcaaccccaccuggugcuggggcguggggaccggcugcacgugcugcgggguggaugucaaggaccuguuuaccgaccacauguucgugaaguggaagguggaauacaucaagaccgaggccaucgucugcguggagcucaccucacaagagcggcagugcucccuuaucgaggccggcacccgcuucaaccugggccccgugaccaucacgcucagcgagccgcggaacauccagcagaagcugccgcccgagaucaucacccugcaccccaaggucgaggagggguucuucgaccucaugcacgugcagaaggugcuguccgccagcaccgucugcaagcugcagagcugcacccacggcaucccuggggaccuccagguguaccacaucggcaaccugcugaagggcgaccgcgugaacgggcaccucauccacaagaucgagccccacuucaacacgagcuggaugaguugggacggcugcgaccuggacuacuacugcaacaugggggacuggcccagcugcaccuacaccggcgucacccagcacaaccacgccgccuucgugaaccugcucaacaucgagacggacuacaccaagaccuuccacuuccacuccaagcgggucaccgcacacggggacacgccccagcuagaccugaaggcccgcccgaccuacggcgcgggcgagaucaccgugcucguagaggucgccgacauggagcugcacaccaagaagguggagaucagcgggcugaaguucgccucccucgccugcacgggcugcuacgccugcagcuccgggaucagcugcaaggugcggauacacgucgacgagcccgacgagcugaccgugcacgucaagucuagcgaccccgacgucguggcggccagcaccucccugauggcccgcaagcucgaguuuggcaccgacagcacguucaaggccuucuccgccaugcccaagaccagccugugcuucuacaucguugagcgggaguacugcaaguccugcagcgaggaggacacccagaagugcgucgacacuaagcuggagcagccgcaguccauccucaucgagcacaaggggacgaucaucggcaagcagaacgacacgugcaccgcgaaggccagcugcugguuagaguccgucaagagcuucuucuacggccugaagaacaugcucggguccguguucggcaacuucuucaucgggauccugcuguucuuggcccccuucgugcuccuggugcuguucuucauguucggcuggaagauacucuucugcuucaagugcugccgccgggcccgcgggcugcugaaguaccgccaccucaaggacgacgaggagaccggcuaccggaagaucaucgagcgccugaacaacaagaagggcaagaaccggcugcucgacggggagcgccuggcggaccggaagaucgccgagcuguucagcaccaagacccacaucggcuga

SEQ ID NO: 15345 - RNA, 5052 nt, Artificial Sequence
  derived and/or modified CDS sequence (opt11) from CCHFV(37-R-2013)__KR814858.1__GP
augcacacccugcucgugugcuucauccuguaccuucagcuccugggccucgggggcgcccaccgccagagcaacgccaccgagcacaacgggacgaacaccacaacagcgcccuccacgagccaguccccgaagccgcccgucagcaccgcgccgccccacgcccccgagaccuccaccaucaagcccacgacccccgccagcgagaccgagggcuccggggagaccacgcccccucccaacaccacccagggccccagcccgcccgaggccacccccgagcggcccgccacgaccgugaccuccacccccagcacggacaacaccaacuccaccacccacgccacggacaacaaccccaccagcaccaucuccaccucccccuccagcucccccagcacgccguccacgccccaggguauccaccaccccgcccgcaaccuccugagcgugagcucccccaagaccgccaccacuccgacccccaccagccccggggacauuuccagcgagaccuccagccugcacuccgcgaugagccggacgcccacccuccauaccgccacccaggccuccaccgagaacgccaaccacagcgccccgcgccaauccgagagcuccgcgcagcagacgaccaccucgcccaugaccucccccgcucagccgauccugguuaugagcgccgcccccacggccauccagaacauccaccccucccccaccaaccggagcaagcgcaaccuggagauggagaucauccucacccugucccagggcuugaagaaguacuacgguaagauucucaagcugcugcaucuaacccuagaggaggacacggagggccugcucgaguggugcaagcggaaccuggggagcaacugcgacgacgacuucuuccagaagcgcaucgaggaguucuucaugaccggcgagggcuacuucaacgagguucugcaauucaagacccucagcacccuguccccgacggagcccagccacgcgagaccgcccaccguggagcccuucaaauccuacuucgccaagggcuuccugagcauugacuccggcuacuucagcgccaagugcuacccccgccucaccaccuccgggcugcagcugaucaacgucacgcagcaccccgcccggaucgccgagacccccgggccgaagaccaccagccucaagacgaucaacugcaucaaccugcgcgcguccguguucaaggagcaccgggagauugagaucaacgugcugcucccccagaucgccgucaaccugagcaacugccacguggugaucaacucccacgucugcgacuacagccuggacaccgacggcccggugcgacucccccacaucuaccacgaggggaccuucaucccggguaccuacaagaucgugaucgacaagaagaacaagcugaacgaccggugcacgcuggucaccaacugcgugaucaaggggcgcgaggugcggaagggccaguccguccuccgccaguacaagacugagaucaagaucgggaaggccagcaccggcucccggaagcugcugagcgaggagcccggcgacgacugcaucucccgcacgcagcuccugcggaccgagaccgccgagauccacgacgacaacuacgggggccccggggacaagaucaccauuugcaacggcagcacgaucguggaccagcgccuggggagcgagcucggcugcuacaccaucaaccgcgugaaguccuucaagcugugcgagaacagcgccaccggcaagaccugcgagaucgacuccacgcccgucaagugccggcagggguucugccugaagaucacccaggagggucgcgggcacgugaaacucagccggggcuccgaggugguuuuagacgcgugcgacaccagcugcgaggugaugaucccgaaggggaccggcgacauccuggucgacugcuccggcgggcagcagcacuuccugaaagacaaccugaucgaccugggcuguccccacaucccccugcucgggaagauggcaaucuacaucugccgcaugagcaaccacccccggaccacgauggccuuccuguucugguucuccuucggcuacgugaucacgugcauuuucugcaaagcccuguucuacagccucauuaucaucggcacccuggggaagaagaucaagcaguaucgugagcuuaagccgcagaccugcaccaucugcgagaccgcgcccgugaacgccaucgacgccgagaugcacgaccucaacugcuccuacaacaucugccccuacugcgccagccggcugaccuccgacggucuggcccgccacgucccgcagugccccaagcggaaggagaagguggaggagaccgagcucuaucugaaccuggagcgcauccccuggaucgugcggaagcuccugcaggucagcgaguccacggggguggcgcugaagcgcagcuccuggcucaucguacugcugguccuccugaccgugagccugagccccgugcagagcgccccggucggccacgggaagaccaucgagaccuaccagacgcgggagggcuucaccagcgugugccucuucaugcugggcuccauccuuuuccucgugagcugccuggucaaggggcugguggacuccgugucugacuccuucuuccccggccucagcgucugcaagaccuguuccaucgggagcaucaacggcuucgagaucgagucccacaagugcuacugcagccucuucugcugccccuacugccgccacugcuccgccgaccgggagauccaccagcugcaccucagcaucugcaagaagcgcaagaugggguccaacgugaugcuggccgugugcaagcggaugugcuuccgcgccaccaucgaggcaagccggcgcgcccugcugauccgcuccaucaucaacacgaccuucgucaucugcauccugaccuuaaccaucugcguggugucaacguccgccguggagauggagaaccuccccagcgggaccugggagcgggaggaggaccugaccaacuucugccaccaggagugccaggugaccgagacggaaugccuaugcccguacgaggcccucguguuacgcaagccacuguuccucgacuccaucguaaagggcaugaagaaccugcugaauagcaccagcuuggagaccucccugucuaucgaggcccccuggggcgcgaucaacguccaguccaccuucaagcccacggugagcaccgccaacaucgcccuguccuggagcuccguggagcaccgggggaacaagauccucgugaccgggcgcagcgaguccaucaugaagcuggaggagcggaccggcgugagcugggaccugggggucgacgacgccuccgagagcaagcuccugacgguguccaucauggaccugagccagauguacuccccgguguucgaguaccucagcggggaccgccaggucgaggaguggcccaaagcgaccugcaccggcgacugccccgagcggugcgggugcacguccagcacgugccugcacaaggaauggccccacucccgcaacuggcggugcaaccccaccuggugcuggggcguggggaccggcugcaccuguugcgggguagacgucaaggaccuguucaccgaccacauguucguuaaguggaagguggaguacaucaagaccgaggccaucgucugcguggagcucaccagccaggagcgccagugcagccuuaucgaggccgguacccgguucaaccugggccccguaacaaucacgcucuccgagccccgcaacauccagcagaaacuucccccggagaucaucacccuacaccccaaggucgaggagggguucuucgaccucaugcacguacagaaggugcugagcgccuccaccgucugcaagcugcagagcugcacccacggcauccccggggaccuccagguguaccacaucggcaaccugcugaagggcgaccgggugaacgggcaccucauccacaagaucgagccgcacuucaacacguccuggaugagcugggacggcugcgaccuggacuacuacugcaacaugggggacuggccguccugcaccuacaccggcgucacccagcacaaccaugccgcguucgugaaccugcucaacaucgagacggacuacaccaagaccuuccacuuccacagcaagcgcgucaccgcccacggggacacaccccagcuagaccugaaggcccggcccaccuacggcgccggcgagaucaccgugcucguggaggucgccgacauggagcugcacaccaagaagguggagaucuccgggcugaaguucgcgagccucgccugcacgggcugcuacgccugcuccagcgggaucuccugcaaggugcgcauccacgucgacgagcccgacgagcugaccgugcacgucaaaucuaacgacccggacgugguggccgccuccaccagccuuauggcgcggaaacucgaguucggcaccgacuccacguucaaggcuuucagcgccaugcccaagaccagccugugcuucuacaucguggagcgcgaauacugcaagucuugcagcgaggaggacacccagaagugcgucgacacuaagcuggagcaaccccaguccauccucaucgagcacaaggggacgaucaucggcaaacagaacgugaccugcaccgccaaggcgagcugcuggcuggaguccgucaagagcuucuucuacggccugaagaacaugcucggguccguguucggcaacuucuucaucgggauccugcuguuccucgccccguucgugcugcuggugcuguucuucauguucggguggaagauccucuuuugcuucaaguguugccggcgcacccgggggcugcugaaguaccgccuccugaaggacgacgaggagacgggcuaccgccggaucaucgagcgccugaacaacaagaagggcaagaaccggcuccuggacggggagcgccuggccgaucggaagaucgccgagcuguucagcaccaagacccacaucggcuga

SEQ ID NO: 15346 - RNA, 5052 nt, Artificial Sequence
  derived and/or modified CDS sequence (opt11) from CCHFV(Kashmanov)__DQ211631.1__GP
augcacacccuguuggugugcuucauccuguaccugcagcugcugggccucggcggggcccacgggcagucgaacgccaccgagcacaacgggaccaacacaaccaccgcccccuccaccagccaguccccgaagcccuuagucagcaccgccccgccccacgcccuggaguccagcacgaucaagcccaccacccccgccuccgagaccgaggggagcggcgagaccacgccgccgcccaacaccacccagggccccagcccgcccgagaccacccccgagcggcccgccaccaccgccaccagcacccccuccaccgacaacaccaacagcaccacucacgugacggacaacaaccccaccuccaccaucagcaccuccccgagcuccagccccuccacgcccuccacgccccaagggauccaccacccggcccggaaccugcucagcguguccagccccaagaccgccaccacgcccacccccaccuccccgggcgagaucagcucugaggccagcucccugcacagcgcgaugucccgcaccagcacgcuguacaccgccacccaggucuccaccgagaacgccaaucauagcgcgccccggcaguccgagagcuccgcccagcccaccacgaccagcccgaugaccucccccgcgcagagcauccucgucauguccgccgcccccauagccauccagaacauccaccccagcccgaccaaccgcagcaagcggaaucuggagauggagaucauacugacgcucucgcaggggcugaagaaguacuacggcaagauccugaagcuccuccaccugacccucgaggaggacacagaggggcugcuggagugguguaagcgcaaccucggcucgaacugcgacgacgacuucuuccagaagcggaucgaggaguucuucaugaccggcgagggguacuucaacgaggugcugcaguucaagacgcuguccacccucagccccaccgagcccucccacgccggcccgcccaccgucgaacccuucaagagcuacuucgcgaagggguuccuguccaucgacagcggcuacuucuccgccaagugcuacccccgcagcuccacgagcggccuucagcucaucaacgugacccagcaccccgcccggaucgccgagaccccagggcccaagaccacgucccugaagaccaucaacugcauuaaccugcgcgccuccguguucaaggagcaccgggaaaucgagaucaacguccuccugccccagaucgcggugaaccuguccaacugccacguggucaucaacagccacgugugcgacuacucccucgacaccgacggccccgugcgccugccgcacaucuaccacgaagggaccuucauccccggcacguacaagauugucaucgacaagaagaacaagcugaacgaccggugcacccucgugaccaacugcgugaucaaagggcgcgaaguucggaagggccagagcgugcugcgccaguacaagaccgagaucaagaucggaaaggcgagcacggggucccggaagcugcucagcgaggagcccggggacgacugcaucucccgcacccagcugcugcggaccgagaccgccgagauccacgacgacaacuacgggggccccggggacaagaucacgaucugcaacggcagcaccaucguggaccagcgccucggcuccgaguuagggugcuacaccaucaaccgggucaagagcuucaagcugugcgagaacuccgccaccggcaagacaugcgagaucgacagcaccccggugaagugccgccagggauucugccucaagaucacucaagaggggcgcgggcacgugaaacugucccggggcagcgaggucgugcuggacgccugcgacuccagcugcgaggucaugauccccaagggcaccggggacauccugguggacugcuccggcgggcagcagcacuuucucaaggacaaccugaucgaucugggcugcccccacaucccccuccugggcaagauggcgaucuacaucugccgcaugagcaaccacccgcggacgaccauggccuuccuguucugguucuccuucggguacgugaucacgugcaucuucugcaaggcccucuucuacagccugaucaucaucggcacccuggggaagaagaucaagcaguaccgcgagcuuaagccccagaccugcacgaucugcgagaccgcccccgucaacgcgaucgacgccgagaugcacgaccugaacugcuccuacaacaucugccccuacugcgccagccggcugaccuccgacggccucgcccgucacgugccgcagugccccaagcggaaggagaagguugaggaaaccgaguuauaccugaaccucgagcgcauccccuggaucguccggaagcugcuccaggugagcgagagcacggggguggcccucaagcgcagcagcuggcugaucguccugcucgugcugcugaccgugucgcucagccccguccaguccgcgccagugggccacgggaagaccaucgagaccuaccagacgcgggagggguucacgagcaucugccuguuuaugcugggcuccauccucuuccuggugagcugccuggucaaggggcucguggacuccguaagcgacuccuucuuccccggccugagcgucugcaagaccugcaccaucggguccauaaacggcuucgagaucgagagccacaagugcuacugcucccuguucuguugccccuauugccgccacugcagcgccgaccgggagauccaccagcuccaccuguccaucugcaagaaacgcaagacgggaagcaacgugaugcuggcugucugcaagcggaugugcuuccgcgccaccaucgaggccucccggcgcgcgcuccugauccggagcaucaucaacaccaccuucgucaucugcauccugacgcucacgaucugcguugugagcaccuccgccgucgagauggagaaccugccgagcgggaccugggagagagaggaggaccugacgaacuuuugccaccaggagugccaggugaccgagaccgagugucucugccccuacgaggcccuggugcugcgcaagccccucuuccuugacuccaucgucaagggcaugaagaacagccugaacuccaccagccucgagacgucccugagcaucgaggcccccuggggcgccaucaacgugcaguccaccuucaagccgaccgugagcaccgcgaacaucgcccuguccuggagcuccgucgagcaccggggcaacaagauccucgugacggggcgcagcgaguccaucaugaagcuggaggaacggaccggcgugagcugggaccugggcgucgaggacgccuccgagagcaagcuccugaccguguccaucauggaccugagccaaauguacagccccguguucgaguaccucuccggggaccgccaagucgaggaguggcccaaggcgaccugcacgggcgacugcccagagcggugcgggugcaccagcagcacgugccugcacaaggaauggccgcacagccgcaacuggcggugcaaccccaccugguguuggggaguggggacggggugcacgugcugcggcguggacgucaaggacuuauucaccgaccacauguucgugaaguggaagguggaguacaucaagaccgaagcgaucgucugcguggagcucaccucccaggagcgccagugcagccugaucgaggccgggacgcgguucaaccugggccccgucaccaucacccucuccgagccccgcaacauccagcagaagcugccgcccgagaucaucacccugcaccccaaggucgaggagggguucuuugaccucaugcacgugcagaaggugcugagcgccuccacggucuguaagcugcagagcugcacccacggcauccccggcgaccuccagguguaccacaucgggaaccugcugaagggcgaccggaucaacgggcaccucauccacaagaucgagccgcacuucaacaccuccuggaugucaugggacggcugugaccuggacuacuacugcaacaugggggacuggcccuccugcaccuacacgggcgugacccagcacaaccacgccgccuucgucaaccugcucaacaucgagaccgacuacaccaagacguuccacuuccacagcaagcgcgugacugcgcauggcgacacgccccagcuggaccugaaggcucggcccaccuacggggccggcgagaucacgguccucguggagguggccgacauggagcugcacaccaagaagguugagaucuccggacugaaguucgccagccucgcgugcaccggcugcuacgccugcuccagcgggaucuccugcaaggugcgcauccacguggacgagccggacgagcugaccguccacgugaaguccagcgaccccgacguggucgccgccuccacgagccugauggcccgaaagcucgaguucggcaccgacuccaccuucaaggcguucagcgccaugcccaagaccucccuaugcuucuacaucguggagcgcgaguacugcaagagcugcuccgaggaggacacgcagaagugcgucgacaccaagcuggagcagccgcagagcauccucaucgagcacaagggcaccaucaucgggaagcagaacgacacgugcacggccaaggccuccugcuggcuggagagcgucaaguccuucuucuacggccugaagaacaugcucgggagcguuuucggcaacuucuucaucgggauccugcuguuccucgcgccguucgugcugcugguccuguucuucauguucggcuggaagauccucuuuugcuucaagugcugccggcgcaccaggggccugcugaaguaccgccaccucaaggacgacgaggagacgggguaccggcgcaucaucgagcgccugaacaacaagaagggcaagaaccggcugcucgacggggagcgccuugcugaucggaagaucgccgagcuguucuccaccaagacgcacaucggcuga

SEQ ID NO: 15347 - RNA, 5052 nt, Artificial Sequence
  derived and/or modified CDS sequence (opt11) from CCHFV(Haskovo-V46/13)__KR092379.1__GP
augcacacccugcuggugugcuucauccuguaccugcagcuccugggccucggcggggcccacgggcaguccaacacgaccgagcacaacgggaccaacaacaccaccgcccccgggaccucccagucuccgaagccccacauguccaccaccccgccccacgcgccggagagcuccaccaucaagccuaccacccccaccagcgagaccgagggcuccggcgagaccacgccgcccagcaacaccacccaggggcccagcccgcccgagaccaccagcgagcggcccgccaccaccgccaucuccaccagcuccaccgacaacaugaaccccaccagccagaugaccgacaacacgcccaccuccaccgucagcaucucccccagcuccagccccagcacccccuccacgccccagggcaugcaccaccccgcccggagccuccugagugugagcucuccgaagaccgccaccacccccacgccgaccagccccguggaggucggguccgagaccagcucccagcacagcgcgauguccagcaccccuacgccccacaccgccacucagguguccacggagaacaccaaccacagcacgccccgccaauccgagcccagcgcucagcagaccaccccgucccccaugcccagcccggcccaguccacacugcucaugagcgcggcccccacggccgugcagaacacccaccccucccccaccaaccgguccaagcgcaaccuggagauggagaucauccugacccucucccagggccugaagaaguacuacgggaagauccugaagcuccugcaccugacccucgaagaggacaccgagggccugcuagaguggugcaagcggaaccucggcuccaacugcgacgaugauuucuuccagaagcgcaucgaggaguucuucaugaccggggagggcuacuucaacgagguccugcaguucaagacccugagcacgcucuccccgauggagcccagccacgccgagcugccaaccgcagagcccuucaaguccuacuucgcgaagggguuccugagcaucgacuccggcuacuucagcgccaagugcuacccuagguccagcaccuccggccuccagcugaucaaugugacgcagcaccccgcccgcaucgccgagacgcccgggcccaagaccaccagccucaaggccaucaacugcaucaaccuccgggcguccguguucaaggagcaccgcgagaucgagaucaacguccugcugccgcagaucgccguaaaccucagcaacugccacguggucauuaacucccacgugugcgacuacagccuggauaccgacgggcccgugcggcugccccacaucuaccacgaggggacguucauacccggcaccuauaagaucgucaucgacaagaagaauaagcucaacgacagaugcacccuggugaccaacugcgugaucaaggggcgggagguccgcaagggccagagcgugcugcggcaguacaagacggagaucaaaaucggcaaggccuccaccgggagccgcaagcuccuguccgaggagcugggcgacgacugcaucagccggacccagcuccugcgaacagagacggccgagauccacgacgacaacuacggggguccgggggacaagaucaccaucugcaacggcuccaccaucguggaccagcggcugggcagcgagcucgggugcuacaccaucaaccgcggcaaguccuucaagcugugcgagaacagcgccacggggaagaccugcgagaucgacuccacccccgucaagugccggcagggcuucugccugaagaucacccaggaggggcgcggccacgugaagcucagccgcggcuccgaggugguccuggacgcgugcgacagcuccugcgaggugaugauccccaaggggacgggcgacauccuggucgacugcagcgggggccagcagcacuuccugaaggacaaccucaucgaccugggcugcccccacauaccgcugcucgguaagauggccaucuacaucugccggauguccaaccacccccgcaccaccauggcuuuccuguucugguucagcuucgguuacgugauuacuugcaucuucugcaaggcccuguucuacucccucaucaucaucgggacccugggcaagaagaucaagcaguaccgggagcugaagccgcagacgugcaccaucugcgagaccacccccgugaacgccaucgacgcggagaugcacgaccucaacuguagcuacaacaucugcccguacugcgccucucgccugacgagcgacgggcuggcccggcacgucacccagugccccaagcgcaaagaaaagguggaggagaccgagcucuaccugaaccuggagcggauccccuggaucgugcgcaaacuccugcaggucagcgaguccacaggcguggcccugaagcggagcuccuggcucaucgugcugcugguccuccuaccggugagccugucccccgugcagagugcgcccgucggccacgggaagacgaucgagaccuaccagacccgcgagggcuucaccuccaucugccucuucaugcuggggagcauccuguucaucguguccugcuuagugaagggccuggucgacagcgugggggacuccuucuuccccggccugucggugugcaagacgugcuccaucggcagcaucaacggguucgagaucgagucccacaagugcuacugcagccucuucugcugcccguacugccggcacugcuccgccgaucgcgagauucaccaacugcaccugaguaucugcaagaagcggaagaccggcuccaacgucaugcucgccgugugcaagcgcaugugcuuccgggccaccaucgaggccagccgccgggcgcugcugauccgcagcaucaucaacaccacguucgccaugugcaucuuaacccugaccaucugcguggucagcaccagcgccguggagauggagaaccugccugccgggacgugggagcgcgaggaggaccucaccaacuucugccaccaggagugccaagugaccgagaccgagugccugugccccuaugaggcccugguccuccgcaagccccuguuccuugacuccaucgugaagggcaugaagaaccuccugaacagcacgucccuggagaccagccucuccaucgaggcaccguggggcgcaaucaacgugcagagcaccuucaagcccaccgucuccacggccaauaucgcccugagcuggagcagcguggagcaccgcggcaacaagauacuggugaccggccgguccgagagcaucaugaagcucgaggaacgcaccggggucuccugggacuuaggcguggaagacgccagcgagucaaagcugcuaaccguaagcaucauggaccugucccagauguacagccccgucuucgaguaccugagcggggaccgccagguggaggaguggcccaaagcgacgugcaccggcgacugcccggagcgcugcgggugcaccuccagcacgugccuccacaaggaguggccccacucccggaacuggcgcugcaaccccacuuggugcuggggcgugggcaccgggugcacgugcugcggcgucgacgugaaggaccuguucaccgaccacauguucgugaaguggaaggucgaguacaucaagaccgaggccaucgugugcguggagcugacgagccaggagcggcagugcucccucaucgaggccgggacccgcuucaaccugggccccgucaccaucacacugagcgagccucgcaacauccagcaaaagcugccgcccgagaucaucacgcugcaccccaagaucgaggaaggcuucuucgaccugaugcacgugcagaaggugcucuccgccagcaccgucugcaagcuccaguccugcacccacgggaucccgggcgaccuccagguguaccacaucgggaaccuccugaagggcgaccgcguaaacgggcaccugauccacaagaucgagccccacuucaacaccagcuggauguccugggacggcugcgaucucgacuacuacugcaacaugggcgacuggcccagcugcacguacacgggggucacccagcacaaccacgcggccuucgugaaccugcugaauaucgagaccgacuacacgaagaccuuccacuuccacuccaagcgggugaccgcccacggcgacacgccccagcucgaccugaaggcccgcccgacguacggggcaggagagaucaccguccugguggaggucgcggacauggagcuccacaccaagaagguggagaucagcgggcugaaguucgccucgcugaccugcacgggcugcuacgccugcagcucaggcaucagcugcaaggugcggauccacgucgacgagcccgacgagcucacugugcacgugaaguccagcgaccccgacgucguggcugccgguaccagccugauggcgcgcaagcuggaguucggcaccgacuccacguucaaggccuucagcgccaugcccaagaccucccucugcuucuacaucguggagcgggaguacugcaaguccugcuccgaggaugacacccagaagugcguugacaccaagcuggagcagccacagagcauccugaucgagcacaaggggacgaucaucggcaagcagaacgacacgugcaccgcccgcgccuccugcuggcucgagagcgugaaguccuucuucuacgggcugaagaacaugcugggcagcguguucggcaacuuucucaucgggauccugcuguuucucgcgcccuucguccugcuggugcuguucuucauguucggcuggaagauccucuucugcuucaagugcugccggcgcacccgggggcuguucaaguaccgccaccugaaggacgacgaggagacgggcuaccggcgcaucaucgaacgccucaacuccaagaagggcaagaaccggcugcuggacggggagcgccucgccgaccggaagaucgcagagcuguucagcaccaagacccacaucggcuga

SEQ ID NO: 15348 - RNA, 5052 nt, Artificial Sequence
  derived and/or modified CDS sequence (opt11) from CCHFV(Min)__KX013481.1__GP
augcacacccugcuggugugcuucauccuguacuuacaacuccugggccucggcggggcccacgggcagagcaacgccaccgagcacaacgggaccaacaccaccacugcccccuccaccucccaguccccgaagccccucgucagcaccgccccgccccacgcccuagaauccagcaccaucaagcccaccaccccggcuuccgagacugaaggaagcggcgagaccacgcccccucccaacacgacccagggccccagcccgcccgagaccacccccgagcgccccgccaccaccgcgaccagcacccccuccacggacaacaccaacagcaccacccacgugacggauaacaaccccaccuccaccaucagcaccuccccgagcuccagccccuccacccccucuacgccccaggggauccaccacccggcccgaaaccugcucagcguguccucgcugaagaccgccaccacgcccacccccaccucccccggcgagaucagcuccgagaccagcucccugcacagcgccaugucccgcacgagcacccucuacaccgcgacccaggucuccaccgagaacgccaaccacagcgccccgcgacaguccgagagcuccgcccagcccacgaccaccagccccaugacaucccccgcccagagcauccuggugauguccgcggccccgaucgccauccagaacauccaucccagccccacgaaccgcagcaagcggaaccuggagauggagaucauccucacccugucccaggggcugaagaaguacuacggcaagauccucaaacuccugcaccucacccuggaggaggacaccgaggggcugcucgaguggugcaagcgcaaucugggcagcaacugcgacgacgacuucuuccagaagcggaucgaggaguucuucaugacgggcgagggguacuucaaugaggugcugcaguucaagacccucuccacgcugagcccgaccgagcccucccacgcccggccgcccacggucgagccguucaagagcuauuuugccaagggcuuccugagcaucgacucaggguacuucuccgcgaagugcuacccccggagcuccaccagcggccuccagcugaucaacgugacccagcaccccgcccgcaucgccgagacccccggcccgaagacgaccucccugaagaccaucaacugcaucaaccuccgggccagcguguucaaggagcaccgcgagauugagaucaacguccugcugccccagaucgccgugaaccucuccaacugucacguggucaucaacagccacgugugcgauuacucccuggacaccgacgggcccgugcggcugccccacaucuaccaugagggcacguucaucccggggaccuacaaaaucgucaucgacaagaagaacaagcucaacgaccgcugcacccuagugacuaacugcgugaucaagggccgggagguccgcaaggggcagagcgugcugcggcaguacaagacggagaucaagaucggcaaggcgagcaccggcucccgcaagcuccugagcgaggagcccggggacgacugcaucucccggacccagcugcuccgcaccgagacggccgagauccacgacgacaacuacggcgggcccggcgacaagaucaccaucugcaacgggagcaccaucguggaccagcggcugggcuccgaacugggcugcuacaccaucaaccgcgucaagagcuucaagcucugcgagaacuccgccacggggaagacuugcgagaucgacagcacccccgugaagugccgccagggcuucugccugaagaucacccaggaggggcggggccacgugaagcugucccgcgggagcgaggucguccuggacgccugcgacuccagcugcgaggucaugauccccaagggcacgggcgacauccucguggacugcuccgggggccagcagcacuuccugaaggacaaccugaucgaccucggaugcccccacaucccucugcugggcaagauggccaucuacaucugccggaugagcaaccacccccgcaccaccauggcguuccucuucugguucucauuuggcuacgugaucacgugcaucuucugcaaggcccuguucuacagccugaucaucauagggacccucggcaagaagaucaagcaguaccgggagcugaagccgcagacgugcaccauaugcgagaccgcccccgucaacgccaucgacgcggagaugcacgaccugaacugcuccuacaacaucugccccuacugcgccagccgccucaccuccgacgggcuggcccggcacgugccccagugcccgaagcgcaaggagaagguggaggagacggagcuguaccucaaccuggagaggauccccuggauaguccgcaagcugcuccaggugagcgaaagcaccggcguggcccugaagcgguccagcuggcugaucguccuccuugugcugcucaccgugucccugagccccguccaguccgcgccgguggggcacgguaagacaaucgagaccuaccagacccgcgagggcuucaccagcaucugccuguucaugcuuggguccauccuguuccuggugagcugccucgucaagggccugguggauuccgugagcgacuccuucuuccccggguugagcgucugcaagaccugcacgaucggcuccaucaacggguucgagaucgagucacacaagugcuacugcucccucuucugcugucccuacugccggcauugcagcgcggaccgcgagauccaccagcugcaucuguccaucugcaagaagcggaagaccggcagcaacgugaugcucgccgugugcaagcgcaugugcuuccgggccaccaucgaggccucccgccgggcacugcugauccgcagcaucaucaacaccacguucgucaucugcauccucacccugaccaucugcguggugagcaccuccgcggucgagauggagaaccugcccagcggcacgugggagcgcgaggaggaccucaccaacuucugccaccaggagugccaagugaccgagaccgagugcuuaugcccguacgaggccuuggugcuccggaagccucuguuccuggacuccaucgucaaggggacgaagaaccuccugaacagcaccuccuuagagaccagccucuccaucgaggcccccuggggcgccaucaacgugcagagcaccuucaagcccacgguguccaccgccaacaucgcgcugucaugguccagcgucgagcaccgcgggaacaagauccuggugaccggccgguccgaaagcaucaugaagcucgaggaacgcacggggguguccugggaccugggcgucgaggacgccagcgaguccaaguuacucacggugagcaucauggaccugucccagauguacagcccgguguucgaguaucugagcggcgaccggcaggucgaggaguggccuaaggcgaccugcaccggggacugccccgagcgcugcggcugcaccuccagcacgugccuccacaaggaguggccccacucccggaacuggcgcugcaacccgacguggugcuggggcgugggcaccgggugcacgugcugcggcguggacguaaaagaccuguucaccgaccacauguucgugaaguggaagguggaguauaucaagacggaggccaucgucugcguggagcugaccagccaggagcggcagugcucccucaucgaggcgggcacccgcuucaaccuggggcccgugaccaucacgcugucagagccccggaacauccagcagaagcugccgcccgagaucaucacccugcaccccaaggucgaggagggcuucuucgaccugaugcacguucagaagguacucuccgccagcaccgucugcaagcugcagaguugcacccacgggauccccggcgaccuccagguguaccacaucggcaaccuccugaagggggaccgcaucaacggccaccugauccacaagaucgagccccacuucaacacgagcuggauguccugggacgggugcgaccucgacuacuacugcaacaugggcgacuggcccagcugcaccuauaccggggugacccagcacaaccacgcagccuucgucaaccugcugaacaucgagacugacuacaccaagaccuuccacuuccacuccaagcgggugaccgcccacggcgacacgccccagcucgaccugaaggcgcgccccaccuacggcgccggggagaucaccguccuggucgagguggccgauauggagcuccacaccaagaaggucgagaucagcggucugaaguucgccucccuggccugcacggggugcuacgcgugcagcuccggcaucagcugcaaggugcggauccacguggacgagcccgacgagcucaccguccacgugaaguccagcgacccggacguggucgccgccagcaccucccugauggcccgcaagcuggaguucgggaccgacagcacguucaaggccuucuccgcgaugcccaagaccagccuuugcuucuacaucguggaacgggaguacugcaaguccugcagcgaggaggacacccagaagugcguggacaccaagcuggagcagccccaguccauccugaucgagcacaagggcacgaucaucggcaagcagaacgacacgugcaccgccaaggccagcugcuggcucgaguccgucaagagcuucuucuacgggcugaagaacaugcugggcuccguguucgggaacuucuucaucggcauccuccuguuccuggcgcccuucgugcugcucguccuguucuucauguucggcuggaagauccuguuuugcuucaagugcugccgccguacccgcggccuccugaaguaccggcaccugaaggacgacgaggagacgggcuaccgccgcaucaucgagcggcucaacaacaagaaggggaagaaccgccuguuggacggcgagcggcucgcggaccgcaagaucgccgagcuguucagcaccaagacccacauuggauga

SEQ ID NO: 15349 - RNA, 5052 nt, Artificial Sequence
  derived and/or modified CDS sequence (opt11) from CCHFV(Kosovo/9553/2001)__AY675511.1__GP
augcacacccugcucguaugcuucauauuauaccugcagcuccugggccugggaggcgcgcacgggcagaguaacgccaccgagcacaacggcacgaacaccaccaccgcgcccggaacgucccagagcccgaagccucccgcauccaccacccccagccacgccccggaguccagcaccauaaagcucacaacccccacuuccgagaccgagggcagcggcgagaccaccccgcccaccuccaccacgcaggggagcccgccccuggagaccacccccgagcgcuccaccacgaccgccaccagcaccuccggcacggacaacaugaacagcaccacccagaugaccgacaacacgcccacccugaccgccucaaccagcccguccagcucccccagcacgcccagcaccucccaggggcuccacuaccccguccggagccugcugucggugagcuccccgaagaccgugaccacucccacucccaugagccccggugaaauguccagcgagaccaguagccagcacagugcgaugagccgcaccccgacgccccacaccgccacccaagucuccacagagaacgccaaccggagcaccucccgccaaagcgaguccucagcccagcccgcgacgcagucccccgugaccagcccggcccagagcauucuccugauguccgccacccccaccacgauccaaaauauccaccccagccccaccaaucgcuccaagcgcaaccucgagauggagaucauccucacccugagccaggggcugaagaaguacuacggcaagauacucaagcugcugcaccucacccuggaggaggacacggagggccugcucgaguggugcaagcggaaccugggcuccaacugcgacgacgacuucuuccaaaagcgcaucgaggaguucuucauuaccggcgagggguacuucaacgaggugcugcaguucaagacccucagcaccccgucccccacggagcccagccacgcccggcugccgaccgccgagcccuucaaguccuacuucgcgaagggcuuccuguccaucgacuccggcuacuuuagcgccaagugcuacccccgcuccagcaccuccgggcuccagcugaucaacgucacccagcaccccgccaggaucgccgagacgccgggccccaagaucacuagccugaagacaaucaacugcaucaaccuccgcgccuccguguucaaggagcaccgggagguggaaauuaacguccugcugccccagaucgcggugaaucucagcaacugccacgugguuaucaacagccacgugugcgacuacucgcuggacaccgacgggcccgugcgccugccgcggaucuaccaugagggcacguucaugcccgggacuuacaagaucgucauagaccgcaagaacaagcucaacgaccggugcacccuggugaccaacugcgugaucaagggccgcgagguccggaagggccaguccgugcugcgccaauacaagacggagaucaaaaucgggaaggcccccaccggaucccggaagcuccugagcgaggagcccggagacgauugcaucucccgcacccagcugcuccgcaccgagacugccgagauccacgacgacaacuacggcgggccgggggacaagaucaccauuugcaacggcagcaccaucguggaccagcggcugggguccgagcucgguugcuacaccaucaaccgcguuaagucauucaaacuuugcgagaacagcgccacggggaagacaugcgagaucgacagcacccccgugaagugccggcaaggauucugccugaagaucacgcaggaggggcgcggccacgugaagcugucccggggcagcgaagucgugcuggacgccugcgauuccagcugcgaggugaugauccccaaggggaccggcgacauccucguggacugcagcgggggccagcagcacuuccugaaggacaaccugaucgacuugggcugcccccacaucccgcugcuggggaagauggcaaucuacaucgcccguaugucgaaccaccccaagacgaccauggcguuucucuucugguucuccuuaggcuacgugauaaccugcauccugugcaaggcccucuucuacagcuugaucaucaucgggacacugggcaagaagaucaagcaguaccgggagcucaagccccagacgugcaccaucugcgagaccgcccccgucaacgcgaucgacgccgagaugcacgaccugaacugcuccuacaacaucuguccguacugcgccagccgccugacuagcgaugggcucgcucggcacgugaagcagugccccaagcgcaaggagaagguggaggagacggagcuguaccugaaccucgagaggauccccugggucgugcgcaagcuguuacaggugucugagagcaccggcguagcgcucaagcggagcagcuggcugauugugcugcucgugcugcugaccgucucccucagccccgugcaguccgcuccggugggccacgggaagacgaucgagacguaccagacccgcgagggcuucaccagcaucugccuguucaugcugggguccauucucuucauagucagcugccucguuaagggccuaguggacuccgucagcgacuccuucuuccccggguugagcgugugcaagacaugcagcaucggcagcaucaacggcuucgagaucgagucccacaagugcuacugcagccuguuuugcugccccuacugccggcacugcuccgccgaccgcgagauccaccaacugcaccucagcaucugcaagaagcggaagacggggagcaacgugaugcuggccgucuguaagcgcaugugcuuccgggccaccaucgaggcgucccgccgcgcacugcucauccggagcaucaucaauaccaccuucgugaucugcaucuuaacucugacgaucugcguagcauccaccuccgccguggagauggagacccucccggccgcgacgugggagcgcgaggaggaccugaccaacuuuugccaccaggagugccaggugcccgagaccgaaugccugugccccuacgaggcccucgugcugaggaagccccuguuccucgauaguaucgucaaggggaugaagaaccuguuaaacagcaccucccucgagacgagucuguccaucgaggccccguggggcgcaaucaacgugcaaucuacauucaagcccaccguguccaccgccaacaucgcgcugagcuggagcagcgucgagcaccgcgggaacaaaauucucgugaccgggcgcuccgagagcauaaugaagcuggaggaacgcaccgggguuuccugggaccugggcgucgaggaugcgagcgaguccaagcuccugaccgugagcaucauggaccugagccagauguacucccccguguuugaguaccucagcggcgaccggcaggucgaggaguggcccaaggcgaccugcacgggcgacugcccggagcgcugcgggugcaccuccagcacaugccugcacaaggaguggccccacucccggaauuggcgcugcaacccuaccuggugcuggggcguagggaccgggugcacgugcugcggcguugacgucaaggaccuguucaccgaucacauguuugugaaguggaagguggaguacaucaagaccgaggccaucgucuguguggaacucaccagccaggagcggcaguguucccugaucgaggccgggacgcgcuucaauuugggccccgugaccaucacccucagcgagccgcggaacauccagcagaagcugccgcccgagaucaucacucugcaccccaagaucgaggagggguucuuugaccucaugcacguucagaaagugcugagugccucuacggugugcaagcuccaaaguugcacccacggcauccccggugaccuccaggucuaccacaucgggaaucugcugaagggagaccgcguaaacgggcaccucauccacaagauugagccccacuucaacaccucauggauguccugggacggcugcgaccucgacuacuacugcaacaugggggacuggcccagcugcaccuacacaggugucacccagcacaaccacgccgccuucgucaaccugcucaacauagagaccgacuacacgaagacguuccacuuccacaguaagcgggugaccgcccacggcgacacaccccagcuggaccugaaggcgcgcccgaccuacggggccggugagaucacggugcuaguggagguggccgacauggagcugcacaccaagaaggucgagauaagcgggcugaaguucgccucccucgccugcaccggcugcuacgcuugcagcuccgggaucagcugcaaggugcggauccacgucgaugagcccgacgaacugaccguucacguaaagagcagcgaccccgacguggucgccgccagcacgucccugauggcccgcaaacucgaguucggcaccgacagcaccuucaaggccuucuccgcgaugcccaagaccagccugugcuucuacauaguggagaaggaguacugcaaguccugcagcgaggacgacacgaagaaguguguggacaccaagcucgagcagccgcaguccauccucaucgaacaccggggcaccaucaucgggaagcccaacgacacgugccccgccaagacgagcuguuggcuggaguccgucaagagcuuuuucuacggccugaagaacaugcucgguucaguguucggcaacuucuucaucgggauccugcuuuuccuggcccccuucuuccucuggaugcugagcuucauguucggcuggaagauccuguuuugcuuuaagugcugccgccggacccgcggccucuucaaguaccgccaccugaaggacgacgaggagaccggguacaggcguaucaucgagcggcugaacaacaagaaaggcaagaaccgcuuacuggacggggagcggcuggccgaccgcaagaucgcggaacucuucuccacaaagacgcacaucggauga

SEQ ID NO: 15350 - RNA, 5052 nt, Artificial Sequence
  derived and/or modified CDS sequence (opt11) from CCHFV(4495-ST-2008)__KR814869.1__GP
augcacacccugcucgugugcuucauccuguaccugcagcuccugggccccgguggcgcacacgggcagccgaacgccaccgagcacaaccgcacgaacaccaccaccgcgcccagcacgucccagagccccaagcccccggucuccacggcaccaccccacgcccuggaaagccccaccaucaaguccaccaccccgaccagcgagaccgagggguccggggagaccacgccaccgcccaauaccacccagggccccaguccacccgagaccacgcccgagcggccggccaccaccgccaccuccacgcccagcaccgacaacacuaauuccaccacgcacgugaccgacaacaaccccaccagcaccaucuccacgagccccuccagcuccccgagcacccccuccacaccccgcggcauccaccaccccgcgcggaaccuccugagcgugagcuccccgaagacggccacgaccccgacucccaccagccccggugagaucuccagcgagacguccagccugcacuccgccaugagccgcaccuccacccucuacaccgccacccaggcgagcacggagaacgccaaccacuccaccccgcggcagagcgaguccccugcccagcccaccaccacgagccugaugaccucaccggcccagagcauccuggucauguccgccgcgcccaccgccauccagaacauucaccccagccccaccaaccgcuccaagcggaaccucgagauggagaucauccugacgcugucgcagggccucaagaaguacuacgggaagauccugaagcugcuccaucugacccuggaggaggacaccgagggccuccuggaguggugcaagcgcaaccuggggagcaacugcgacgacgacuucuuccagaagcgcaucgaggaguucuucaugaccggcgagggcuacuucaacgaggugcuccaguucaagacgcugucuacgcugagcccgaccgagcccucccacgccagaccacccaccguggagccguucaagagcuacuucgccaagggguuccucuccaucgacagcggcuacuucuccgccaagugcuacccccggagcuccacgagcgggcugcagcugaucaacgucacccagcaccccgcgcgcaucgccgagacccccggcccgaagaccacgucccucaagaccauaaacugcaucaaccugcgggccagcguguucaaggagcaccgcgagaucgagaucaacgugcugcucccccagaucgccgucaaccuguccaacugccacguggugaucaacagccacgucugcgacuacucccuggacaccgacggccccgugcggcucccccauaucuaucacgaggggaccuucaucccgggcacguacaagaucgugaucgacaaaaagaacaagcucaacgaccgcugcacccuugucaccaacugcgugaucaaggggcgggaggugcggaaggggcagagcguccuccggcaguacaagaccgagaucaagaucgggaagguguccacgggcagccgcaagcugcugagcgaggaauccggcgacgacugcaucagccggacccagcuccugcgcaccgagaccgccgagauccacgacgacaacuaugggggccccggggacaagaucacgaucugcaacggcuccaccaucguggaccagcgccuggggagcgagcucggcugcuacaccaucaaccgggucaaguccuucaagcugugcgagaacagcgcgaccgguaagacgugcgagaucgacuccacccccgugaagugccgacagggguucugccugaagaucacccaggagggccgggggcacgugaagcucagccgcggcuccgaggucgugcuggacgccugcgacagcuccugcgaggucaugauccccaaggggaccggcgacauccugguggacugcagcggcgggcaacaacacuuccugaaggacaaccucaucgaccugggcugcccgcacaucccccugcucgggaagauggccaucuacaucugccggauguccaaccacccccgcaccacgauggccuuucuguucugguucagcuucggcuacgugauaaccugccuguucugcaaggcccucuucuacucccugaucaucaucggcacccuggggaagaagaucaagcaguaccgggagcuccgcccccagaccugcacgaucugcgagaccgccccggucaacgccaucgacgccgagaugcacgaccugaacugcagcuacaacaucugccccuacugcgccucccggcugaccagcgacggccucgcgcgccacguuccccagugcccgaagcggaaggagaagguggaggagaccgagcuguaccugaaccucgagcgcauccccuggaucguccggaagcugcuacagguguccgagagcacugggguggcccucaagcgcagcuccuggcugaucguccugcucgugcugcugaccgugagccucucccccguccagagcgcccccgugggccacgggaagaccaucgagaccuaccagacgcgggagggcuucaccagcaucugccuguucauguugggcucaauccucuuccugguguccugccuggucaaggggcucguggacucgguguccgacagcuuuuucccgggccucuccgucugcaagaccugcagcaucggguccaucaacggauucgagaucgagagccacaagugcuacugcucccugcucugcugccccuacugccgccacugcagcgccgaccgggagauccaccaacugcacuuauccaucugcaagaagcgcaagaccgggucuaacgugaugcucgccgugugcaagcggaugugcuuccgcgcgacgaucgaggccucccgacgggcccugcugauucgcagcauuaucaacaccaccuucgucaucugcauccucacccugacgaucugcguggucagcaccuccgccguagagauggagaaccugcccagcggcaccugggagaaggaggaggaucucaccaacuucugccaccaggagugccaggugacggagaccgagugccugugcccuuacgaggcccuggugcuccggaagccgcuguuccuggacuccaucgucaagggcaugaagaaccuccugaacagcaccucccuggagaccagccucuccauugaggcgcccuggggagccauaaacgugcagagcacguucaagcccaccgugagcaccgccaacaucgcccugagcugguccagcgucgagcaccgcggcaacaagauccuggugaccgggcgguccgagagcaucaugaagcucgaggagcgcacgggcaucuccugggaccuggggguggaggacgccagcgaguccaagcugcucacugucaguaucauggaccugucccaaauguacagccccguguucgaguaccugagcggcgaccgucagguggaggaguggcccaaggcgaccugcaccggcgacugccccgagaggugcggguguacguccaguaccugccuccacaaggaguggccccacucccggaacuggcgcugcaacccgaccuggugcuggggcgucgggaccggcuguaccugcugcgggguggacguaaaggaccuguucacggaccauauguucgucaaguggaagguggaguacaucaagaccgaggccaucgucugcgucgagcuuaccagccaggaacggcagugcucccucauagaggccggcacccgcuucaaccuaggcccggugacgaucacccugagcgagccccggaacauccagcagaagcuaccgcccgagaucauaacccugcacccgaagguggaggagggguucuucgaccugaugcacguccagaaggugcucuccgccagcaccgugugcaagcugcaguccugcacgcacggcauccccggggaccugcagguauaccacaucggcaaccuccugaagggcgaccgcgugaacgggcaccugauccacaagaucgagccgcacuucaacaccagcuggauguccugggacggcugcgaccucgacuauuacugcaacaugggggacuggccgagcugcaccuacaccggcgugacucagcacaaucacgcggccuucgucaaccugcugaacaucgagaccgacuacacuaagaccuuccacuuccacuccaagcgggugaccgcccacggggacaccccgcagcuagaccugaaggcccgccccaccuacggcgccggcgagaucaccguccugguggagguggcggacauggagcuccacacgaagaaggucgagaucagcgggcugaaguucgccucccuggccugcaccggcugcuacgccugcagcuccgggaucagcugcaagguucgcauccacguggacgagcccgacgagcucaccguccacguaaaguccagcgaccccgacguggucgccgcguccaccucccugauggcccgcaagcuggaguucggcacggacagcaccuucaaggccuucuccgccaugccgaagaccagccucugcuucuacaucguggagcgggaguacugcaaguccugcagcgaggaggacacccagcgcugcguggacacgaagcuggagcagccccaguccauccugaucgagcacaaggggaccaucaucggcaagcagaacgauaccugcaccgccaaggcgagcugcuggcucgaguccgucaagagcuucuucuacggccugaaaaacaugcugggguccguguucgguaacuucuucaucggcaucuugcuguuccuggcccccuucgugcugcucguccuguucuucauguucggcuggaagauccucuucugcuucaagugcugccggcgcgcccgcggacuccugaaguaccggcaccugaaggacgacgaggagacgggcuaccgcaagaucaucgagcgguuaaacaacaagaagggcaagaaccgccugcuggacggggagcggcucgccgaccgcaagaucgcggagcuguucagcacuaaaacccacaucggcuga

SEQ ID NO: 15351 - RNA, 5052 nt, Artificial Sequence
  derived and/or modified CDS sequence (opt11) from CCHFV(Mamon)__KX013478.1__GP
augcacacccugcuggugugcuuuauacuguaccugcaacugcugggccucggcggggcccacgggcagagcaacaccaccgagcacaacgggaccaacaccacuaccgccccuuccaccagccaguccccgaagccccucgucagcacggcgccgccccacgcccuggaguccucaaccaucaagcccaccacucccgccuccgagaccgaagggagcggcgagaccacaccgccgcccaacauuacccagggccccagcccgcccgagaccaccccugaacgccccgcaacaaccgccaccagcacccccuccacugacaacaccaacagcaccacccaugugaccgacaacaaccccaccuccacgaucuccaccuccccgagcuccagccccuccacacccagcacgccacaggguauccaccacccggcccggaaucugcucucaguguccagccccaagaccgccaccacgccuacccccaccuccccgggcgagaucucauccaagaccagcucgcuucacagcgcuaugucccgaacgagcacccuguacaccgccacacaggucuccacggaaaacgcgaaccacagcgcgccccggcagagcgagagcuccgcgcaacccacaaccaccagcccgaugaccuccccggcccagagcauccucgugaugucggccgcgccuacggccauccagaacauccaccccagcccgaccaaccgcagcaaacgaaaccuggagauggagaucauccugacccucucccaggggcugaagaaguacuacggcaagauccucaagcuccugcaccugacccuagaggaggacacggaagggcugcuggaguggugcaagcguaaccucggcagcaacugugacgacgacuucuuccagaagcggaucgaggaguucuucaugaccggcgagggauacuuuaacgaaguguuacaauucaagacccuguccacccuaagccccacggagcccucccacgcccggccgcccacggucgagcccuucaagagcuacuucgccaagggcuuccuguccaucgacagcggguacuucuccgccaagugcuacccccggagcuccaccaguggccugcagcuuaucaacgugacccaacaccccgcgcgcauagccgagacgcccggccccaagaccaccucccugaagacaaucaacugcaucaaccugcgggccagcguguucaaggagcaccgugagauugagaucaacguccuccugccccagaucgccgugaaccuguccaacugccacgugguaaucaacagccacgugugcgacuauucccucgacaccgaugggcccgugcggcucccccacaucuaccacgagggcaccuuuauacccggcaccuacaagaucgucaucgacaagaagaacaagcugaacgaccgcugcacccucgugacgaacugcgugaucaagggccgggagguccgcaaggggcagagcgugcugcggcaauacaagaccgagaucaagaucggcaaggcgagcacuggcucccgcaaacugcucucugaggagcccggggacgacugcaucucccggacccagcugcugcgcaccgagaccgcggagauccacgacgacaacuacggcgggcccggagacaaaaucaccaucugcaacgggagcacaaucguggaccagcggcucggcuccgagcugggcuguuacaccaucaaccgcgucaagaguuucaagcugugugagaacuccgcgaccgggaagaccugcgagaucgacagcaccccggugaagugcaggcagggcuucugccucaagaucacgcaggaggggcggggccacgugaagcugucccgcgggagcgaaguuguguccgacgccugcgacagcuccugcgaagucaugauccccaaggggaccggcgacauccugguggacugcagcgggggccagcagcacuuccugaaggacaaucucaucgaccuggggugcccccacaucccgcugcucggcaagauggcaaucuacaucugccggaugagcaaccacccgcgcaccaccguggcguuccuguuuugguucagcuuuggcuacgucaucacgugcaucuucugcaaagcgcuguucuacucccucaucauuaucgggacucuuggcaagaagaucaaacaguaucgggagcugaagccccagacauguaccaucugcgagaccgcccccgugaacgccaucgacgccgagaugcacgaccucaacugcucauacaacaucugccccuacugugcgucccgccugacgagcgacgggcuggcccggcacgugccgcagugccccaagcgcaaggagaaggucgaggagaccgaacucuaccugaaccuggagcggauccccuggaucgugcgcaagcucuugcaagugucugaguccaccggcgucgcccugaagcggagcuccuggcucaucgugcugcuggugcuccugaccgucagccuguccccaguucagagcgcccccguggggcacggcaagacgauugagaccuaccagacccgcgagggcuucaccucaaucugucucuucaugcuugggagcauccuguuccucgucuccugccuggugaagggccugguugacucagucuccgacagcuucuuccccggguuguccgugugcaagaccuguagcaucggcuccaucaauggguucgagaucgagagccacaagugcuacugcucccuuuucuguugccccuacugccggcacugcagcgcagaccgcgagauccaccagcugcaccucuccaucugcaagaagcggaagaccggcagcaaugugaugcuggccgucugcaagcgcaugugcuuccgggccaccaucgaggccagccgccgggcccugcucauccgcuccaucaucaacaccacguucgugaucuguauccugacccugaccaucugcguggucucuaccuccgccguggagauggagaaccucccgucgggcacgugggagcgcgaggaggaccugaccaacuucugccaucaggaaugccaggugaccgagaccgagugcuugugccccuacgaggcguuaguccugcggaagccccuguuccucgacuccaucgugaaggggaugaagaaccuucugaacagcacgucccucgaaaccagccuguccaucgaggcccccuggggcgcaaucaacgugcagucgaccuucaagccgacggucuccacggccaacauagcccugagcugguccagcguggagcaccgcgggaacaagauccucgugaccggccgguccgagagcaucaugaagcucgaggaacgcaccggggucuccugggaccugggcguggaggacgcgucugaguccaagcuccuaaccguaagcaucauggaccugagccaaauguacucccccgucuucgaguaccucagcggcgaccgccagguggaggaguggccgaaggcgacgugcaccggugacugccccgagaggugcggcugcaccuccucaacgugccugcauaaggaauggccccacuccagaaacuggcgcugcaaccccaccugguguuggggcgugggcacagggugcacgugcugcggcgucgacguuaaggaccuuuucaccgaccacauguuugugaaguggaaagucgaguacaucaagaccgaggccauaguuugcguggagcucacgagccaggagcggcagugcucccugaucgaggccggcacccgcuucaaccuggggccugucaccaucacccucagcgagccccggaacauccagcagaagcugccgccggagaucaucacgcugcaccccaagguggaggagggcuucuucgaccucaugcacgugcagaagguccuguccgcgagcaccgugugcaaguuacaguccugcacccacgggauccccggcgaccuccaaguguaccacaucggcaaucugcugaagggggaccgcgucaacggacaccucauccacaagaucgagccgcacuucaacaccagcuggauguccugggacgggugcgaccuggacuacuacugcaacaugggagacuggcccagcugcacguacaccggggugacccagcacaaccacgccgccuucgucaaccugcucaacaucgagaccgacuacacgaagacguuccacuuccacuccaagcgggugaccgcccacggagacacgccccaguuggaccugaaggcccgccccacguacggcgcaggggagaucaccgugcucgucgagguggccgacauggagcugcacacgaagaagguggagaucagcggccugaaguucgccucccucgccugcacaggguguuacgccugcagcuccggcauuuccugcaagguccggauccacguugacgagccggacgagcugacgguucacgucaagagcuccgaccccgauguuguggcggccagcaccucucugauggcccgcaagcucgaguucgggacggacagcaccuucaaggccuucuccgccaugcccaagacgagccugugcuucuacaucgucgagcgggaguacugcaaguccugcagcgaggaggacacccagaagugcguggacaccaaguuagagcagccccagucaauccucaucgagcacaagggaaccaucauaggcaagcagaacgacacgugcaccgcgaagaccucgugcuggcuggaguccgugaaguccuucuucuacgggcugaagaacaugcucggcuccgucuucgggaacuuuuucaucggcauucugcuguuccucgccccguucgugcugcuggugcuuuucuucauguucggguggaagauccucuucugcuucaagugcugucgccggacccgcggucugcugaaguaucggcaccucaaggacgacgaggagacggguuaccgcaggaucaucgagcgguugaacaacaagaaggggaagaaccgccugcucgacggcgagcgccuggcagaccgcaagaucgccgagcuguucagcaccaagacccacaucggguga

SEQ ID NO: 15352 - RNA, 5052 nt, Artificial Sequence
  derived and/or modified CDS sequence (opt11) from CCHFV(81-R-2014)__KR814865.1__GP
augcacacccugcuggugugcuucauccuguaccugcagcuccugggccucggcggagcccacgggcaguccaacgccaccgagcacaacggcaccaauacaaccaccguucccuccaccagccaguccccgaagccccucgugagcaccaccccgccccacgcgcuggagucgagcaccaucaagcccaccacccccaccuccgagaccgaggggucuggcgagacggcgccccugcccaacaccacccagggcccgccgccacccgagaccacgccggagcggcccgccaccacugugaccuccacgcccagcaccgacaacaccaacuccaccauccacgugacggacaacaacccaaccagcaccaucuccaccagcccguccagcucccccagcacgcccuccacgccccaggggauccaccacccggcccggagccuccuaucuguguccagccccaagaccgccaccacgcccacccccaccuccccgggcgagaucaacagcgagaccuccagccugcacuccgccaugagccgcacgcccacccuccacaccgcuacccagguguccaccgagaacgccaaccacagcgcgccccggcaguccgagagcuccgcccagcccacgaccacgagcuugaugaccuccccggcccagagcauccugcucauguccgccgcccccacggccauccagaacacccaccccagcccgaccaaccgcuccaagcggaaccuggagauggagaucaucuugacccuuagccaggggcugaagaaguacuacggcaagauccugaagcuccugcaccugacgcucgaggaggacacagaggggcugcucgaguggugcaagaggaaccucggcagcaacugcgacgacgacuucuuccagaaacggaucggcgaguucuucaugaccggggagggcuacuucaacgagguccugcaguucaagacccuguccacgcucagccccaccgagccgucccacgcgcgccugcccaccguggagccguucaagagcuacuucgccaagggguuccuguccaucgacagcggcuacuucuccgcuaagugcuacccccggagcuccaccagcggccuccagcugaucaacgugacgcagcaccccgcccgcaucgccgagacccccgggccgaagaccaccucccugaagacgaucaacugcaucaaccuccgugcgagcgucuucaaggagcaccgcgagaucgagaucaacgugcugcugccccagaucgccgugaaccucuccaacugccacgucgugaucaacagccacgugugcgacuacucccuggacaccgacggccccguccggcugccccacaucuaccacgaggggaccuucaucccgggcaccuacaagaucgugaucgacaagaagaacaagcucaacgaccgcugcacgcucgugaccaacugcgucauuaaggggcgggaggugcgcaagggccagagcgugcugcggcaguacaagacggagaucaagaucggcaaggccuccaccgggagccgaaagcuccugagcgaggagcccggcgacgauugcaucagucggacgcagcuccuccgcacagagaccgcggagauccacgacgacaauuacgggggccccggggacaagaucaccaucugcaacggcucgacgaucgucgaccagcggcugggguccgagcuggggugcuacaccaucaaccgagucaagagcuucaaacugugcgagaacuccgccacuggcaagaccugcgagaucgacagcacgcccgugaagugccgccagggguucugccucaaaaucacccaggagggccgggggcacgucaagcugucccgcggcagcgaggugguccuggacgcgugcgacaguagcugcgaggugaugauccccaagggcaccggggacauccucguggacugcuccggcgggcagcagcacuuccugaaggacaaccugaucgaccucggcugcccccacaucccccugcugggcaagauggcuaucuacaucugccggaugagcaaccacccccgcaccacaauggccuuccucuucugguuuuccuucggguacgucaucacgugcaucuucugcaaggcccuguucuacagccugaucaucaucggcacccucgggaaaaagaucaagcaguaccgagagcugaagccgcagaccugcacgaucugcgagacggcccccgugaacgcgaucgacgccgagaugcacgaccugaacugcuccuacaacaucugccccuacugcgccagccgccucaccuccgacggccuggcccggcacgugccccaguguccgaagcgcaaggagaaggucgaggagaccgagcuguaccucaaccuggagcggauccccuggaucgugcgcaagcugcuccaggugagcgaguccacgggggucgcgcugaagcggagcagcuggcugaucguacuccuggugcugcucacggucucccugagccccguacaguccgccccggugggccacggcaagaccaucgagacguaccagaccagggagggguucacgagcaucugccuguucaugcucgguuccauccuguuccuggucagcugccuggugaaggggcugguggacuccgucagcgacagcuucuuccccggccugagcgugugcaagaccugcuccaucgggucuaucaacggcuucgaaaucgagucccacaaaugcuacugcagccucuucugcugccccuacugccggcacugcuccgccgaccgcgagauccaccagcuccaccugagcaucugcaagaagcggaagaccggcuccaacgugaugcucgccgucugcaagcgcaugugcuuccgagccaccaucgaggcgagccgccgggcacugcugauccgcuccaucaucaacacgaccuucgugaucugcauccucacccugaccaucugcguggucagcacgagcgccguggagauggagaaccugcccgccgggaccugggagcgcgaggaggaccucaccaacuucugccaccaggagugccaggugaccgagacggagugccugugcccguacgaggcccugguccuccggaagccccuguuccuggacuccaucgugaagggcaugaagaaccuccugaacagcaccucccuggagaccagccucuccaucgaggcgcccuggggcgccaucaacgugcagagcaccuucaagcccacgguauccaccgccaacaucgcccugagcugguccagcguggagcaccgcgggaacaagauccuggugaccgggcgguccgagagcaucaugaagcucgaggagcgcaccggggucuccugggaccucggcguggaggacgccagcgaguccaagcugcucacggugucaaucauggaccugucccagauguacagcccggucuucgaguaccucaguggggaccgccagguggaggaguggcccaaggcgaccugcaccggcgacugccccgagcgcugcgggugcaccagcagcacgugccuccauaaggaguggccccacucccggaacuggcgcugcaacccgaccuggugcuggggcguggggaccggcugcacgugcugcggcgucgacgugaaggaccuguucaccgaccauauguucgugaaguggaaggucgaguacauaaagacggaggccaucgugugcguggagcugaccucucaggagcggcagugcucccucaucgaggccgggacccgcuucaaccugggccccgucaccaucacgcugagcgagccccggaacauccagcagaagcugccgccugagaucaucacucuacaccccaagguggaggagggguucuucgaccuaaugcacgugcagaagguccucuccgccagcaccgugugcaagcugcaguccugcacccacggcauccccggcgaccuccagguguaccacaucgggaaccuccugaagggcgaccgcaucaacgggcaccugauccacaagaucgagccccacuucaacacgagcuggauguccugggacggcugcgaccucgacuacuacugcaacaugggggacuggcccagcuguaccuacaccggcgucacccagcacaaccacgcggccuucgugaaccugcugaacaucgagacggacuacaccaagaccuuccacuuccacuccaagcgggucaccgcccacggcgacacgccccagcucgaccugaaagcccgacccacuuacggggccggcgagaucaccgugcugguggaggucgcggacauggagcuccacaccaagaagguggagaucagcgggcugaaguucgccucccuggcuugcacuggcugcuacgccuguucuuccgggaucuccugcaaggugcggauccacguugaugaacccgacgagcucaccgugcacgugaaguccagcgacccggacgucguggccgcguccaccagccugauggcccgcaagcuggaguucggcaccgacagcacguucaaggccuucuccgccaugcccaagaccagccucugcuucuacaucguggagcgggaguacugcaaguccugcagcgaggaggacacccagaagugcgucgacacccgccuggagcagccccaguccauccugaucgagcacaaaggcacgaucaucgggaagcaaaacgacacgugcaccgccaaggcgagcugcuggcucgaguccgucaagagcuucuucuacggccugaagaacaugcugggguccguguuuggcaacuucuuuaucgggauccuccuguuccuggcacccuucguacugcucgugcuguucuucauguucggcuggaaaauacuguucugcuucaagugcugccggcgcacccgaggccuccugaaguaccgccaccugaaggacgacgaggagacgggguaccgccggaucaucgagcgccucaacaacaagaagggcaagaaccgacugcuggacggggagcgccucgcagaccggaagauugccgaguuguucagcaccaagacccacaucggcuga

SEQ ID NO: 15353 - RNA, 5052 nt, Artificial Sequence
  derived and/or modified CDS sequence (opt11) from CCHFV(5180-R-2011)__KR814874.1__GP
augcacacacugcuagugugcuucauuuuauaucugcagcuccugggccucgggggagcccaccgccagagcaacgccaccgagcacaauggcacgaacacaaccaccgcgcccuccacgucacaguccccgaaaccgcccgucucgaccgccccaccuuaugccccugagaguucaaccaucaaacccacgacgcccgccuccgagaccgaaggaagcggagaaaccacgccuccgcccaacaccacccagggcccguccccgccggaggccaccccugagcgccccgccaccacggccacauccaccccuuccaccgacaacacuaauagcaccacacacgccaccgacaacaaccccacguccaccauuagcaccagucccucauccagucccuccaccccgagcacgccccaggguauccaccacccugcccgaaaccuccugagcgugucuucacccaaaacagcgaccacuccgacccccacgucgcccggggacauaaguuccgaaaccagcucccuucauagcgccaugucucgaaccccaacgcuccacaccgccacccaggccagcaccgaaaaugccaaccacucugcgccacgacagagcgagucuagcgcccagcagaccacgaccucccccaugaccagccccgcccagcccauacuggucauguccgccgcccccaccgcgauccagaacauccaccccagccccacgaaccgcuccaaacgcaaccuggagauggagauaauccucacccugagccaagggcugaagaaguacuacggcaagauccucaagcugcugcauuugacgcuggaggaggacacagaaggccugcucgaguggugcaaacggaaccuggggucaaacugcgacgacgacuucuuccaaaagcggaucgaagaguucuuuaugacgggcgagggcuacuucaacgaaguccugcaguuuaagacccuuuccacccugagcccuacugagccuucccaugcccggccgcccacgguggagccauucaagagcuacuucgcuaaaggauuccuuucuaucgauucaggauacuucuccgccaaaugcuauccucggcucuccaccuccgggcugcagcugaucaacgugacccaacaucccgcccggaucgcugagacccccggcccgaagacgaccagccucaaaacaaucaacuguaucaaccugcgcgcaucagucuucaaggagcaccgcgagaucgagauaaacguacugcucccccaaaucgccgugaacuuaaguaauugccacguagucauaaacucccacgugugcgacuacaguuuggacaccgauggcccaguccgccucccccacaucuaucacgaagggacguucaucccgggaaccuacaagauagugauugacaagaaaaacaagcugaacgaccgaugcacccuggugaccaacugcgucaucaaagguagagagauccgaaagggucaguccguguuacgccaauacaagacggaaaucaagauugggaaggccagcacagguucccguaagcugcugagcgaggagcccggcgacgacugcaucagccgcacgcagcuccugcggaccgaaacugccgagauccacgacgauaacuacggaggucccggugacaagaucacuaucugcaacggcucuaccauaguggaucaacgccuggggucagagcucggcuguuacacuaucaaccgcgucaaguccuucaaacuuugugagaacagcgccacgggcaagaccugugagauagauuccaccccagugaaaugucggcaggguuucugccugaagaucacccaggagggucgugggcacgugaaacuuucucgcggcuccgaaguggugcuggacgccugcgacacaagcugcgaggugaugaucccgaaggggaccggggauauccuggucgauuguuccggcggucagcagcacuuccugaaagacaaccucaucgaccucggcugcccccacaucccccugcucgggaagauggccaucuacaucugcagaaugucuaaccacccgcggacaacgauggccuuucuauucugguuuuccuucgguuaugugauaacgugcauuuucuguaaagcgcuguuuuacagccucaucaucaucgguacccugggcaagaagauuaagcaauaucgcgagcugaagccacagacaugcaccaucugcgagaccgcccccgugaacgcaauagacgccgaaaugcacgaccuaaacugcuccuacaauaucugccccuacugcgccucacggcucacguccgacggccuggcgcgccacgugccacagugccccaagcgaaaggagaagguggaggagacagagcuauaccugaaucuggaacgcauccccuggaucguucggaagcuccuacaggugagcgagucuaccggaguggcccugaagaggucguccuggcugauuguccuguuggugcuccuaacgguaagccugucgcccguccaguccgccccagugggccacgguaaaacgauugagacguaucaaacccgugagggcuucacuuccguaugucucuucaugcugggcuccauccucuuccucgucuccugcuuagugaagggacuggucgacuccgucucagauuccuucuucccaggacucagcguguguaagacguguuccaucgggagcaucaacggcuucgagaucgagucucacaagugcuacugcagccuguuuugcugccccuauugccgccauuguucagccgacagggaaauccaucagcuccaucucagcaucuguaagaaacgaaaaaugggguccaacgugaugcucgccgucuguaaaagaaugugcuuccgcgcgaccaucgaagccagucgucgcgcccuacugauccgcuccaucaucaauacaaccuuugugauaugcauccugacgcugacuaucugugugguuaguaccuccgccguggagauggaaaaucugcccucgggcaccugggagcgggaggaggaccugacgaacuucugccaucaggagugucaggugaccgagacugagugccugugcccguacgaagcccucguccugcgcaagccccucuuccucgacagcaucgugaaaggcaugaagaacuugcuuaacuccaccagccucgagacgucccugagcaucgaagcgcccuggggcgccauaaacgugcagucaaccuucaaacccaccgucagcaccgccaauaucgcucuguccuggagcucgguagagcaccgggggaacaaaauccucguuacggggcguucugaauccaucaugaagcuagaggagcggacaggggucucuugggaucuggggguggaggacgcgucggagagcaagcuccugaccguguccaucauggaccugagccaaauguacuccccuguauuugaauaccucucaggggaccgucaaguggaggaauggccuaaggcgacaugcacaggggauugcccugagcggugcggguguacguccuccaccugucugcacaaggaguggccucauagccgcaacuggcguugcaauccuaccuggugcuggggcgucgggaccggcugcacguguuguggggucgaugucaaagaucuguucaccgaccacauguucgugaaguggaaggucgaguacauaaagaccgaagcgauugugugcguggaacucacaucucaggaacgccagugcagcuuaaucgaggccggcacgcgguucaaccugggccccguaacaaucacccucucugagccaagaaacauccagcagaaacugccgccggagaucaucacccuacaccccaagguggaggaagguuucuucgaccucaugcacguacagaaggucuuaucggccuccacggugugcaagcuacagagcugcacacacgguaucccgggggaucuacagguuuaucacaucgggaaucugcugaaaggagaccgggugaacggccacuuaauccacaagaucgagccccacuuuaacacgucguggauguccugggacggcugcgaccucgacuacuacugcaacaugggggacuggccguccuguaccuacacgggagugacccagcacaaucacgccgccuuugugaaccuccucaacaucgagacggacuacaccaagacuuuucacuuccacagcaagcgcgucaccgcccauggagacacgccccagcuggaccugaaagcccggccgaccuacggcgcgggcgagaucaccgugcucgucgagguggcugacauggagcuucacaccaagaaagucgagauaucaggguugaaguucgccagccucgccugcaccggcugcuacgccugcaguagcgggaucuccugcaagguccgcauccauguggacgagccugacgaacugaccguacacguuaagucaaacgaccccgacguaguggccgcguccaccagccugauggccagaaaguuagaguuugguaccgacuccaccuucaaggccuuuagcgcaaugcccaagaccagccuguguuucuacauugucgaacgcgaguacugcaagaguuguucagaggaggacacccagaaguguguugacaccaagcuggagcaaccccagagcauucucaucgaacacaaggggaccaucaucgguaagcagaacgauacgugcacugccaaggccucguguuggcuugaguccgucaagagcuuuuucuacggccuaaagaacaugcucggguccguauuugggaacuucuucaucgggauccuacuguuccucgcgccguucgugcuccuaguacuguucuucauguucggguggaagauccucuucugcuucaaaugcugccggagaacccgugggcuccugaaguaccgccuccugaaggacgacgaggagacgggcuaccgccgaaucaucgaacgccuuaacaauaagaagggcaagaaccggcuccuggacggggagcgacuggccgaccgcaagaucgcggagcuauuuagcaccaagacgcacauaggcuaa

SEQ ID NO: 15354 - RNA, 5052 nt, Artificial Sequence
  derived and/or modified CDS sequence (opt11) from CCHFV(24-R-2012)__KR814856.1__GP
augcauacccuguuagugugcuucauucuguaccugcagcuccugggccuugggggcgcccaccgccagagcaacgccaccgagcacaaugggacgaacaccaccaccgcgcccuccacgagccaguccccgaagccgcccgucagcaccgcgccgccacacgccccugaguccagcaccaucaagcccaccacgccagccuccgagaccgagggcagcggcgagaccacgcccccgcccaacaccacccagggccccuccccgcccgaggccacccccgagcggaccgccacgaccgccaccagcacccccuccaccgacaacacgaacagcaccacgcacgccacggauaacaacccgacguccacaaucuccaccucccccagcuccagccccuccacccccagcaccccgcagggcauccaucaccccgcccgcaaccucuuaagcguguccagccccaagaccgcgaccacgccuaccccgacgucccccggcgacaucagcuccgagacaucuucccugcacagcgccaugucccggacgcccacccuccacaccgccacccaggcuucuaccgagaaugcaaaccacagcgcgccccgacaguccgaauccagcgcccagcaaacgacuaccuccccgaugaccagccccgcccaacccauccuggugauguccgccgccccgacggcgauccagaacauccaccccagcccgaccaaucgguccaagcgcaacuuggagauggagaucauccucacccugagccagggccugaagaaguacuacgggaagauucucaagcucuugcaccugacccuggaggaggacacggagggccugcucgaguggugcaagcgaaaccuggggagcaacugcgacgacgauuucuuucaaaagcgcaucgaggaguucuucaugaccggcgaaggcuauuucaacgagguacugcaguucaaaacacuuuccacgcugagccccacggagccgucccacgcccggccgcccaccguggagcccuuuaagagcuacuucgccaagggguuccugagcaucgacagcggcuacuucuccgccaaguguuacccccgccucagcaccuccgggcugcagcugaucaacgugacccagcaccccgcccggaucgcggagacgcccggccccaaaaccaccagccucaagaccaucaacugcaucaaccugcgcgccuccgucuucaaggagcacagagagauugaaaucaaugugcugcucccgcagaucgccgugaaccugagcaacugccacgucgugaucaacucacacgugugcgacuauagccuggacacggacggccccguucgccucccccacaucuaccacgaggggaccuucauccccggcaccuacaagaucgucaucgacaagaagaacaagcugaacgaccggugcacucuuguuacgaacugcgucaucaagggacgugaggugcggaagggccaguccgugcuccgucaguacaagaccgagaucaaaaucggaaaggcaagcacgggcuccagaaaacugcuuagcgaggagccgggcgacgacugcaucagccgcacccagcuccugcggacggagaccgccgaaauccacgacgacaacuacgggggccccggggacaagauaaccaucugcaacggcuccaccaucgucgaccagcgccuggggagcgagcucggcugcuacacgaucaaccgcgugaaguccuucaagcugugcgagaauagugcgaccgguaagaccugcgagaucgacuccacccccgugaagugccggcagggguucugccugaagaucacgcaggagggucgcgggcacgucaagcugagccggggaagugagguggugcuggacgccugcgacacaagcugcgaggucaugauucccaagggaaccggcgacauccugguugacugcuccggcgggcagcagcacuuccugaaggacaaccucaucgaccugggcugcccgcacaucccccugcucggaaagauggccauuuacaucugccgcaugagcaaccacccccggaccaccauggccuuccuguucugguuuuccuucggcuacgucaucacgugcaucuucugcaaggcgcuguucuacagccucaucaucaucggcacccuggggaagaagaucaagcaguaccgcgagcucaagccgcagaccugcaccaucugcgagacugccccggugaaugccaucgacgcagagaugcacgaccucaacugcuccuacaauaucugccccuauugcgcaagccggcugaccuccgacggccuggcgcgacacgugccccaaugcccgaagcggaaggagaaggucgaggagaccgagcucuaccugaaccuggagcgcauucccuggauagugcggaagcuccuacaggugagcgaguccaccggggucgcccugaagcggagcuccuggcuaaucgugcugcuggugcuccugacggucagccugagccccgugcaguccgcgcccgugggccacgggaagaccaucgagacguaccagacccgggagggguucacgagcgucugccucuucaugcugggcuccauccuguuccucgugagcugccuggugaaggggcuggucgauuccgugagcgacuccuucuucccaggccucagcgugugcaagaccuguuccaucggcagcauaaauggcuucgagaucgagucccacaagugcuauugcucucuguucugcugcccuuacugccgccacugcucggccgaccgggagauccaccagcugcaccucagcaucugcaagaagcgcaagaugggguccaacguuaugcuggccgugugcaagcggaugugcuuccgcgcgaccaucgaggccagccggcgcgcccuguugauccgauccaucaucaacaccacguucgugaucugcauccugacccugacaaucugcgucgugagcaccuccgccguggagauggagaaccuccccagcggcaccugggagcgugaggaggaccugaccaacuuuugccaccaggagugccaggucaccgagaccgagugccugugcccguaugaggcccucguccugcgcaagccgcuguuccucgacagcauugucaagggcaugaagaaccugcugaacucgacaagccucgagaccucccugucaaucgaggcgcccuggggcgccauuaacguccagucuaccuucaaacccaccgugagcacggccaacaucgcccuguccuggagcuccguggagcaccgggggaauaagauccucgucaccgggcgcagcgaguccaucaugaagcuggaggagagaaccggcgugagcugggaccuggggguggaggacgcguccgagagcaagcuccugaccgucuccaucauggacuugagccagauguacuccccaguguucgaguaccucagcggcgaccgccagguggaggaguggccgaaggccacgugcaccggcgacugccccgagcggugcggcugcacuuccagcacgugccugcacaaggaauggccccacagccgcaacuggcggugcaaccccaccuggugcuggggcguagggaccggcugcacgugcugcgggguggacgugaaggaccucuucaccgaucacauguucgucaaguggaagguggaguacaucaagaccgaagccaucgugugcgucgaacucacuucccaggagcgccagugcucccugaucgaggccggcacccgguucaaccugggcccggugaccaucacccucuccgagccccgaaacauccagcagaagcugccgcccgagaucaucacgcugcaccccaagguggaagagggguucuucgaccucaugcacguccagaaggugcugagcgccuccaccguguguaagcugcaaagcugcacccacggcauccccggggaucuccaggucuaccacaucggcaaccugcugaagggggaucggguuaacgggcaucucauucacaagaucgagccccacuucaacaccuccuggaugagcugggacggcugcgaccuggacuacuacuguaacaugggcgacuggcccuccuguacguacaccggcguuacccagcacaaccacgcggccuucgucaaccugcucaacaucgagaccgacuauacgaagaccuuccauuuccacagcaagcgcgugaccgcccacggugacacuccacagcuggaccugaaggcccggcccaccuacggcgccggcgagaucaccguccucguggagguggcagacauggaacugcacaccaagaaggucgagaucuccggguugaaguucgccagccucgccugcaccggcugcuacgccugcuccagcgggaucuccugcaaggugcgcauccacguugacgagcccgacgaguugacgguccacgucaagagcaacgaccccgacgugguggccgcguccacuagccugauggcccgaaagcuggaguucggcaccgacuccaccuucaaggccuucagcgccaugccgaaaacgagccugugcuucuauaucguggagagagaguacuguaagaguugcagcgaggaggacacccagaagugcguggauacaaagcuggagcaaccucaguccauccucaucgagcacaaggggaccaucaucggcaaacagaacgacacuugcaccgcgaaggccagcuguuggcuagaguccgucaagucuuucuucuacggccugaagaacaugcucggguccguguucggcaacuucuucaucgggauacugcuguuccucgccccuuucgugcugcugguccuguucuuuauguucggcuggaagauccucuucugcuucaaaugcugccggcgcacccgggggcugcugaaguaccgccuccugaaagacgacgaggagaccggauaccgccggaucauugagcgcuugaacaacaagaagggcaagaacagacuccuggacggggaacgcuuggccgaccggaagaucgccgagcuguuuucgacgaaaacccacaucggcuga

SEQ ID NO: 15355 - RNA, 5052 nt, Artificial Sequence
  derived and/or modified CDS sequence (opt11) from CCHFV(46-ST-2012)__KR814860.1__GP
augcacacucuacucgucugcuucauccuuuaccuucaacuccucgggcucggcggugcacacggccaaagcaacgccacugaacacaauggaaccaacacaacaacagucccaucgacgucacaaucacccaaaccccuagucuccacgacacccccacaugcucuugaaucaagcacuaucaaaccaacaacccccacgagcgaaaccgagggcucuggugaaaccgccccacuaccgaacacuacucaaggcccgcccccacccgaaaccacuccggaaagacccgcgacgacagucaccuccaccccguccacagacaauaccagcucgacaauccacguaaccgauaacaaccccacauccaccaucuccacgucaccaagcucuaguccuaguacccccucuacaccccagggcauacaccaccccgcacgcagccugcucagcgucagcagccccaaaaccgcaaccacccccacccccaccuccccaggcgaaauaaacucugaaaccuccucccuacauagugccaugagccgaacgccuacacuccacaccgcaacccaagucuccacagaaaacgccaaccacuccgccccgcgccaauccgagucauccgcccaaccgaccacaacaucccucaugacaucccccgcacaauccauccuccuuauguccgccgcccccacugcaauccagaacauacauccaucacccacaaaccgcuccaagaggaaccuugaaauggagauaauccuaacuuuaucccaaggguugaagaaauacuacggcaagauccuaaaacuccuacaccuuacacuggaagaagacacggaaggacuccuagaauggugcaaacggaaccuuggcuccaacugugaugaugauuucuuccagaaaaggaucgaagaguucuucaugacaggcgaaggcuacuucaacgaagucuuacaauucaaaacccucaguacccugucccccacagaacccucccacgcacgauuaccaacuguagaaccauuuaaaagcuauuuugcuaagggguuccucaguguagauaguggcuauuucagcgcaaagugcuauccacgauccuccacgagcgggcugcaacuaaucaacguaacucaacaccccgcacgcaucgcagaaacaccgggcccaaagaccaccucacucaaaacuaucaacugcaucaaccuccgagccagcgucuucaaagaacaccgcgaaauagaaauaaacgugcuacucccccaaaucgccgugaaccucuccaacugccacgucgucaucaacucgcacguaugugacuacagcuuggacaccgaugguccuguccgccucccucacaucuaccacgaaggcacguucaucccggggacuuacaaaauaguuauagacaagaagaacaaguuaaacgacagaugcaccuuaguaacgaacugugucaucaagggccgagaaguacgaaagggccagagcgugcuccgccaauacaaaaccgaaaucaaaauaggaaaagcaucgacgggcucccgaaaacuucucucagaagaacccggugacgacugcauuucccggacgcaacuucuccgaacggaaaccgccgaaauccacgacgacaacuacggagguccgggcgacaagauuacuauuugcaauggcuccacaaucguagaccaacggcucggguccgaacucggcuguuauaccaucaaccgcgugaagucguuuaaacugugcgaaaacucagccacgggcaaaacaugugaaaucgacagcacccccguuaaauguaggcaaggcuuuugccuaaaaaucacacaggagggccgcggacacguaaaacuuagccgagguuccgagguuguucucgacgcaugugacucgucaugugaagucaugauaccaaagggaacuggcgauaucuuagucgacugcucugguggacaacagcacuuccuaaaagacaaccucaucgaccuagggugcccacacauacccuuacuugggaagauggccauauauauaugccgcaugagcaaccacccccgcaccaccauggccuuccuauuuugguuuuccuucggauauguuaucacgugcauauucugcaaagcucucuucuacucccuaauaauaaucgggacgcucggcaaaaagaucaaacaauaucgagaacucaagccucaaacaugcacaaucugugaaaccgcuccggucaacgccauagacgcggaaaugcaugacuuaaacuguucauacaacaucugccccuacugugccucgagacuuaccagcgacggccucgcuagacacgugccccaaugcccaaagcgcaaggaaaaagucgaagagacggagcuauaccucaaucucgaacgaauaccauggauuguccguaagcuccuacaagugucagaaucgaccggcgucgcgcucaaacgaaguucuuggcuaaucguccugcuugucuuacucaccgugucccucuccccgguacaauccgcuccagucggucacggcaaaacgaucgaaacauaucaaacuagagaagguuuuaccuccauaugccucuucauguugggcagcauccuuuuccuugucucaugucuaguaaaggggcuagucgacucaguuucugacuccuucuucccuggucucagcgucugcaaaacguguuccauaggcucuauuaacgguuucgaaauagaaagccacaaaugcuacuguucccuuuucugcuguccauacugccgccacugcucugccgaucgagaaauccaccaacugcaucucuccaucugcaagaaacgcaaaacagguucaaauguaaugcucgccguaugcaaacgcaugugcuuucgcgcaacuauagaagcuagccgccgcgcccuccuuaucagaagcaucaucaaugccacauuugugauaugcauccuaacccuuacgauauguguagucucaaccuccgccguagaaauggagucucuaccugcuggcacaugggagcgagaagaagacuugaccaacuucugccaccaagaaugccagguaaccgaaacggaaugccuaugccccuacgaagcccucguccucagaaagccacuguuccuggacuccauaguaaaaggaaugaagaaccuccucaauucaacgucccuagaaaccagccuauccauagaagccccauggggagcgauaaacguacaaucaaccuuuaaaccaaccgucagcaccgccaacaucgcucucagcuggucaucggucgaacaucgcggaaacaagauucuaguaaccggacgauccgaauccauuaugaaacuagaggaacguaccgggguaagcugggaccuaggcguagaagacgccucggaaucgaaacuucuaaccgucagcauaauggaccuaucccaaauguacucccccguauuugaauaccuaaguggugaccgccaggucgaggaauggccaaaagccacgugcacaggggacugccccgaaagaugcggcugcaccuccagcacuugccuacauaaggaguggccgcacucacgcaacuggcguugcaacccaacguggugcuggggugucggcacagggugcacaugcugugggguagauguuaaggaccuuuucacagaccacauguucguaaaauggaaaguagaauauaucaaaacagaagccauaguauguguagaacuaacaucccaagaacgccaaugcucccuaaucgaagccgggaccagauucaaccucggaccagucaccaucacccucuccgaaccgcggaacauacaacaaaaacucccuccugaaaucauuacccuacaucccaagguagaggaaggcuucuuugaccucaugcacguacaaaaggugcucucggcgagcaccgucugcaaacuccaauccugcacacacggcauuccuggcgacuuacaagucuaccacaucggaaaccugcucaaaggagaccgcauaaacggccaccuuauccacaagauagaaccacacuucaauacuucauggaugucaugggauggcugcgaccucgacuauuacuguaacaugggugacuggccaucaugcacauauacaggcgucacccagcauaaccacgcagccuucgucaaucugcuuaacauagaaaccgacuauaccaagaccuuucacuuccacucgaaacggguaacggcccacggagacacaccccaguuagaccucaaggccagaccuacauauggagccggcgaaaucaccguucucguagagguugcagauauggaacuacauaccaagaaggucgaaaucucaggcuuaaaauucgcgucccuugcaugcacgggaugcuacgcgugcucaucaggcauuuccugcaaagucagaauccacguggacgagcccgacgagcugacugugcacgucaagucauccgacccugacgucguugcggcauccacuucccuuauggcgcgaaagcucgaguucggaacagauuccaccuucaaggccuucuccgcuaugccaaaaaccagccuguguuuuuauauaguugaacgcgaauacugcaaaucaugcagugaagaagacacccaaaaaugcguggacacccgccuagaacaaccacagagcauccuaauagaacacaaaggaacaauaaucgggaaacaaaacgacaccuguacagcaaaagccagcugcuggcuggagucgguaaaaucauucuucuauggccugaaaaacaugcuaggcagcguuuuuggcaacuuuuucauaggaauccugcuauuucucgcgcccuucguguuacuuguccucuuuuucauguucggguggaaaauacuauucugcuuuaaaugcugccgccgaaccagaggacuacucaaauacagacaccuaaaagacgacgaagaaaccggcuaccgccgcaucauagaacgucuuaauaacaagaaagggaaaaacaggcuuuuagauggcgaaagacucgccgacagaaaaauagcggaacuauucagcaccaaaacucacauaggauaa

SEQ ID NO: 15356 - RNA, 5052 nt, Artificial Sequence
  derived and/or modified CDS sequence (opt11) from CCHFV(ROS/HUVLV-100)__DQ206448.1__GP
augcacacccugcuggugugcuucauacuguacuugcagcuccugggccucggcggggcccaccgccagagcaacgcaaccgaacacaacgggaccaacaccaccaccgccccguccaccagccaguccccgaagccccucgucagcaccgcuccgccccacgcccuggaguccagcaccaucaagcccaccacucccguguccgagaccgaagggagcggggagaccacgcccccgcccaacaccacccagggccccagcccgcccgaggccacccccgagcgccccacuaccacggccaccagcacccccuccacggacaacaccaacagcaccacccacgugacggacaacaaccccaccuccaccaucagcaccagcccgagcucgagcccuuccacgcccagcacgccccagggcauucaccacccggcgcgaaaccugcuaagcgucuccagcccaaagaccgccaccacgcccacccccaccucaccgggggagaucagcuccgagaccagcucccugcacagcgccaugucccggacgagcacgcuguacaccgcgacccagguguccaccgagaacgcgaaccacagcgcgccccgccaguccgagagcuccgcgcaacagacgaccaccagccccaugaccucacccgcccagagcauccucgugauguccgccgcgccgacggccauacagaacauccaccccagccccaccaaccggagcaagcgcaaccuggagauggagaucauccugacccucucccagggccugaagaaguacuacgggaagauccugaagcuccugcaccugacccucgaggaggacacggagggccugcuggagugguguaaacggaaccucgggagcaacugcgacgacgacuucuuucagaagagaaucgaggaguucuucaugaccggcgagggcuacuucaacgagguccugcaguucaagacccuguccacccucucuccgacggagcccucccacgcccggccgcccaccguggagccguucaagagcuacuucgccaagggguuccuguccaucgacagcggcuacuucuccgccaagugcuacccccgccugagcaccuccgggcuccaguugaucaacgugacccagcaccccgcgcggaucgccgagacgcccgguccgaagaccaccagccugaaaaccaucaacugcaucaaccuccgcgccuccgucuucaaggagcaccgggagaucgagaucaacgugcugcugccccagaucgccgugaaccucagcaauugccacgucgugaucaacucccacgugugcgacuacagccuggacacggacggccccguccgccugccccacaucuaccacgagggcaccuucauaccgggcaccuacaagaucgugaucgacaagaagaacaagcucaacgaccggugcacacuggugacgaacugcgucaucaaggggcgugaggugcggaagggccaguccgugcugcgccaguacaagaccgagaucaagaucgggaaggccagcaccggcagccggaagcuccuguccgaggagcccggagacgacugcaucagccgcacccagcugcuccgcacggagaccgcggagauccacgacgacaauuacgggggccccggggacaagaucaccaucugcaacggcuccaccaucgucgaccagcggcuggggagcgagcugggcugcuacacgaucaaccgcgugaaguccuucaagcucugugaaaacagcgccaccggcaagaccugcgagaucgacuccacccccgugaagugccggcagggguucugcuuaaagaucacgcaggagggccgcgggcacgucaagcugagccggggcuccgaggugguccuggacgccugcgacagcuccugcgaggugaugaucccgaagggaaccggcgacauccucgucgacugcagcggcgggcagcagcacuuucugaaggacaaccugaucgaccucggcugcccccacaucccccugcuagggaagauggccaucuacaucugccgcauguccaaccacccccggaccaccauggccuuccucuucugguucagcuucggcuacguaaucacgugcaucuucugcaaggcgcuuuucuauuccuuaaucaucaucggcacgcucgggaagaagaucaagcaguaccgcgagcugaaaccgcagaccugcaccaucugcgagaccgcccccgugaacgccaucgacgccgagaugcacgaccugaacugcagcuacaacaucugccccuacugcgcgucucggcucacgagcgacggccuggcccgccacgugccccagugcccgaagcggaaggagaaggucgaggagaccgagcuguaccucaaccuggagcgcaucccauggaucgugcgcaagcugcuccagguguccgagagcaccggggucgcccugaagcgcagcuccuggcugaucgugcuccuggugcugcucaccgucagccugucccccgugcagagcgcgccggugggccacgggaagacgaucgagaccuaccagacccgggagggcuucaccuccaucugccuguuuaugcucgguagcauccuguuccuggucuccugccucgugaaggggcugguggacucggucuccgacagcuucuucccaggccuguccgugugcaaaacgugcagcaucggguccaucaacggcuucgagaucgagagccacaagugcuacugcucccucuucugcugccccuacugcaggcacugcagcgccgaccgcgagauccaccagcugcaccugaguaucugcaagaagcgcaagaccgggagcaacgugaugcucgcggucugcaagcggaugugcuuccgcgccaccaucgaggccucccggcgcgcccuacugauccgcagcaucaucaacaccacguucgucaucugcauccucacccugaccaucugcguggucagcaccuccgccguggagauggagaaccugcccagcggcacgugggagcgggaggaggaccucaccaacuucugccaccaggagugccaggugaccgagaccgaaugccugugcccguacgaggcgcuuguccuccgcaagccccuguuccuggacuccaucguuaagggcaugaagaaccuccugaacagcacgucccuggagaccagccucuccaucgaggcccccuggggcgccaucaacgugcagagcacauucaagcccaccgucuccacggccaacaucgcccugagcugguccagcguggagcaccggggcaauaagauccuggugaccgggcgcuccgagagcaucaugaagcucgaggagcggacaggcgucuccugggaccuggggguggaggacgcgagcgaguccaagcugcucaccgugagcaucauggaccugucccagauguacagcccggucuucgaguaccugagcggcgaccgccagguggaggaguggcccaaggccacgugcaccggcgacugccccgagcggugcgggugcaccuccagcacgugccuccacaaggaguggccccacuccaggaacuggcggugcaacccgaccuggugcuggggcguggggaccggcugcacguguugcggggucgacgugaaggaccuguucaccgaccacauguucgugaaguggaagguagaguacaucaagaccgaggccaucgugugcguggagcugacgagccaggagcgccagugcucccucaucgaggccggcacccgguucaaccugggccccgucaccaucacccugagcgagccccgcaacauccagcagaagcugccgcccgagaucaucacgcugcaccccaagguggaggagggguucuucgaccugaugcacgugcagaagguccuuuccgcgagcaccgugugcaagcugcaguccugcacccacgguaucccaggggaccuccagguguaccacaucggcaaccuccuuaagggcgaccggguuaacgggcaccugauacacaagaucgagccccacuucaacacaagcuggauguccugggacggcugcgaucucgacuacuacugcaauaugggggacuggcccaguugcacguacaccggcgugacccagcacaaccacgccgccuucgucaaucugcugaacaucgagaccgacuacacgaagaccuuccacuuccacuccaagcgcgugaccgcccacggggacacgccccagcucgaccugaaggcccggcccacguacggcgcaggcgagaucaccgugcuggucgagguggccgacauggagcuccacaccaagaagguggaaaucagcgggcugaaguucgccucccuggccugcacgggcugcuacgccugcagcucggggaucagcugcaagguccgcauccacguggacgagcccgacgagcucacggugcacgucaaguccagcgacccggacgugguggcggccagcaccucccugauggcccggaagcuggaguucggcaccgacagcaccuucaaggccuucuccgccaugcccaagacgucucucugcuucuacaucgucgagcgcgaguacugcaaguccugcagcgaggaggacacccagaagugcguggacaccaaguuagagcagccccaguccauccugaucgagcauaaggggaccaucaucggcaagcagaacgacacgugcaccgcgaaggccagcugcuggcucgaguccguaaaguccuucuucuacggccugaagaacaugcuggggagcgucuucggcaacuucuuuaucgggauccuccuguuucuggcccccuucgugcugcucgugcuguucuucauguucggcuggaagauccuguucugcuucaagugcugcaggcgcacccggggccuccugaaguaucgccuguugaaggacgacgaggagaccggcuaccgccggaucaucgagcgccugaacaacaagaagggcaagaaccggcugcucgacggggagcgccuggccgaccggaagaucgcggagcuguucagcacgaagacccacaucggguga

SEQ ID NO: 15357 - RNA, 5052 nt, Artificial Sequence
  derived and/or modified CDS sequence (opt11) from CCHFV(Saf)__KX013487.1__GP
augcacacccugcuggugugcuucauucuguaccugcagcugcugggccucggcggggcccacgggcagagcaacgccacggagcacaacgggaccaacacgaccaccgcccccuccaccagccaguccccuaagcccuuagucagcaccgcuccgccccacgcccuggaguccagcaccaucaaacccaccacccccgccuccgagaccgaggggaguggcgagaccacgcccccgcccaacaccacccaaggccccagcccgcccgagaccacccccgagcgccccgccaccaccgcgaccagcacccccuccaccgacaauaccaacagcaccacccacgugacggacaacaacccuaccuccaccauuagcaccuccccuagcuccagccccuccacgcccucaacaccgcaagggauccaucacccggcccggaaccugcucucaguuuccagccccaagacugccaccacgcccacccccaccuccccgggcgagaucagcuccgagaccagcucccuucacucugcaaugucccgcacgagcacccuguacaccgccacccaggucuccacggaaaaugccaaccacagcgcgccgagacagucggaaagcuccgcccagcccacgaccaccagccccaugaccuccccggcccagaguauucucgugauguccgcggcccccacggccauccagaacauccacccuagcccgaccaaccgcucgaagcggaacuuagagauggagaucauccugacccucucccagggguuaaagaaguacuacggcaagaucuuaaagcuccugcaucugacccucgaggaggacacggaggggcugcuggaguggugcaagcgcaaccucggcagcaacugcgacgacgacuucuuucagaagagaaucgaagaguucuucaugaccggcgaagguuacuucaacgaggugcugcaguucaagacccugucgacccugagcccaacggagcccucccacgcccgcccgcccaccguugagcccuucaagagcuacuuugccaagggcuuccuauccauagauagcggguauuuuucagcgaagugcuauccccguagcuccaccagcggccugcagcucaucaacgugacccagcaccccgcccgcauugccgagacgccgggccccaagaccaccucccugaagaccaucaacugcaucaaccuacgggccagcguguucaaggagcaccgcgagaucgagaucaacguccuccugccccagaucgccgugaaucuguccaacugccacguggucaucaacagccacgugugcgacuacucccucgacacagacgggcccgugagacugccgcacauccaccacgagggcaccuucauccccgggacauauaaaaucgucaucgacaaggagaacaaguuaaacgaccgcugcacccucgugacgaacugcgugaucaagggccgggagguccgcaaggggcagagcgugcugcggcaguacaagaccgagaucaagaucggcaaggcgagcaccggcuccagaaaacugcucagcgaggagcccggggacgauugcaucucccggacacagcugcugcgcacggagacggccgagauccacgaugacaacuacggcgggccuggcgacaagaucaccaucugcaacgggagcaccaucguggaccagcggcucggcuccgagcugggcugcuacacgaucaaccgggucaagagcuucaagcugugcgagaacuccgccacugguaagaccugcgaaaucgacagcaccccggugaagugccgccagggcuucugccucaagaucacgcaggaagggaggggccacgugaagcugucccgcgggagcgaggucgugcuagacgccugcgauuccagcugcgaggucaugaucccuaaggggaccggcgacauccugguggauugcuccggaggccagcagcacuaccucaaggacaaccugaucgaccuggggugcccccacaucccccuccugggcaagauggccaucuacaucugucggaugagcaaucacccgcguaccaccauggcguuccucuucugguucuccuucggcuacgugaucacguguaucuucugcaaggcccucuucuauagccugauaaucaucgggacgcuggggaagaagaucaagcaguaccgggagcuaaagccccagaccugcaccaucugcgagaccgcccccgucaacgccaucgacgcugagaugcacgaccugaacugcuccuacaauaucugccccuacugcgccagccgccugacguccgacgggcuggcccggcacguaccgcagugccccaagcgcaaggagaagguggaagagaccgagcuguaccugaaccuagaacggauccccuggaucguacgcaagcuacuucaggugagcgagagcaccggcguggcccuuaagcgcuccagcuggcugaucguccugcucgugcugcugaccgugucccucagcccgguccaguccgcccccguggggcacggcaaaacgaucgagaccuaccagacccgagagggcuucaccagcaucugccuuuucaugcugggguccauccucuuccuggugagcugccuggucaagggccuaguggacuccgugagcgacuccuucuuccccgggcugagcgucugcaagaccuguuccaucggcagcaucaacggguucgagaucgagucccacaagugcuacugcagccuguucuguugccccuacugccggcacugcuccgcggaccgcgagauccaccagcuccaccugagcaucugcaaaaagcggaagaccggcuccaacgugauguuagccgugugcaagcgcauguguuuccgggccaccauugaggccagccgccgggccuuacugauccgcagcauaaucaacacaacguucgucaucuguauccugacccucaccaucugcgugguauccaccagcgcggucgaaauggagaaccugccguccggcacgugggagcgcgaggaggaccugaccaacuucugccaucaggaaugccaggugaccgagaccgagugccucugucccuacgaggcccuggugcugcggaagccccucuucagcgacuccaucgucaaggguaugaagaaucugcugaacagcacgucccucgagaccagccuuuccaucgaggcccccuggggcgccaucaacguccaaucgacuuucaagccgaccguguccacggccaauaucgcguuaagcugguccucggucgagcaccgcgggaauaagauccucgugaccggcagguccgagagcaucaugaagcuggaggagcgcaccgggguguccugggaccugggagucgaggacgccagcgaguccaagcuauuaaccgugagcaucauggaucugagccagauguacucccccguguucgaguaccucagcggcgaccggcaggucgaggaguggcccaaggccacgugcaccggggacugcccggagcgcugcggcugcaccucgagcacgugccugcacaaggaguggccgcacucccggaacuggcgcugcaacccuaccuggugcuggggcgugggcaccggguguaccugcugcggcguggacgucaaggaccuguucaccgaccacauguucguuaaguggaagguggaguacaucaaaaccgaggccaucguuugcguggagcucacgagccaggaacggcagugcucccugaucgaggcgggcacccgcuucaaccuggggcccgugaccaucacccucagcgaaccccgaaacauccagcagaagcugccgcccgagaucaucacgcugcacccuaagguugaggaaggcuucuucgaccucaugcauguacagaagguacuguccgccagcaccgucugcaagcugcaguccugcacccacgggauccccggcgaccuccagguguaccacaucggcaaccugcugaagggggaccgcgugaacgggcaccucauccacaagaucgagccgcacuucaacacaagcuggauguccugggacgggugcgaccuugacuacuacugcaacaugggcgacuggcccagcugcacguacaccggggucacccagcacaaccaugccgcuuucgugaaccugcuaaacaucgagaccgacuacaugaagacguuucacuuccacuccaagcgggucaccgcccacggcgacacgccccagcuggacuugaaggcacgccccaccuacggcgcaggggagaucaccgugcugguggaagucgccgauauggagcugcacaccaagaagguggagaucagcggcuuaaaguucgugucccuggcuugcaccgggugcuacgccugcagcuccggaauuagcuguaaaguccggauccacguggacgagccggacgagcugaccgugcacgucaagucauccgaccccgaugugguggcggccagcacgucccugauggcccgcaagcucgaguucgggaccgacagcaccuucaaggcuuucucggccaugcccaagaccagcuugugcuucuacaucgucgagcgggaguacuguaagucaugcagugaagaggauacgcagaagugcguggacaccaaacuggagcagccccaauccauccucaucgagcacaagggaaccaucauaggcaagcagaacgacacgugcacggcgaaggccagcugcuggcuggaguccgugaaguccuucuucuacgggcugaaaaacaugcucggcuccgucuucgggaauuucuucaucggaauccuacuguuccucgccccuuucguccugcuggugcuuuucuucauguucggguggaagauccucuucugcuucaagugcugccgccggacccgcggccugcugaaguaccgccaccucaaggacgacgaagagaccggcuaccgccgcaucaucgagcggcugaacaacaagaaggggaagaaccgccugcucgacggcgagcggcuggccgaccgcaagaucgcggagcuguucagcaccaagacgcacaucggguga

SEQ ID NO: 15358 - RNA, 5052 nt, Artificial Sequence
  derived and/or modified CDS sequence (opt11) from CCHFV(52-R-2014)__KR814862.1__GP
augcacacccugcucgugugcuucauucuguaccuccagcuccugggccucgggggcgcacaccgccagagcaacgccaccgagcacaacgggacgaacaccaccacugcgcccucaacgagccaguccccgaagccgccagucagcaccgcgccaccccacgcccccgaguccagcaccaucaagcccaccacacccgccuccgagacugagggcagcggggagaccacucccccgcccaacacuacccagggcccuucgccgcccgaggccacccccgaacgccccgccaccacagccacuagcacccccucgaccgacaacacgaacucgaccacccacgccaccgacaauaaccccacguccaccauauccaccucacccagcuccucgcccuccaccccgagcacuccccagggcauucaccaccccgcccgcaaccuccugagcguguccagccccaagaccgcgaccaccccgacgcccaccucccccggcgacaucucguccgagaccagcucccugcacagcgccauguccagaacccccacguugcacaccgccacccaggccagcaccgagaacgccaaccauuccgcgccgcggcaaagcgaguccagcgcacagcagaccacgaccuccccuaugaccucgcccgcccagccgauccuggugauguccgccgccccuacagcgauccagaacauccacccaagccccacgaaccgguccaagcgcaaccuggaaauggagaucauccucacacugagccagggccugaagaaguacuacgggaagauccucaagcugcugcaccucacccuggaggaggacaccgaaggccugcucgagugguguaagcggaaccuggggagcaauugcgacgacgacuuuuuccagaaacguaucgaggaguucuucaugacgggcgagggcuacuucaaugagguccugcaguucaagacccucaguacccugagcccgacugagccuucccacgcacggccacccacuguggagccauuuaaaagcuacuucgcgaagggguuccucaguauagacagcgguuacuucuccgccaagugcuacccccgccucagcaccuccgggcugcagcugaucaaugugacccagcaccccgcccggaucgcggagaccccuggcccgaagacgaccagccucaagaccaucaacugcaucaaccugcgcgccuccgucuucaaggaacaccgggagauagagaucaacgugcugcucccccagaucgcagugaaccugagcaacugccacgucgugauuaacucucacgugugugacuacagccuggacaccgacggccccguccgccugccccacauuuaccacgaggggacguucaucccuggcaccuacaagaucguaaucgauaagaagaacaagcugaacgaccgguguacccuggugaccaacugcguuaucaaggggcgcgaagugaggaagggccaguccguccucaggcaguacaagacggagaucaagauugggaaggccagcaccggcucccggaagcugcugucggaagaacccggcgaugacugcaucucucgcacccaacuccugcggacagagacagccgagauccacgacgauaacuacgguggccccggggacaagaucaccaucugcaacggcuccaccaucgucgaucagcgccuggggagcgagcucggcugcuacaccaucaaccgcguuaaaucuuucaagcugugcgagaacagcgcuacggguaagacuugcgagaucgacuccacccccgugaagugccggcagggauucugccuaaagaucacccaagagggccgcgggcacgucaagcucagccguggcuccgagguggugcuggacgccugcgacacaagcugcgaaguaaugaucccgaaggggaccggcgacauccugguugacugcuccgggggccagcagcacuuccugaaggacaaccucaucgaccugggcugcccccacgugccccuguuggggaagauggccaucuauaucugucgcaugagcaaccacccacggaccacaauggccuuccuguucugguucuccuucggcuacgugaucacgugcaucuucugcaaggcgcuguucuauagccucaucaucaucggcacucuggggaaaaagaucaagcaguaccgcgagcugaagccgcagacgugcaccaucugcgaaaccgcccccgugaacgccaucgacgccgagaugcacgaccucaacugcuccuacaacaucugccccuacugcgccagccgccugaccagugacggccuggcgcgccacgucccucagugccccaagcggaaggagaagguggaggagaccgagcucuaccuuaaccuggagcgcauccccuggaucgugcggaagcuccugcaggucagcgaauccaccgggguggcccugaagcgcagcuccugguugauagugcugcugguccuccugaccgugagccugagccccgugcaguccgccccugucggccacggcaagacgaucgagacauaccagacccgugaaggcuucaccagcgugugccucuucauguugggcuccauccuguuccucgugagcugcuuagucaaaggacugguggacuccgugucugauuccuucuucccgggccucagcgucuguaagacguguuccaucgggagcaucaacgguuucgagaucgagucccacaaaugcuacugcagccuguucugcugccccuacugucgccacugcuccgcagaccgggaaauacaccagcuacaccucagcaucugcaaaaagcgcaaaaugggguccaacgugaugcuggcggugugcaagagaaugugcuuccgcgcgaccaucgaggccagccggagggcccugcucauccgcucgaucaucaacaccaccuuugucaucugcauccugacgcuuaccaucugcguggugagcaccuccgccgucgagauggagaacuuacccagcggcaccugggagcgggaggaagaccuaacaaauuucugccaccaggaaugccaggugaccgagacggaaugccugugcccguacgaggcccuggugcugcgcaagccgcuguucuuagacagcauagucaagggcaugaagaaccugcugaacuccaccagccucgagacgucccugagcaucgaggcuccguggggagccaucaacguccaauccaccuucaagcccaccgucagcaccgcaaacaucgcccugaguuggagcuccgucgagcaccgggggaacaagauccucgugacgggucgcucugaguccaucaugaagcuggaggagcggacaggcgugagcugggaccugggggucgacgacgcguccgaguccaagcucuugaccguguccaucauggaccugucccagauguauuccccgguguucgaguaccucagcggcgacaggcaggucgaggaguggcccaaggcuaccugcacgggcgacugcccggagcgaugcggcugcacguccuccacgugcuugcacaaagaauggccccacagccgcaacuggcggugcaacccgaccuggugcuggggcguagggaccggcugcacaugcugugggguggacgucaaggaccuguucaccgaccacauguucgugaaguggaagguggaguacauuaagacggaggccaucgucugcguggagcucaccagccaggagcgccagugcagccugaucgaagccggcacccgguuuaaccugggucccgugaccauaacccucucggagccccgcaacauucagcaaaaguuaccaccugagaucaucacccugcacccaaaggucgaggaaggguucuuugaccugaugcacgugcagaaggugcugagcgccuccacggucugcaagcugcagagcugcacucacggaauccccggggaccuucagguguaccacaucggcaaccugcugaaaggcgaccgggucaacggccaccucauccacaaaaucgagccucacuuuaacacauccuggaugagcugggacggcugcgaccuggacuacuacugcaacaugggggacuggccguccugcaccuacacgggcgucacccagcacaaccacgccgccuucgugaaccuccucaacaucgagaccgacuacaccaagacguuccacuuccauagcaagcgcgucaccgcccauggugacacgccgcagcuggaccugaaggcccggcccaccuacggcgccggcgagaucaccgugcucguggaggucgcagacauggagcugcacaccaagaagguggaaaucagugggcugaaguucgccucccucgccugcaccgggugcuacgccugcucgucagguaucucuugcaaggugaggauacaugucgacgagcccgacgagcugaccgugcacgucaagagcaacgacccggaugucguggccgcguccacgagccugauggccagaaagcuggaguucggcaccgacuccaccuucaaagccuuuagcgccaugcccaagaccucgcuaugcuucuauauaguggagcgcgaguacugcaagagcugcagcgaggaggacacgcagaagugcgucgacaccaagcuggagcagccccaguccauucucaucgagcacaaggggacgaucaucggaaagcagaacgacacgugcaccgcgaaggccggcugcuggcuggaaagcgugaaauccuucuucuacggucugaagaacaugcucggcucgguguucgggaacuucuucaucggcaucuuauuauuccucgccccguucguccuucugguucuguucuucauguucggguggaagauccucuucugcuucaagugcugccggcgcacccggggccugcugaaguaccgccuccugaaggacgacgaggagaccggcuaucgccggaucaucgagcgccugaacaacaagaaggggaagaaccggcuccuggacggcgagcgccuggcagaccggaagaucgccgagcuguucuccacgaagacccacaucggguga

SEQ ID NO: 15359 - RNA, 5052 nt, Artificial Sequence
  derived and/or modified CDS sequence (opt11) from CCHFV(Turkey-Kelkit06)__GQ337054.1__GP
augcacacgccccuggugugcuuuauccucuaccuucagcugcucugccuuggcggggcccacggccaacugaacgccaccgaacacaacgguaccaacaacaccaccgccccgggggccagccagucccccaaaccgcccaugagcaccacgccuccccacgccccugaguccagcaccaucaaaccuaccacacccauauccgaggccgaggggagcggcgagacaaccagcccgcccaacaccacucaaggccucagcucccccgagacgaccagcgagcgccccgccacaaccucuauaucaacguccagcaccgacucaaccaaccccaccacgcagaugacugacaacacgcccaccccuacggucaguacuuccccgagcucuagccccagcacccccuccacgccgcagggcauucaccacccggcgcggucacuccuuuccgugucuucacccaagacugugaccacccccacucccacaagcccgggcgagauguccagcgaaacguccucucagcacuccgcuaugucacgcauccccacgccccauaccgccacccgggucuccacagagaucaccaaccaccgcacgccccggcagagcgagaguagcgcccagcaaaccaccccgucccccaugaccagccccgcgcaguccauacuuuuaaugagcgcggccccgacugccguacaagacauccacccuagccccaccaaccgcuccaagcgcaaccuggagaccgagaucauccuaaccuugucacaggggcugaagaaguacuacggaaaaauccugaagcugcugcaccucacccuggagcaggacaccgagggccugcuugagugguguaaaggcaaccugggcuccaacugcgaugacgacuucuuccaaaagcgcaucgaagaguucuucaugacgggggaaugcuacuuuaacgaggugcuucaauucaagacccucaguacgcugucccccaccgaacccagccacgcgcggcugcccacggccgaacccuucaaguccuacuuugccaagggcuucuuaagcaucgauuccggguacuucagcgccaagugcuacccccgcucaucagcauccggccugcaacugaucaacgucacgcagcacccagcgcgcaucgcggagacccccggcccaaagaccacgagccucaagaccaucaacugcaucaaccuacgcgcaucugucuucaaggagcauagggagguggagauaaacgugcuacucccccagaucgcaguuaaccuuagcaauugccacguggucaucaacucccacgugugcgacuacagccuggacaccgacggcccgguccgccucccccgaaucuaccacgagggcaccuucauccccgggaccuacaagaucguuaucgacaaaaagaauaagcugaacgaccggugcacccuggugaccaacugcgugaucaagggacgggagguccgcaagggucagaguguguuacggcaauacaagaccgaaaucaagaucggcaaggccucaacgggcuuccgcaaacugcugagugaggagcccggggacgauugcaucucccggacccagcugcugcgcaccgagaccgcugagauucacgaugacaacuacggcgggccgggcgauaagauaacgaucugcaacgggagcaccaucguggaccagcgccugggcuccgagcucggcugcuacaccaucaaucggguuaagucauucaagcugugcaaaaacuccgcuaccgggaagacgugcgagguugacuccacgcccgugaagugcagacagggcuuuugucugaagaucacccaagagggccggggccacgucaagcucucccgcgggagcgaggugguccuggacgcaugcgauuccucaugcgaggugaugauacccaagggaaccggcgacauccugguggacugcucuggcgggcaacaacacuuccugaaggauaaccucaucgaccugggcugcccacacaucccgcugcucgggcggauggccaucuacauuugccgcaugagcaaccacccgcggacgacgauggccuuccuguuuugguucuccuucggcuacgucauuacgugcaucuucugcaaagcccuguucuacagccucaucaucaucgggacccugggcaagaagaucaaacaguaccgcgagcugaagccccagacuugcacuaucugcgagaccgcgcccgugaaugccaucgacgcugagaugcacgaccucaacugcaguuacaacaucugcccguacugcgccagccgucucaccuccgacgggcuggcgcgccacgugacccagugcccuaagagaaaggaaaagguagaggagacggagcucuaccugaaccuggagcgcauccccuggaucguacggaagcuccuccaggugagcgaguccaccggcguagcccugaagcgcaguagcuggcugaucgugcuccuggugcuccugaccgucucccugagcccggugcagucagcccccguggggcacggcaagacgaucgagaucuaccagacccgggagggauucgccagcaucugccucuucaugcugggguccauccuguucaucgucucgugccucgugaagggccucguggauucagucagcgaguccuucuuccccgggcugagcgugugcaagacaugcagcaucggcagcgucaacggguucgaaaucgagucccacaagugcuacugcagccucuucugcugcccuuacugccgucacugcuccgcagaucgggaaauccaccagcugcaccugagcaucugcaagaagcguaagaccggauccaacgucaugcucgcgguuugcaagcggaugugcuuccgcgcgacuaucgaggccagccgacgggcccugcugauacguagcaucaucaauacgaccuucgugauuugcauccucacccuaaccaucugcgucguauccacgagcgcgguggagauggagaaccuaccagcuggcaccugggagagagaggaagaccucaccaacuucugccaccaggagugucaggucaccgagacggaaugccugugccccuacgaggcccuggugcuucgcaagccccuguuccuggacuccaucgugaaggggaugaagaaccuccugaacucuaccucccuggagaccucuuuauccauagaggccccuuggggcgccaucaacguccagucaaccuucaagccgacgguuuccaccgcgaacaucgcgcugagcugguccucggugguccaccgggggaacaagauccuggugaccggccgcucagagagcauuaugaagcucgaggagagaacagggguguccugggaccugggcguggaagacgcgagcgagucaaagcuguugacugugagcaucauggacuuaucccagauguacagcccaguguucgaguaccugagcggggaccgccaagucgaggaguggcccaaagcuacuugcaccggagauugccccgagcggugcggcugcaccuccucaacgugucuccacaaggaguggagccacagccgcaacuggcggugcaacccgaccuggugcuggggcguggggaccgggugcacauguugcgguguggacguuaaggaccuguucaccgaccacauguuugugaaguggaagguagaguacaucaagaccgaggccaucgucugcguggcgcugacgucccaggagagacagugcagccucaucgaggccggcaccagguucaaccucgggccggugaccauaacgcucuccgagccacgcaacauucaacagaagcugcccccggagaucaucacccuccaccccaagaucgaggagggcuucuucgaccugaugcacguacagaaggugcucagcgccuccaccgugugcaaguuacagagcuguacccacggcauccccggcgaccugcaggucuaccacaucggcaaccuccugaagggagaccggguuaacggccaccuaauacacaagaucgagucccacuuuaacacuagcuggaugucuugggaugggugcgaccucgacuacuacugcaauaugggcgacuggcccagcugcacuuacacgggggucacccaacauaaucaugccgccuucgugaaccugcugaacaucgagacagacuacaccaagaccuuccacuuccacagcaagcgagugaccgcgcacggcgacaccccgcagcucgaccugaaggcccggcccaccuacggugccgggggcaucacaguccugguggagguggcggacauggagcuccacacgaagaaggucgaaaucagcgggcugaaguucgccagccuggccugcacgggcugcuacgccuguagcucugggaucucguguaaggugcgcauucacguggacgaacccgacgaacucaccguucacgucaagucuucugaccccgacgucguggccgccagcaccucccugauggcgcggaaacuugaguuugguaccgacaguacauucaaggcauucuccgcuaugccgaagaccagccucuguuucuacaucguugagcgugaguauugcaaauccuguucagaggacgacacccagaaaugcguggacacacggcuggagcagccucaguccauucugaucgagcacaagggaacgaucaucgggaagcagaaugacacgugcaccgccaaggcgagcugcugguuagaguccgugaagucuuucuucuaugggcuuaagaacauguugggguccgucuucggcaaccucuucaucgggauccuguuguuccucgcgcccuuugugcugcugguacuguucuucauguucgguuggaagaucuuguucugcuucaagugcugccgccgcacccggggccuuuucaaguaucgccaccugaaggacgaugaggagaccggguaccggcggauuaucgagcggcucaacagcaagaagggcaagaaccgccuguuagacggagaucgacucgccgaucgcaaaauugccgagcuguucuccaccaagacccauauuggcuga

SEQ ID NO: 15360 - RNA, 5052 nt, Artificial Sequence
  derived and/or modified CDS sequence (opt11) from CCHFV(V42/81)__GU477490.1__GP
augcauacccugcucguaugcuucauccuguaccugcagcuccugggccucggcggggcucacguccagccgaacgccaccgagcacaaccgcacgaacaccaccacggcgccggggacgagccacucacucaagccgcuggugagcacuaccccgccgcaggcccccgagagcucaaccaucaagcccacgacccccaccuccgagaccgaggggagcggggaggccacgccccugucaaacacaauccaggcaccgucgucccccgagacgaccagcgaacgacccgccacagcggugaucuccacuagcggcaccgacuccaccaacaguacgacccagacgacggacaacaaucccacgacgaccgucggcaccuccccgagcuccagccccuccacgcccagcacaccucaggggauccaccaccacgcgcgcagccuccuguccguaacgagcccggagaccguaaccacccccaagccgaccagcccgcgggaaaugagcuccgagaccucgaaccagcacuccgccaugagccgaaccccgacccaccacaccgucacccagguguccaccgagaacacaagccauuccacgcccagacagcccgagaguuccgcccaaccaacuagcuccaguccgaugacgucccccgcgcagucuacccugcuaauguccgccgcgcccaccgccgugcaaagcauacaccccagcccgaccaaccgcuccaagcggaaccuagagaccgagaucauccucacgcucagccagggccugaaaaaguacuacgggaagauccugaagcuccugcacuugacccucgaggaagacaccgagggccugcuggaguggugcaagcgcaaccucggguccaacugcgacgaugacuucuuccagaagcggaucgaggaguucuucaugaccggcgagggcuacuucaacgagguccugcaguucaaaacgcccucgaccguaucgcccaccgagccgucccacgcacgccugcccaccgcggagcccuucaaauccuacuucgccaaggguuuccuaagcaucgauuccggcuacuucagcgccaagugcuacagucggagcuccacgucugggcugcagcugaucaauguaacucagcacccugcccgcaucgccgagaccccgggccccaagaccacgagccucaagaccaucaacugcauaaaccugcgggcgagcgucuucaaggagaacagggagaucgagaucuccguucugcucccccagauagccgugaaccugagcaacugccacgucgugaucaacagccacgugugcgacuacucccuugauacagauggcccuguccggcuaccacgcaucaaccacgaggggaccuucaucccaggcacguacaagaucguuaucgacaaaaagaauaagcugaaugaccggugcacccuagugacuaacugcgucaucaaggggcgcgagguacggaagggccagagcguccucagacaguacaagaccgagaucaagaucggcaaggccuccacgggcucacgcaagcugcugaguaaggagcccggcgacgauugcaucagccgcacccagcucaugcgcaccgagaccgcagagauccacgacgacaacuacgggggccccggagacaagauaacgaucugcaacggauccaccaucgucgaccaacgacugggaagcgagcugggcugcuacaccaucaaccgcgugaaguccuucaagcucugcgagaauagugccacuggcaaggcgugcgaggucgacuccacgccggugaagugccgucagggguucugcuugaagaucacccaggagggccgcgggcacgugaagcugagccgggguuccgagguagugcucgacgcaugugacagcuccugcgaggugaugauccccaagggcaccggcgauauccugguugauugcucaggcgggcagcagcacuuucugaaggacaaccugauagaccucgagugcccccauaucccccugcugggaaagcucgccaucuacaucugccgcauguccaaccacccgcggaccaccauggccuuccuguuuugguucggcuucggcuaugugauuacgugcauccugugcaaggcccucuucuauagccugauaauuaucggcacccugggcaagaaaaucaagcaguaucgcgaguugaagccccagacaugcaccaucugcgagacggcccccgugaacgccaucgacgcggaaaugcacgaccugaacugcuccuacaacauaugccccuacugcgccagccggcugaccagcgacggccucgcgcgccacgucacacagugcccgaagcggaaagagaaggucgaggagaccgagcuguaccugaaccucgaacgcauccccuggaucgugagaaagcugcugcaggucucggagagcacgggaguggugcucaagcgcuccaguuggcugaucguccugcucgugcuacugaccgugucccucagccccguccaguccgcucccgugggccacgggaagaccaucgagacauaccagacgcgggaaggguucaccagcaucugccuauucaugcuagguuccauacucuucaucgugagcugcaucgucaaggggcugguggacuccgugagcgauagcuucuucccgggucugagcgucugcaagaccugcuccaucagcuccaucaacggguucgagaucgagagccacaaaugcuacugcucccucuucugcugccccuauugccgccacugcagcgccgaucgggagauacaccagcugcaccuguccaucugccgcaaacggagaaccggcuccaacgugaugcucgccguuuguaagcgcaugugcuuccgggccacgaucgagguuucgcgccgugcgcugcugauccguuccaucauaaacaccaccuucgugaucugcauacuaacccugacgauuugcguugucagcaccuccgccguggagauggagaaccugccugccgggaccugggagcgggaggaagacuugaccaacuucugucaccaggagugccagguaaccgagaccgagugccugugcccguaugaggcccugguucucagaaagccccuguuccuggacagcaucgugaagggcaagaaaaaccucuugaacuccaccagccuugagacaucccucucgauagaggccccauggggcgccaucaacauccaauccacguuuaagcccacaguaagcgccgcuaacaucgcgcugagcuggagcucagucgagcaccgggggaacaagauccuggugaguggccgcagcgagagcaucaugaagcucgaggaacggaccggcguguccuggaaccuuggcguggaggacgccagcgagagcaagcugcucaccguguccaucauggaccugagccagauguauucccccguguuugaguaccugagcggggacagacaggucgaggaguggcccaaggcuacuuguaccggugacugccccgagcggugcgggugcaccuccucgacgugcuuacacaaggaguggccccacagccgcaacuggcggugcaacccgacguggugcuggggcguggggaccgggugcacguguuguggcguggacgucaaggaucuguucaucgaccacauguuugugaaguggaagguugaguacaucaagaccgaagcuaucgucugcguagagcugaccagccaggagcgacaguguagccucauugaggccgggaccagauucaaccugggacccgucaccaucacccugagugagccccgcaauauccagcagaaacugcccccugagaucaucacccugcaucccaagaucgaggagggcuucuucgaccuaaugcacguccagaaggugcucucagccucgacugucugcaagcugcaguccugcacccacggcauccccggugaccuccagguguaucauaucgggaaccuccugaagggugaccgggugaacggccaucucauccauaagaucgagccccacuucaacaccagcuggaugucuugggacgggugcgaccucgacuacuacugcaacaugggcgacuggccgagcuguaccuacacgggggugacccaacacaaccacgcggccuucgugaaccugcugaacauagagaccgacuacaccaagacguuucauuuccacuccaagcgcgugaccgcccacggcgagacgccccagcucgaccugaaggcucgucccgccuacggggcaggcgagaucacaguccugguggagguggccgacauggagcuccacaccaagaaggucgagaucagcggccugaaguuugccucccucgccugcaccgggugcuacgccugcagcagcggcauuuccugcaaggugcgcauccacguggacgagcccgacgagcucaccguccaugucaaaagcaacgacccggacgugguggcagccucgacaagccugauggcccggaaguuagaguccgggacggacagcaccuucaaggccuucuccgccaugcccaaaaccucacucugcuucuacaucguggaacgcgaguacugcaaguccugcagcgaggacgacacccagaagugcguggagacgaagcuggagcagccccaauccauccugaucgagcacaagggcaccaucaucgggaagcagaacgacacgugcaccgcgaaggccagcugcuggcucgaguccgucaagagcuucuucuacggccugaagaacaugcugggcuccguguucggcaacuucuucaucggcauucuccuguuccuggcccccuucguguuacugguacuguucuucauguuuggguggaagauccuguucugcuucaagugcugccgccggacccgcggccucuucaaguaccggcaccugaaggaagacgaggagaccggauaccgccggaucaucgagagacugaacagcaagaaggggaaaaaccggcuccuggacggcgagcgucuggccgacagaaagaucgccgagcuguucucgaccaagacccacauaggguga

SEQ ID NO: 15361 - RNA, 5052 nt, Artificial Sequence
  derived and/or modified CDS sequence (opt11) from CCHFV(75-R-2012)__KR814863.1__GP
augcacacccugcugguguguuucauccuguaccugcagcuccuaggccucggcggcgcccaucgccagagcaacgccaccgggcacaacgggaccaacaccaccaccgcccccucgaccucgcaauccccgaagccccucguuagcaccgccccgccgcacgcgcuggagaguucaaucauuaagcacaccacccccguguccgagaccgagggcagcggcgaaaccacgccaccgcccaacaccacccagggcccgucgccccuugagaccacacccgagcggcccgcgaccaccgcgaccagcacgccauccaccgacaauacaaacagcaccacccacgugaccgacaauaauccgacgucgaccaucagcaccucccccagcuccagcccaagcaccccgagcacaccccaggggauccaccaccccgcgcgcaaccuccuguccgucucuagccugaagacggccaccacccccaccccgaccucucccggcgagaucagcucugagaccagcucccuccacagcgcgaugucccggaccagcacacuguacaccgccacacagguaucuaccgagaacgccaaucauagugccccacgccaguccgagucuuccgcccagcaaaccacgaccagccccaugacauccccggcccaaucgauccuggugauguccgcugcgcccaccgccauucagaacacucaccccucacccacgaaccgaagcaagagaaaccucgagauggagaucaucuugacccuaucucaggggcucaagaaguacuacggcaagauacugaagcuguugcaccugacccuggaggaagacaccgaggguuuacuggaguggugcaagcggaaucuaggcagcaacugugacgacgauuucuuccaaaagcgcaucgaggaguucuucaugaccggcgaggguuacuucaaugaggugcuccaguucaagacgcuguccacccaaagcccgacggagcccagucacgcccggcccccgacgguggagccuuucaaaucauacuucgcgaagggcuuccugaguauugacagcggguacuucuccgccaagugcuauccccgccucucaaccuccggccugcaguugaucaacguuacccaacaucccgcgcggaucgccgagacaccgggccccaaaacgacaagccugaagaccaucaacugcaucaaccugcgcgccucggucuuuaaggagcaccgggagaucgagaucaacgugcugcucccccagaucgccguaaaccuuuccaacugccacgucgugauuaacagucacgucugcgacuauagccuggauacggacgggcccguccgucucccucauaucuaccacgaaggcaccuucauccccgggaccuacaagaucgugaucgauaagaagaauaagcugaaugaccggugcacccugguaacgaacugcgucauaaagggccgcgaaguccggaagggucaauccgugcuccgccaguacaagaccgagaucaagauaggcaaggccagcacuggcagccggaagcugcuguccgaggagccaggggacgacugcaucagccgcacccaguugcugcggacggaaaccgccgagauccacgacgacaacuacggaggccccggcgauaaaaucacgaucuguaacgguuccaccauugucgaccaacgacugggcagcgagcucgguuguuacacgaucaaccgcguaaaguccuucaagcucugcgagaacagcgccaccgggaagaccugcgagaucgacuccgcgccggugaagugcagacagggcuucugccugaagauaacccaggaggggcgcggccacgucaagcugucucggggguccgaggugguccuagacgcgugcgacagcuccugcgaggugaugauccccaaaggcacgggcgauauuuuaguggauuguagcgggggccagcaacacuuccugaaggacaaucucaucgaccugggguguccacacauaccccuccucgggaagauggccaucuacaucugucgcauguccaaccacccccggaccacuauggcguucuuauucugguuuagcuucggauacgucauuaccugcaucuuuugcaaggcccuguucuacucccucaucauaaucgguacccuuggcaaaaagaucaagcaguaccgcgagcugaagccccaaacuugcaccaucugcgagaccgccccggugaacgccauagacgcggaaaugcacgacuugaacugcucauacaacaucugccccuacugcgccucccggcugacaucugacggacuggcccgccacgugccacagugccccaagcggaaagagaagguagaggagacggagcucuacuuaaaucuggagcggauccccuggaucgugcgcaagcuccuccagguguccgagagcaccggggucgcccugaagaggagcaguuggcucaucguguuacuggugcuccugaccgucucucugucccccgugcagucggccccgguggggcauggcaaaaccaucgaaacguaucagacacgggaaggcuucaccaguaucugccucuucaugcuggguagcaucuuguuccugguuuccugucuggugaaggggcuagugaacucggucuccgacaguuucuuccccggucucucagugugcaagaccugcagcaucggcuccaucaacggguucgagaucgaaagccacaaauguuacugcucccuguucugcugucccuauugccgccacugcagcgcggaucgggagauccaccaacugcaccucuccauuuguaagaagcgcaagacuggcagcaaugugauguuggccgucugcaagcggaugugcuuccgcgccaccaucgaggccucccggcgcgcccugcugauccggagcaucaucaacaccaccuucgugaucugcauccugacgcuaaccaucugcguugucagcaccuccgcgguggaaauggagaaccuaccgagcggcaccugggaacgagaggaggaccugacgaacuuuugccaccaggagugccaggugacugagaccgagugccugugccccuacgaggcccucguccugcgcaaaccccuguuccucgacuccaucgugaaagggaugaagaaccugcugaauagcaccucccucgagacgagccugucaaucgaggcacccuggggcgccaucaacgugcagagcacuuucaagccgaccgucaguaccgccaauaucgcgcugagcugguccucaguggagcaucgggggaacaagaucuuggugacgggccgcuccgaguccauaaugaaacuugaagaacggaccggggucuccugggaccugggcguggaggacgccagcgaguccaagcuccugaccgugucaaucauggaccucucccagauguacagcccgguguucgaauaccuaaguggcgacagacaaguggaagaguggcccaaggcgaccugcacgggggacugccccgaacggugcggcugcaccuccuccacgugccugcacaaggaauggccgcacucccgcaacuggcgguguaaccccaccuggugcuggggaguuggcaccgggugcacgugcugcggagucgacgucaaggaccuguucaccgaccacauguuugugaaauggaaggucgaguacauuaagaccgaggccaucgugugcgucgagcucacuagccaggagcgccaauguucccugaucgaggcgggcacgcgcuuuaaucugggacccgucaccaucacccuaagcgaaccgcgcaacauccagcagaagcugccucccgagaucaucacccugcaucccaagguggaggagggcuucuuugaccuuaugcacgugcagaagguccuguccgccagcaccgugugcaagcuacagucgugcacccacggaauccccggcgaccuccaaguuuaccacaucggaaaucugcugaagggggaccggguaaacggacaccucauccacaagauagagccgcacuucaacaccagcuggauguccugggacgggugcgaccuggacuacuacugcaacaugggcgacuggcccagcugcaccuacacgggagugacacagcacaaccacgccgccuucguuaaccugcucaacaucgagaccgacuacacuaagaccuuccacuuccacucaaagcgcgugacagcccacggcgacacgccacagcuugaccucaaggcgcggcccaccuacggcgccggggagaucacggugcuugucgagguggcggacauggaacugcauaccaagaagguggagaucagcggccugaaguucgccucccucgccugcacggggugcuacgccugcagcuccggcaucagcugcaaaguucgcauccacguggacgagcccgacgagcuaaccgugcacgucaaguccagcgacccggacgugguagccgccagcacgucccugauggccaggaagcucgaguucgggacagacagcaccuucaaggccuucuccgcaaugccaaaaaccagccuguguuucuauaucgucgaaagagaguacugcaaguccugcagcgaggaggacacacagaagugcguggauaccaagcuggagcagccgcagucgauccucaucgaacauaagggcacgaucaucgggaaacagaacgacacgugcacggccaaggccagcugcuggcuagaguccgucaagaguuuccuguacgggcucaagaacaugcugggauccgucuucgggaacuucuucauuggcauccuacuguuccucgccccuuuugugcugcuggucuuguucuuuauguucggauggaaaaucuuauucugcuucaagugcugccgacgcacccggggucugcugaaguacagauuacucaaggacgacgaagagaccggcuaucgccggaucaucgagcgccucaacaacaagaaggggaagaaccggcugcuggacggcgaaaggcucgcggauaggaagaucgccgaauuguucuccaccaaaacucacaucggguga

SEQ ID NO: 15362 - RNA, 5052 nt, Artificial Sequence
  derived and/or modified CDS sequence (opt11) from CCHFV(VLG/TI29414)__AY179961.1__GP
augcacacgcugcuggugugcuucauccuuuaccugcagcuccugggccucgggggcgcccacauccagagcaacgccaccgagcacaacgggaccaacacgaccaccgcccccuccaccagccaguccccgaagccccucgucagcaccgccccgccccacgcccuggaguccagcaccaucaagcccaccacccccguguccgagaccgagggcagcgggggcaccacgcccccacccaauaccacccagggccccagcccgcccgaggccacccccgagcgccccgccaccacggcgaccagcacacccuccaccgacaacacgaacagcaccacccacgugacggacaacaaccccacguccaccaucagcaccuccccgagcuccagccccuccacccccagcacgccccaggggauccaccacccggcccggaaccugcucagugucuccagccccaagaccgccaccacccccacacccacuuccccgggcgauaucagcagugaaaccucuucucugcacagcgccaugucccgcacaucaacgcuguacaccgcgacccaggugucaaccgagaacgccaaccacagcgcgccccggcaguccgagagcuccgcccagcagaccacgaccagccccaugaccuccccggcgcagccgauucucgugaugagcgcggcccccaccgccauccagaacauccaccccuccccgacgaaccgcagcaagcggaaccuggagauggagaucauccugacccucagccaggggcugaagaaguacuacggcaagauccugaagcuccugcaccugacccucgaggaggacaccgaggggcugcuggaguggugcaagcgcucccucggcagcaacugcgacgacgacuucuuucaaaaacggaucgaggaguucuucaugacgggcgagggguacuucaacgagguacugcaguucaagacccuguccacccucagccccaccgagcccucccacgcccggccgcccacgguggagcccuuuaagagcuacuucgccaagggcuuccuguccaucgacagcggguacuucuccgcgaaaugcuacccccggcugagcaccuccggccuccagcugaucaacgugacgcagcaccccgcccgcaucgcugagacccccggccccaagacgacaagccugaagaccaucaacugcaucaaccuccgggccuccgucuucaaggagcaccgcgagaucgagaucaacgugcugcugccccagaucgccgugaaccucagcaacugccacgucgugaucaacucccacgugugcgacuacagccuggacaccgacgggcccguccggcugccucacaucuaccacgagggcacguucauccccgggaccuauaagaucgugaucgacaagaagaacaagcucaacgaccgcugcacccuggugaccaacugcgucauuaagggacgggaggugcgcaaggggcaauccgugcugcggcaguacaagaccgagaucaagaucggcaaggcgagcaccggcagccgcaagcuccuguccgaggagcccggggacgacugcaucagucggacccagcugcuccgcgccgagcccgccgagauccacgacgacaacuacggcgggccgggcgacaagaucaccaucugcaacggguccacgaucgucgaccagcggcugggcuccgaacugggcugcuauacaaucaaccgcgugaaauccuucaagcucugcgagaacagcgcaaccgggaagaccugcgagaucgauuccacgcccgucaaaugccgccagggcuucugccugaagaucacccaggaggggcggggccacgucaaacuuagccgcggguccgaggugguccuggaugccugcgauagcuccugcgaggugaugauccccaagggcaccggcgacauccucguggacugcagcgggggccagcagcacuuccugaaggacaaucugauagaccucgggugcccccacaucccccuguugggcaagauggcgaucuacaucugccggauguccaaccacccccgcaccacgauggccuuccucuuuugguucagcuuuggcuacgucaucacgugcauuuucugcaaggcccuguucuacucccugaucauuaucgggacccucggcaagaagaucaagcaguaccgggagcuuaagccccagaccugcaccaucugcgagacggcccccgugaacgcgaucgacgccgagaugcacgaccugaacugcucauacaacaucugcccguacugcgccucccgccucaccagcgacgggcuggcccggcacgugccccagugccccaagcgcaaggagaaggucgaggagaccgagcuguaccucaaccuggagcggaucccguggaacgugcgcaagcugcuccagguguccgagagcaccggcgucgcccugaagcggaguuccuggcugaucgugcuccuggugcugcucacggucucauugucccccgugcagagcgcgcccguggggcacggcaagaccaucgagaccuaccagacccgcgagggcuucacguccaucugccuguucaugcucgggagcauccuguuccuggucuccugucucgucaagggccugguggacagcgucuccgacagcuucuuucccgggcuguccgugugcaagaccugcucgaucggcuccaucaacggguucgagauagagagucacaagugcuacugcucccucuucugcugcccguacugccggcacugcagcgccgaccgugagauccaccagcugcaccuguccaucugcaagaagcggaagaugggcagcaacgugaugcucgccgucuguaagcgcaugugcuuccgagccaccaucgaggccucccgccgggcgcugcugauccgcagcaucaucaacaccacguucgugaucugcauccucacccugaccaucugcguggucagcaccuccgccguagagauggagaaccugcccagcggcacgugggagcgcgaggaggaccucaccaacuucugucaccaggagugccaggugaccgagacugagugucugugccccuacgaggcccugguccuccggaaaccccuguuccuggacuccauagugaaggggaugaagaaccuccugaacagcacgaaccuggagaccucccucagcaucgaggccccguggggcgccaucaacgugcaguccaccuucaagcccaccgucagcacggcgaacaucgcccugucuuggagcuccgucgagcaucgcgggaacaagauccuggugaccggccggagcgaguccaucaugaagcucgaggagcgcaccggggucagcugggaccucggcguggaggacgccuccgagagcaagcugcucaccguguccaucauggaccugagccagauguacucccccgucuucgaguaucugagcggcgaccgccagguggaggaguggcccaaggccacgugcaccggggacugcccggagcgcugcggcugcaccagcagcacgugccuccacaaggaguggccccacagccggaacuggcgcugcaaccccaccuggugcugggagguggggaccgggugcacgugcugcggguggaacgucaaggaccuguucaccgaccacauguucgugaaguggaagguugaguacaucaagacggaggcgaucgucugcguggagcugaccucccaggagcggcagugcagccucaucgaggccggcacuagauucaaccugggccccgugacaaucacccucuccgagccgcggaacauccagcagaagcugccgcccgagaucaucacgcugcaccccaaagucgaggagggguucuucgaccuaaugcacgugcagaaggugcucagcgccuccaccgucugcaagcugcagagcugcacccacggcaucccgggggaccuccagguguaccacaucggcaaccuccuaaagggcgaccgcgugaacgggcaccugauccacaagaucgagccccacuucaacaccuccuggaugagcugggacggcugcgaccucgacuacuacugcaacaugggggacuggcccuccugcacguacaccggcaugacccagcacaaccacgccgccuucgucaaccugcugaacaucgagacagacuacacgaagaccuuccacuuccacagcaagcgggugaccgcgcacggggacacgccccagcucgaccugaaggcccgcccgacguacggcgccggcgagaucaccguccugguggaaguggccgacauggagcuccacaccaagaaggucgagaucuccgggcugaaguucgccagccuggcgugcaccggcugcuacgccugcuccagcgggaucuccugcaaggugcggauccacguggacgagcccgacgagcucacgguccacgugaaguccaacgaccccgaugugaucgccgccuccaccagccugauggcccgcaagcuggaguucggcaccgacagcaccuucaaggcguucuccgcuaugcccaagacgagccucugcuucuacauagccgagcgggaguacugcaaguccugcagcgaggaggacacccagaagugugucgacaccaaacuggaacagccgcaguccauccugaucgagcacaaggggaccaucaucggcaagcagaacgacacgugcaccgccaaggcgagcuguuggcucgaguccgugaaauccuucuucuacggccugaagaacaugcugggguccguguucggcaacuucuucaucgggauccuccuguuccuggcccccuucguccugcucgugcuguuuuucauguucggcuggaagauccuguucugcuuuaagugcugccgccggacccgcgggcuccugaaguacaggcugcucaaggacgacgaggagaccggcuaccgccgcaucaucgagcggcugaacaacaagaagggcaagaaccgccugcucgacggggagcggcuggccgaucgcaagaucgcugagcuguucagcacgaagacccacaucggcuga

SEQ ID NO: 15363 - RNA, 5055 nt, Artificial Sequence
  derived and/or modified CDS sequence (opt11) from CCHFV__KJ648916.1__GP
augcauaucagucugauguacgccauccucugccugcagcugugcggccugggggagacccacgguucccacaacgagacgcgccacaacaagacggacaccaugaccacccccggggacaacccgagcuccgagccgcccgugagcacugcccugaguaucacccuggaccccuccaccgucacccccacgacccccgcguccggccucgagggcagcggcgagguguacaccuccccgcccaucaccacgggcagccugccccuguccgagaccacccccgagcuccccguaacuacggggaccgacacccugagcgccggcgacgucgacccuuccacccagacugccgggggcacuucggccccgaccgugcggacgucccugccgaacagucccuccacgcccagcaccccgcaggacacccaccaccccgugcgcaaccuccuguccguuaccagcccggggcccgacgagacgagcaccccguccggcaccggcaaggaaagcuccgccaccucuucuccucacccuguaucgaaccggcccccgacgccucccgcgaccgcccaggggcccacagagaacgacucccacaaugccaccgagcaccccgagagccugacucaauccgccacgcccggccucaugacgagccccacccagauugugcacccgcaguccgcgacccccauaacgguccaggacacgcaccccagccccaccaacgccuccaaggcaaaccugaagauggagauuauucugacacucagccaggggcugaagaaguacuacggcaagauccugcgccuccugcagcucacgcuugaggaggauaccgagggccugcuggaguggugcaagcggaaccucgggcuggacugcgacgacaccuuuuuccagaagcgcauugaggaguucuucaucaccggcgaagggcacuucaacgagguguuacaguuccggacgccgggaaccuuguccaccaccgagagcacgcccgccgggcuucccaccgccgagccguucaaguccuacuucgcgaagggauuccugagcaucgacuccggcuacuacucggccaagugcuacagugggaccuccaacagcggccuccaguugaucaacaucacccgccacuccacgcggaucguggacaccccggggcccaagaucaccaaccugaagaccaucaacugcaucaaccuaaaagccagcaucuuuaaggagcaccgcgaggucgagaucaacguguugcugccccagguggccgucaaccucuccaacugccacguggugauaaagagccaugucugugacuacucccuggacaucgacggcgccgugcggcugccucacaucuaccacgaggggguguucaucccaggcacguacaagaucgucaucgacaagaagaacaaguugaacgaccgcugcacccuguucaccgacugcgugaucaagggccgggagguacgcaaggggcagagcgucuugcggcaguacaagaccgaaauccgcaucggcaaggcgagcacggggagccggcgccuccugagcgaggagcccagcgacgacugcaucucacggacccagcugcuccgcaccgagaccgccgagauccacggcgauaacuacgggggccccggcgacaagauuacgauaugcaacggaagcaccaucguggaucagcgguuaggauccgagcugggcugcuacaccaucaaccgaguccgcagcuucaagcugugcgaaaauuccgccaccggcaagaacugcgagaucgacagcgugccagugaagugccggcagggcuacugccuccgcaucacgcaggaaggacggggccacgucaagcugagcagaggguccgagguagugcuggacgccugcgacaccagcugcgagaucaugaucccgaagggaaccggggacauccucgucgacugcuccggcggccaacagcacuuccuaaaggacaaccugaucgaccucggcugccccaaaauuccccugcugggcaagauggccaucuacaucugccggaugagcaaccaccccaagaccacgauggcguuccucuucugguucuccuuuggguacgugaucacuugcauccugugcaaggccauauucuaccugcucaucaucgugggcacccuggggaaacgccucaagcaguaccgggagcucaagccgcagaccugcaccaucugcgagacgacccccgucaacgccaucgacgccgagaugcacgaccugaacuguagcuacaacaucugccccuacugcgccucccgccuaaccagcgacggccucgcgcggcacgugauccagugccccaagcgcaaggagaagguggaggagaccgagcuguaccugaaccucgagcggaucccgugggucgugcgcaagcugcuacaaguguccgagagcacgggcgucgccuuaaagcgguccuccuggcugaucgugcugcucgugcuguucaccgucucucugagcccagugcaguccgcccccaucgggcaggguaagacaaucgaggccuaucgcgcucgggagggauacaccagcaucugucucuucgugcugggguccauacuguucaucgucagcugccucaugaaggggcugguugacuccgugggcaauucauuuuucccgggccugagcaucugcaagacaugcuccauuagcuccauaaacggguucgagaucgagagccacaaaugcuacugcucccucuucugcugccccuacugccgccacugcucgaccgacaaggagauccacaagcugcacuuauccaucuguaagaagcggaaaaagggcagcaacgucaugcucgccgugugcaagcucaugugcuuccgcgccaccauggagguguccaaccgggcccuguuuauccgcagcaucaucaacaccacauucguccuaugcauccugaucuuggccgugugcguggucuccaccagcgcgguagagauggagaaccuccccgccgggaccugggagcgcgaggaggaccugacaaacuucugccaccaggagugccagguaacggagaccgagugccuuugucccuacgaggcccucguccugcggaagccguuauuccucgacucaaccgccaagggcaugaagaaucugcugaacagcaccucccucgagacgucucuguccaucgaggcccccuggggcgcgaucaacgugcagagcaccuacaagccaaccgugucuaccgccaacaucgcccugagcuggagcuccgucgagcaccgcgggaacaagauccucgugagcggccggucagagagcaucaugaaacuggaggagcgcacagguaucuccugggaccugggcguggaggacgccucugaguccaagcuccuuaccgucagcgugauggaccugucccagauguacucucccguguucgaguaccucuccggggaccggcaggucggcgaguggccgaaagcgaccugcaccggcgacugccccgagcgcugcgguugcacgagcuccaccugucugcacaaggaguggccccacagccggaacuggaggugcaaccccaccuggugcuggggcguggggaccggcuguacgugcugcggccuggacgugaaggaccucuucaccgacuacauguucgucaaguggaagguggaguacaucaagaccgaggccaucgugugcgucgagcugaccucccaggagagacagugcagccugaucgaggccggcacgcgcuucaaccucggcccggugaccaucacccucucggagccccggaauauucagcagaagcugccgcccgagaucaucaccuugcacccccgcaucgaggagggguucuucgaccugaugcacguacagaaaguccugagcgccucgaccgugugcaagcuccagagcugcacgcacgggguacccggugaucuccagguguaccacaucggcaaccugcugaagggggacaaggugaacggccaccucauccacaagaucgagccccauuucaacaccuccuggauguccugggacggaugcgaccuggacuacuacugcaacaugggcgacuggcccagcugcacuuacacaggcgucacgcagcacaaccacgccuccuucgugaaccucuugaacaucgagaccgacuacaccaaaaacuuccacuuccacagcaagcggguuacggcgcacggggacacgccgcagcuggaccucaaggcccgucccaccuacggagccggcgagaucaccguccuaguggaggucgccgacauggagcugcauaccaagaagaucgagaucuccggccucaaguucgccagccuggcguguacggggugcuacgccugcuccagcgggaucuccugcaagguccggauccacguggacgagcccgacgagcugaccgugcacgucaagagcgacgaccccgacgugguggccgccuccagcucccucauggcccgcaagcuggaguucggcacugacagcaccuuuaaagcguucuccgccaugccgaagacgagcuuauguuucuacaucgucgaacgggagcacugcaaguccugcagcgaggaggacaccaagaagugcgugaacaccaagcucgagcagccccagaguauccucaucgagcacaaggggacgaucaucggcaagcagaauagcacgugcaccgccaaggccagcuguuggcuggaguccgucaagagcuucuucuacggccugaagaacaugcucuccgguauuuucggcaacguguucauggggaucuucuuauuccuggccccuuucauccuccugauuuuauucuucauguucggcuggcgcauccucuucuguuucaagugcugccggcgcacccggggccuguucaaguaccgccaccugaaggacgacgaggaaaccggcuaucggagaaucaucgagaagcucaacaacaagaagggcaagaacaaguugcuggacggggagcgccucgcggaccggcgcauugcggagcuguucagcacgaaaacccacaucggauga

SEQ ID NO: 15364 - RNA, 3495 nt, Artificial Sequence
  derived and/or modified CDS sequence (opt11) from CCHVF(CCHVF 10200)__U39455.2__Gn-NSm-Gc
agcgaggagcccuccgacgacugcgugucccgcacccagcugcuccggacggagacggccgagauccacggcgacaacuacgggggcccgggggacaagaucaccaucugcaacggcuccaccaucgucgaccagcgccuggggucggagcugggcugcuacaccaucaaccgggugcgauccuucaagcucugcgagaacuccgccacgggcaagaacugcgagaucgacuccgugcccgucaagugccggcagggguacugccugcgcaucacccaggaaggccgggggcacgugaagcugagccgcggcuccgaggugguccucgacgcgugcgacaccagcugcgagaucaugauccccaaggggaccggcgacauccugguggacugcuccggcgggcaacagcacuuccugaaggacaaccucauugaccugggcugccccaagaucccgcugcucgggaagauggccaucuacaucugccggaugaguaaccaccccaagacgaccauggccuuccuguucugguucuccuucggcuacgugaucacguguauccugugcaaggcuaucuucuaccuccugaucaucgucggcaccuuggggcgccggcucaagcaguaucgcgagcugaagccccagaccugcaccaucugcgagacuacccccgugaacgccaucgacgcggagaugcacgaccugaacugcagcuacaacaucugcccguacugcgccucccggcucacgagcgacggccuggcccgccacgugauccagugccccaagcggaaggaaaaagucgaggagaccgagcuguaccucaaccuggagcgcauccccuggguggugcggaagcugcuccaggucuccgaguccaccgggguggccuuaaagcgcuccagcuggcugaucgugcuccugguccuguucaccgugagccucucccccgugcagagcgcgccgaucggccaggggaaaacgaucgaggccuaccgggcacgcgagggcuacaccuccaucugccuguucguccugggcagcauccucuucaucguguccugccuuaugaaagggcugguggacagcgucggcaacuccuucuuccccgggcucagcaucuguaagaccuguuccaucagcuccaucaacggcuuugagaucgagucacacaagugcuacugcucccuguucugcugccccuacugccggcacugcagcaccgacaaggagauccacaagcugcaccuuuccaucugcaagaagcgcaagacggggagcaacgugaugcuggccgucugcaagcugaugugcuucagagccaccauggagguguccaaccgggcgcuguucaucagaagcaucaucaacaccaccuucgugcugugcauccugauccucgccgucugcgugguguccacgagcgcugucgagauggagaaccugcccgccggcaccugggagcgggaggaggaccugaccaacuucugccaccaggaaugccaggugaccgagacggagugccugugcccguacgaggcccucgugcugcgcaagccccuguuccucgacagcaccgcaaagggcaugaagaaccuccucaauuccaccagccuggagaccucccugagcaucgaggcccccuggggcgccaucaacguccaguccacguacaagcccaccgugagcaccgccaacaucgcccuguccuggagcuccguggaacaccgggggaacaagauccucgucagcgggcgcuccgagucgaucaugaagcuggaggaacggaccggcaucuccugggaucuggggguggaggacgcgagcgaguccaagcuccugaccgugagcgucauggaccugucccagauguacucuccgguguucgaguaccucagcggcgaccgccagguggaggaguggcccaaggccacgugcaccggcgauugccccgagcggugcgggugcaccuccagcacgugccugcacaaggaguggccccacucccgcaacuggcggugcaauccgaccuggugcuggggcgucgggaccggcuguacgugcugcggccucgacgugaaggaccucuucaccgacuacauguucgugaaguggaaggucgaguacaucaagaccgaggccaucgugugcguggagcugaccagccaggagcgccagugcucccugaucgaggccgggacccgguucaaccucggccccgucaccaucacgcugagcgagcccagaaacauccagcagaagcugcccccggagaucaucacacuccacccccggaucgaggagggguucuuugaccugaugcacgugcagaaggugcuguccgccagcaccgucugcaagcuccaguccugcacccacggcgugcccggggaccuccagguguaccacaucggcaaccugcucaagggcgauaaggucaacgggcaccugauccacaagaucgagccgcauuucaacacgagcuggauguccugggacggcugcgaccucgacuacuacugcaacaugggggacuggcccagcugcaccuacaccggcgugacccagcacaaccacgcguccuucgugaacuuacugaacauugagacggacuacaccaagaacuuccacuuccacagcaagcgcgucacugcccacggggacacgccccaacuggaccucaaggcacggcccaccuacggcgcaggcgagaucaccgugcugguggaggucgcggacauggagcuccacaccaaaaagaucgagaucuccgggcucaaauucgccagccuggccugcaccggcugcuacgccugcuccagcucaaucucgugcaaggugcgcauccacguggacgagccggacgagcugacgguccacgucaagagcgacgaccccgacgugguggccgcguccagcucccucauggcccgaaagcuggaguucgggaccgacagcaccuuuaaggccuucuccgccaugcccaagaccagccugugcuucuacaucguggagcgcgagcacugcaaguccugcagcgaggaggacacgaagaagugcgugaacacaaagcucgagcagccccaguccauccugaucgagcacaagggcaccauuaucgggaagcagaacagcacgugcaccgccaaggcuuccugcuggcuggagagcgucaaauccuucuucuacggccucaagaacaugcugagcggcaucuucgggaacguguucaugggcaucuuccuguuccucgccccguucauccugcucauccucuucuucauguucggguggcggauccuguucugcuucaagugcugccgucgcacccggggccuguucaaguaccgccaccucaaggacgacgaggagaccggguaccggcgcaucaucgagaagcugaacaacaagaagggcaaaaacaagcugcucgacggcgagcgguuagccgacgggcgcaucgccgagcuguucuccaccaagacccacaucggc

SEQ ID NO: 15365 - RNA, 3495 nt, Artificial Sequence
  derived and/or modified CDS sequence (opt11) from CCHVF(CCHVF IbAr10200)__AF467768.2__Gn-NSm-Gc
agcgaggagcccuccgacgacugcaucagccgcacccagcugcuccggaccgagaccgccgagauccacggcgacaacuaugggggcccgggggacaaaaucaccaucugcaacggcuccaccaucguggaccagcgccuggggagcgagcugggcugcuacaccaucaaccggguccgcucauucaagcucugcgagaacagcgccacgggcaagaacugcgagaucgacuccgugcccgugaagugccggcaaggguacugccugcgcauuacccaggagggccgggggcacgugaagcugagccgcggcuccgagguggugcucgacgcgugcgacaccagcugcgagaucaugauccccaaagggaccggcgacauccuggucgacugcuccggcgggcagcagcacuuccugaaggacaaucucaucgaccugggcugccccaagaucccgcugcucgggaagauggccaucuacaucugcaggaugagcaaccaccccaagacgaccauggccuuccuguucugguucuccuucggcuacguuaucacgugcauccugugcaaggccaucuucuaccuccugaucaucgugggcacccuggggaaacgccucaagcaguaccgggagcugaagccccagaccugcaccaucugcgagaccacccccgucaacgccaucgacgcggagaugcacgaccugaacugcagcuacaacaucugcccguacugugccucccgccucacgagcgacggccuggcccggcacgugauccagugccccaagcgcaaggagaagguggaggagaccgagcuguaccucaaccuggagcggauccccugggucgugcgcaagcugcuccagguguccgaaagcaccggggucgcccuuaagcggucgagcuggcugaucgugcuccuggugcuguucaccgucagccucucccccgugcagagcgcgccgaucggccaggggaagacgaucgaggccuacagagcccgggagggcuacaccuccaucugccuguucguucugggcagcauccucuucauuguauccugccugaugaaggggcugguggacagcguuggcaacuccuucuuccccgggcucagcaucugcaagaccugcuccauaagcuccaucaacggcuucgagaucgagagccacaagugcuacugcucccuguucugcugccccuacugccgccacugcucgaccgacaaggagauccacaagcugcaccucuccaucugcaagaagcggaagaaggggagcaacgucaugcuggccguaugcaagcugaugugcuuucgcgccacgauggaggucuccaaccgcgcccucuucauccggagcaucaucaacaccaccuucgugcucugcauccugauccucgccgugugcgucguguccaccagcgccguggagauggagaaccugcccgccgggacgugggagcgcgaggaggaucugaccaacuucugccaccaggagugccaggucaccgagaccgagugucuguguccguacgaggccuuggugcugcggaagccccuguuccucgauagcacagcgaagggcaugaagaaccugcugaacuccaccucucucgagaccucccugagcaucgaggcccccuggggcgccaucaacgugcaguccaccuacaagcccacggucagcaccgccaacaucgcccugucauggucuuccguggagcaccgcgggaacaagauccucgugagcgggcgguccgagagcaucaugaagcuggaggagcgcaccggcaucuccugggaccuggggguggaggacgcgucugaauccaagcuccugacggugagcgugauggaccugucccagauguacagcccggucuucgaguaccucagcggcgaccgccaggugggcgaguggcccaaagcgaccugcacaggggacugccccgagcggugcggcugcaccuccagcacgugccugcacaaggaguggccccacucccggaacuggcggugcaacccgaccuggugcuggggcguggggaccggcugcacgugcugcgggcuggaugucaaggacuuauucaccgacuacauguucgugaaguggaagguggaauacaucaagaccgaggccauagucugcguggagcugaccagccaggagcggcagugcucccugaucgaggccggcacccgcuucaaccucgggcccgugaccaucaccuugagcgagcccaggaacauccagcagaagcugccgccggaaauuaucacgcuccacccccgcaucgaggagggcuucuucgaccugaugcauguccagaaggugcuguccgccagcaccgugugcaagcuccaguccugcacccacgggguccccggcgaccuccaaguguaccacaucggcaaccugcuaaagggggacaaggugaacggccaccugauccacaagaucgagccgcacuucaacaccagcuggauguccugggacgggugcgaccuggacuacuacugcaacaugggcgacuggcccagcugcacguacaccggggucacccagcacaaccacgcguccuucgugaaccuccugaacaucgagaccgacuacacgaagaacuuccacuuccacagcaagcgggugaccgcccacggcgacacgccccagcuggaccucaaggcccgccccaccuacggcgccggggagaucaccguccugguagagguggcggacauggagcugcacaccaagaagaucgagaucucgggccuaaaguucgccagccuggccugcaccgggugcuacgccugcuccagcggcaucuccugcaagguccggauucacguggacgagccggacgagcugaccgugcacgucaagagcgacgaccccgacgugguggccgcgucauccagccucauggcccgcaagcuggaguucggaacugacaguaccuucaaggcguucagcgccaugcccaagaccucccugugcuucuacaucgucgagagagagcacugcaagagcugcuccgaggaggacaccaagaagugcgugaacacuaagcucgagcagccccagagcauccugaucgagcacaagggcaccaucauaggcaagcagaacuccacgugcaccgccaaggcgagcugcuggcuggaguccgucaagagcuucuucuacgggcucaagaacaugcuguccggcaucuucggcaacguguucaugggcaucuuccuguuccuggccccguucauccugcuuauccucuucuucauguucggauggcgcauccuguucugcuucaaaugcugccgccggacccgcggccuguucaaguaccggcaccucaaggacgacgaggagaccggcuaccgccggaucaucgagaagcugaacaacaagaaggggaagaacaagcugcucgacggcgagcgccuggccgaccggcgcaucgccgagcuguucagcaccaagacccacaucggg

SEQ ID NO: 15366 - RNA, 3495 nt, Artificial Sequence
  derived and/or modified CDS sequence (opt11) from CCHVF(CCHVF Turkey-Kelkit06)__GQ337054.1__Gn-NSm-Gc
ucagaagaacccggagacgacugcaucagucgcacccagcuauugcggacggaaacagcugaaauccacgacgacaacuacggcggacccggagacaaaaucaccauauguaacggauccacaauaguugaccagcgccuagggucagagcuaggcugcuacaccauaaaccgcgugaagucauucaaauuauguaaaaacucagccaccggaaagacaugcgaagucgacagcacccccguaaaaugucgccaaggcuucugccucaagaucacccaagaaggacguggucacgucaaacuuucacgaggcuccgaaguaguccucgacgcaugcgacagcucaugcgagguaaugauacccaagggcaccggcgacauacuggucgacugcucaggcggacaacaacacuuccugaaagacaaucuaauagaucuaggcugcccccacauccccuuacugggccggauggcaauauacaucugccgcauguccaaccacccccgcacgaccauggccuucuuauucugguucagcuucggguauguaaucacaugcaucuucugcaaagcucucuuuuacucuuuaauaauuaucgguacauuggggaagaaaauuaaacaguaccgcgaacugaaaccucaaaccugcaccaucugcgagaccgcaccggucaacgcuaucgacgccgaaaugcacgaccucaacugcucauacaacauaugcccguacugcgcuuccaggcuaacaagcgacggccuugcccgccacgucacacagugucccaagcgaaaagagaaagucgaagagaccgagcucuaucuaaaccuugaacguauuccuuggauuguucgaaaacuccuacaagugucagaaagcacgggcgucgcacuaaaaagaucaucuuggcuuauuguacuccugguacuacucacaguuucacucuccccaguccaguccgcccccgucggacacggcaaaaccauugaaaucuaccaaacaagggagggauucgccuccauuugccuauucaugcuagguaguaucuuguucaucguuuccugucuagucaaagggcuaguggacucagucagcgaaucguucuuuccaggacucagcgugugcaaaaccugcagcauaggcucagugaacggcuucgagaucgagucacacaaaugcuacugcucccuauucuguugcccauauugccgacacugcucagcugaccgcgaaauccaccaauuacaccuuucaaucugcaagaaaagaaagaccggguccaacgucaugcucgcagucugcaaacgcaugugcuucagagccaccaucgaggcuucacgacgcgcucuccuaauuagaucgauaauuaacacaaccuuuguaaucugcauacucaccuugaccauuugcguagucuccacaucagcaguugaaauggaaaaccugccagccggaacaugggaacgggaagaagaccucaccaacuucugccaccaggaaugccaaguaacagaaacagaaugccuaugcccauaugaagcccuaguacuccgcaaaccacuguuccuagacagcauuguuaaaggcaugaaaaaucugcucaauuccaccagccucgaaaccucacugagcauagaagcucccuggggagcaauaaacguucaaucuacauucaaacccaccgugucuaccgccaacaucgcacugucaugguccuccguaguucaccggggcaacaaaauccucgucacaggaagaagugaauccauaaugaaacuugaggagcgaaccggcgucucgugggaccucggaguggaagacgccagcgagucgaagcuccucaccgucaguaucauggaccugagccagauguacagccccguauucgaauacuuauccggcgaccgccaaguagaagaguggccaaaggcaaccuguacuggugacugccccgagcgaugcggcugcacuuccuccacaugccuucacaaagaauggucccacucccgcaacuggagaugcaacccaacgugguguuggggcgucgguaccggcugcaccuguugcggcguagacgucaaagaccucuucacggaccacauguucguuaaauggaaggucgaauacaucaagaccgaagcaaucgugugcguggcacuaacaagccaagaacgccaaugcucccucauagaagccggcacccgcuucaaccuuggucccguaacaauaacacucucagagccucggaacauccagcaaaaauuaccaccugaaaucauaacgcuccacccaaaaaucgaggaaggcuucuucgaucucaugcacguacagaaaguacuguccgcaucgacagucugcaagcuacaaucaugcacgcacggcauacccggggaccuccaagucuaccacaucggaaaccuucugaagggcgaccgaguaaacggacauuuaauccacaaaaucgaaagucacuucaauacaagcuggaugucaugggauggaugcgaccuggacuacuacugcaacaugggcgacuggccauccugcacauacaccggagucacccaacacaaccacgccgccuuugucaaucuccugaacauagagacggacuacacaaaaacuuuucacuuucacucuaaacgggugacagcgcacggcgacacaccccaacuugacuuaaaagcucgaccuaccuacggggcaggcggcauaaccguccucgucgaaguagcggacauggaauugcacaccaagaaaguugaaauaucaggacucaaguucgcgucccucgccugcaccggcugcuacgccugcucauccgggauaucaugcaaagugcgcauucacguagacgagccagacgagcuaaccguucauguuaaguccagcgaccccgacgucguagcugcuucaaccagccuaauggcacgaaaacucgaguucggcaccgacucaacuuuuaaagcauucuccgcaaugcccaagaccucgcuauguuucuacaucgucgaacgcgaauacugcaaaagcuguuccgaagaugacacccaaaagugcgucgacacccgccucgaacaaccacaauccauccuaaucgagcacaaaggaaccauaauaggcaaacaaaacgauacgugcaccgcaaaagccuccugcuggcuagaguccgucaaguccuucuucuacggccuuaaaaacaugcuugggucagucuucggcaaccuauuuaucggaauacuucucuuccuagccccauuuguccuacucguccucuucuucauguucggcuggaaaauccuauucugcuucaaaugcugccggcgaacccgugguuuauucaaauaccgccaccugaaagaugacgaggaaaccggauacagacgaaucauagaacgacucaacagcaagaaaggcaaaaaucgccuacucgacggugaccgccucgcagaccgcaaaaucgcggaauuauucuccaccaaaacccacaucggc

SEQ ID NO: 15367 - RNA, 3498 nt, Artificial Sequence
  derived and/or modified CDS sequence (opt11) from CCHVF(CCHVF SR3)__AJ538199.1__Gn-NSm-Gc
agcgaggaauccggugaugacuguaucucgaggacccagcuccuccguaccgagacagccgagguccauggggacaacuacggugggccgggggacaaaaucaccaucugcaacgggucaaccguaguagaccaacgccugggcagcgagcugggcugcuacaccaucaaccgggugcgcucauuuaaguugugcgaaaacagcgcuacgggaaaauccugcgaaaucgauagcauccccgucaagugcaagcagggcuacugccugaaaaucacacaagaggggcggggccacgugaaacugucccgcgggucugaggugguauuggacgugugcgacuccagcugcgaggugaugauccccaagggcacgggugacauacuuguugacugcuccgggggccagcagcauuuccuuaaggauaaccucguggaccuggggugcccuaagauaccauugcucggcaaaauggcgaucuauaucugccggaugagcaaucaucccaagacaacgauggccuuccuguucugguucaguuucggcuacgugaucacgugcauccugugcaaggccaucuucuuccuccugaucaucuucggcacccugggcaagcgcuucaaacaguaucgugaacugaaaccucagaccugcacgaucugcgaaaccacccccgucaacgccauagacgccgagaugcacgaccuaaauugcagcuacaacauuugcccauacugugcgucccgacugacgagcgacgggcucgcgcggcacguaacgcagugcccgcgacggaaggaaaagguggaagagacggaacuuuaccugaaccucgagcgcauccccugggucgugcgaaaacuguuacaaguuuccgagaguacgggcaccguccugaagcgaucguccuggcugaucguccuucuaguauuauucacggucagccuaucccccgugcaaucggcccccaucgggcacggcaaaacgaucgagaccuaccgggugcgcgaggaguacaccaguaucugccucuucguccuaggcagcauccuguucaucguauccuuucucaugaagggguuggucgacggcguugggaauaucuuuuucccagggcuguccguguguaagacaugcuccaucgggagcaucaacggcuucgagaucgaaucccauaaaugcuacugcagccucuucugcugccccuacugucggcauugcagcgccgauggcgagauccaccaacugcaccugaguaucugcaagaagagaaaaaccgggucaaacgucaugcucgcggugugcaagaggaugugcuucagggccacgauggaggugagcaacaaggcccuguucauacgaucgaucaucaacaccacguucguaaugugcauccugaagggcgaguucgccgccgucaagagcauccacccuaucgaaauggaaucccuaccggccggaacuugggagcgggaagaggaccugacgaacuucugccaccaggaaugccaggugacugagacggagugccugugcccguacgaggcuuuggugcuacgccgcccccuguuccuggacagcaucgugaagggaaugaaaaaccuccuaaauagcaccuccuuggagaccagccucuccaucgaggccccauggggcgccaucaacgugcagagcacuuacaagccgacugucuccaccgccaacauugcccugagcugguccucuguggagcaccgcgggaacaaggugcuggucagcggccggagcgaguccaucaugaagcucgaagagaggacagggaucagcugggaucugggaguugaggacgcuuccgagagcaagcuccuaaccguuuccguaauggaccugagccaaauguacagcccgguguucgaguaucugagcggggaccgacagguggaggaguggcccaaggcgaccugcacgggcgacugucccgagagaugcggguguacaagcuccacaugccuucacaaagaguggccccacagccgcaacuggcgcugcaacccgaccuggugcuggggcgucgggaccggguguacguguugcggccuggacgugaaggaccuauuuacggacuacauguucguuaaguggaaggucgaguacaucaagaccgaggccaucgugugcguugaguuaaccucccaggaacggcagugcuccuuaauagaagcggggacccgcuuuaaccugggcuccgugaccaucacgcucagcgagccccggaacauccagcaaaagcucccgccagagauuauaacgcuacaccccaagauagaggagggauucuucgaucucaugcacgugcagaagguacucuccgcuagcaccgucugcaagcugcaguccugcacccacggagugcccggcgaccuccagguguaccauaucgguaaucugcucaagggcgaucgcgugaacgggcaccucauccacaagaucgagcagcauuucaauacgucuuggauguccugggacggcugugaccuggacuacuauugcaauaugggcgacuggccuagcugcacguauaccggggugacacagcauaaccacgccuccuucgucaaucugcucaacaucgagaccgacuacacgaagacuuuccauuuccauagcaagcgggucaccgcccacggcgacacgccccagcuagaucugaaggcccgaccgaccuacggagccggugagaucaccguauuaguugaggucgcagacauggaacugcacaccaagaagaucgaaaucucaggacugaaguucgccggccugacuuguacagggugcuacgccugcagcuccgguauuuccugcaaggugcggauacacguggaugagcccgacgaacugaccguccaugugaaguccgacgaucccgacguugucgccgcgagcagcuccuuaauggcccguaagcucgaguucgguaccgacagcacauuuaaggcauucuccgccaugccaaaaacgucacuguguuuuuacaucguggagcgagaguacugcaaguccugcaauaaggaggacacccagaaaugcgugaacaccaagcuggagcagccccaaagcauauugauagaacacaaggggaccaucaucggcaagcagaacaauacgugcaccgcaaaggcguccuguuggcuugagucgguuaaauccuucuucuacggcuugaagaacaugcuaggcggcaucuucggcaacguauucauaggcaucuucaccuucuuaaccccuuucauccugcuuauccuguuuuucauguucggcuggagaauccuauucugcuucaagugcugccgacguaccagggggcuuuucaaauaucggcacuugaaggaugacgaggagacgggauaccgcaagauaaucgagcggcugaacaacaagaaggggaagaaccgcuugcuggacggcgagcggcuggccgaccgcaagauugccgagcuguuuagcaccaagacccacaucgga

SEQ ID NO: 15368 - RNA, 3498 nt, Artificial Sequence
  derived and/or modified CDS sequence (opt11) from CCHVF(CCHVF UCCR4413)__KY484038.1__Gn-NSm-Gc
agcgaguccagcgccuccggcugcauuagccgcacgcaaaugauuaaguccgagacagccgaaauccacgacgacauauacgggggccccggcgagaaacugacgaucugcaacgguaccaccguggucgaccagaggcucgggagcgagcugggcugcuacaccaucaaccgcaucaagacguacaagcugugugagaacuccguuaaggagaagaccugcgagauagacagcgugccggucaagugccggcagggccucugcuugaagaucacacaggagggucgcggccacgugaagcugucacgggguagcgagaucgugcucgacauaugcgacuccaguugcgagcugaugaucccgaagggcaccggcgacauccugguagauugcuccggcggccagcagcacuuccuccaggacaacuuaguugaccuggggugcccuaacauaccccucuugggcaagguggcgauauacaucugccgcaugucaaaccauccgaagacgacaauggccuuucuguuuugguucuccuuuggguacgucauuaccugcauccucugcaagauccuguucuaucugcucaucaucacaggcacgcuaggcaagaagcugaagcaguaccgggaacucaagccccagaccugcaccaucugcgagagcaccccugugaacgccaucgacgccgagaugcacgaccugaacugcuccuacaacaucugccccuacugcgcuagccgccugacguccgacgggcucauccggcacgugaaccugugucccaagcgcaaggagaaggucgaggagaccgagcucuaccucaaccucgagcggauucccugguucguccgcaaacugcuccaggugucggagucaaccggcguugcgcugaagcgaucaagcuggcuccucauccuggucauccugcucaccguuucuaugagccccguccaguccgcccccaucaaccagcagcgcgccguagaagcauaccaggcgcgggaggguuauacgggcauuugccuauucauccugggguccguccucuucaugacuuccuggcugaccaagggccugaucgacagcaucggcgacuccuucuucccggggcuguucgugugcaagaccugcagcaucggcuccauaaacggguucgagauugagagucaccgcugcuacugcucacuacucugcugccccuacugccggacgugcagcgccgacaaagacucccaccaguugcaccugagcaucugcaagaagaaaaaggccggcucuaacgugaugcuggccgugugcaaaaggaugugcuucaaagccaccaucgaggcguccaaccggguccuucugaucagguccaucaucaacaccaccuucaucauuugcaugcugauacugguggucugcgugaucagcacgagcgccguggaaauggaggaccuccccgccgggaccugggagcgggaggaggaccugacgaacuucugccaccaggagugccaggucacggagacggaaugucugugucccuaugaggccuucguccuccgcaagccgcuguuccuguccagcaucgugaagggcaagaagaacuuacugaacuccgccagccuggaaaccucgcucagcaucgaggcgcccuggggcgccaucaacgcccaguccaccuucaagcccaccaucagcaccgccaacaucgcccugaguuggagcuccgucgagcaccgcgggaacaaggugcugguguccggccgguccgagagcauuaugaagcucgaggagcggaccgggaucuccuggaaccugggugucgaggacgcgagcgagucccggaugcugaccgugagcgugauggaccucagccagauguaccugcccgucuucgaguaccuguccggugaccgccagguggaggaguggcccaaggccaccuguaccggcgacugccccgagcggugcggcugcacgagcuccacaugccuccacaaggaguggccccacagccggaacuggcggugcaaccccaccuggugcuggggugugggcaccggguguacaugcugcggccuggacgucaaagaccuguucaccgacuacauguucgugaaguggaagguggaguacaucaaaaccgaggccaucgucugcguggagcuuaccucccaggagcgccagugcagccugaucgaagcaggcacgcgguucaaccuggggccggugaccaucacucucuccgagccccgcaacauccaacagaagcugcccagcgagauagucaccuuacacccgaaaaucgaagagggcuucuucgaccuaaugcacgugcaaaaggugcuuuccgccagcacggugugcaagcugcaguccugcacccacgggguggcgggcgaccuccagguguaccacgucgggaaccugcugaagggcgacaagaucaacggccacagcauccacaagaucgagccgcaccucaacaccuccuggaugucgugggacgggugcgaccuggauuacuauugcaacaugggcgacuggcccuccugcaccuacacgggcguaacccaacacaaccacgcagccuucgugaacuugcucaacaucgaaaccgacuauaccaagagcuuccauuuccacuccaagcgugucaccgcccauggcgacacgccccagcuggaccugaaggcgcgcccuauguacggggccggcgagaucaccgugcucguggaagucgccgauauggagcugcacagcaagaacaucgagauauccggccuuaaguucgccagccuuaccugcagcggaugcuacgccuguuccagcggcaucuccugcaaggugcgaauacacgucgacgagcccgacgagcuggcgguucacgucaagagcgacgaccuggacgugguggccgccuccagcucccucauggcccgcaagaucgaguucgggaccgauagcaccuuuaaggcguuuuccagcaugcccaaggagucccugugcuucuacaucguggagcgagacuucugcaagagcugcgcugccgaggauacccagaagugcgugaaggccaagcucgagcagccccaguccauccucaucgagcacaagggaaccauaaucgggaaacagaacgacacuugcagcaccaagaccuccugcugguuggagagcuucaaaucuuucuucuacggccucaagaacaugcucagcggaguguucgggagugccaucaugggcauccugcuguuccucgccccguucauccuguugauccucuucuucuucuuuggguggcgcaucuuauucugccugcgguguugcagacggacccgcggucucuucaaguauaagcauauuaaggacgacgaggaggcgggguacaagaagaucaucgagaagcugaacaacaaaaagggagggaccaguaagcugcucgacggggagcgccuugccgaccggaaaaucgcugagcuguucagcaccaaggcccauaucggc

SEQ ID NO: 15369 - RNA, 3495 nt, Artificial Sequence
  derived and/or modified CDS sequence (opt11) from CCHVF(CCHVF 66019)__AB069669.1__Gn-NSm-Gc
agcgaggaguccggcgaugacugcaucagccgcacccagcugcuccggacagagacggccgaggugcacggggacaacuacggcgggcccggcgacaagaucaccaucugcaauggguccaccaucguggaccagcgccugggcuccgagcugggcugcuacaccaucaaccgggugaaguccuucaagcucugcgagaacagcgggacgggcaaguccugcaagaucgacaacaccccggugaagugccggcagggguucugccugaagaucacccaggagggccgggggcacgucaagcugagccgcggcuccgaaguggugcucgacgccugcgacagcuccugcgagaucaugauccccaagggcaccggggacauccuggucgacugcagcggcgggcagcagcacuuccugaaagacaaccuuguggaccugggcugccccaauaucccccugcucggcaagauggcgauuuacaucugccggauguccaaccacccgaagacgaccauggccuuccuguucugguucagcuucggguacgugaucacgugcaucuucugcaagaucaucuucuaccugcucaucgucgugggaaccuuagggaagaaguucaagcaguaccgcgagcugaagccccagaccugcaccaucugcgagaccacucccacgaacgccaucgacgccgagaugcacgaccucaagugcuccuacaacaucuguccuuacugcgccagccggcugaccuccgacggccuggcgcgccacgugacccagugcccgaagcggaaggagaaggucgaggagacggagcucuaccugaaccuggagcgcauccccuggaucgugcggaaguugcuccaggugagcgaguccacgggggucgcccugaagcguagcagcuggcucaucgugcugcuggugcuccugaccgucucccugagccccguucaguccgcccccaucggccacggcaagaccaucgaggccuaccagaccagagaaggguacacgagcgugugccucuucaugcugggcgggauccuguucgucguguccugccucaugaagggccugguggacagcgucuccaacagcuucuucccggggcuguccaucugcaagaccugcagcaucggcuccgugaacggcuucgagaucgagagccacaagugcuacugcucccuccugugcugccuguacugccgccacugcagcgcggaucgggagauccaccagcuccaccuguccaucuguaagaagcgccgggccgggggaaacgucaugcuggccgugugcaagcgcaugugccuccgggccaccauggaggucagcaacaagguccuguucauccgcuccaucaucaacaccacguucgugaucugcauccuggugcucgccgucugcaucgugagcaccuccgcgguggagauggagagccugcccgccgggaccugggagcgcgaggaggaccugaccaacuuuugccaccaggagugccaggucacggagaccgagugccugugccccuacgaggcccucguucugcggaagccccuuuucagcgauuccaucgugaagggcaugaagaaccuccugaacagcaccucacuggagaccagccucuccaucgaggccccguggggcgccaucaauguacagagcacguucaagcccaccguguccaccgcgaacauugcccugagcugguccagcguggagcaccgcgggaauaagauccuggucuccggccggagcgaguccaucaugaagcucgaggagcgcaccgggaucagcugggaccugggcguggaggacgccuccgagagcaagcugcucaccguguccgucauggaccugagccagauguacagccccguguucgaguaccuguccggggaccgccagguggaggaguggcccaaggccacgugcaccggcaacugcccggaccggugcggcugcaccagcuccacgugccuccacaaggaguggccccacagccggaacuggcgcugcaaccccaccuggugcuggggcgucgggaccgggugcacgugcugcggccuggacgugaaggaccuguucaccgacuacauguucgugaaguggaaggucgaguacaucaagaccgaggccaucgugugcguggagcucaacucccaggagcggcagugcagccugaucgaggcggggacccgcuucaaccugggccccgucaccaucacccucuccgagccgcggaacauccagcagaagcugcccagcgagaucauaacgcugcauccccgcaucgaagagggcuucuucgaccucaugcacgugcagaaggugcuguccgcgagcaccgucugcaagcugcaguccugcacccacggggugcccggcgaccuccagaucuaccacaucgggaaccugcugaagggcgaccgggugaacgggcaccucauccacaagaucgagccgcacuucaacaccaguuggauguccugggacggcugcgaucuggacuacuacugcaacaugggcgacuggcccagcugcacguacaccggugucacccagcacaaccacgccgccuucgugaaccugcucaacaucgagaccgacuacacgaagaacuuccacuuccauuccaagcgcgugaccgcccacggcgacacgccccagcuggaccugaaggcgcguccaaccuacggggccggcgagaucaccguccucguggagguggcugacauggagcugcacaccaagaaaaucgcaaucagcgggcugaaguucgcgucccugaccugcaccggcugcuacgccugcagcuccggcaucagcugcaagguccgcauccacguggacgagcccgacgaguugacggugcacgucaagagcgaggaccccgacaucguggccgccuccuccucccugauggcccggaagcucgaguucgggaccgacagcaccuucaaggcguucuccgccaugcccaagaccagccugugcuucuacaucguggagcgcgaguauugcgaguccugcagcaaggaggacacgcagaagugcgucaacaccaagcuggagcaaccgcagucuauccucaucgagcacaagggcaccaucaucgggaagcagaacgacacgugcaccgccaaggccagcugcuggcuggaguccgucaagagcuucuucuacggccugaagaacaugcucuccgggaucuucggcaauguguucauuggcaucuuccuuuuccuggcccccuucauacuccugauccuguucuucauguucggguggcggauccucuucugcuucaagugcugccgccgcacccguggccuguucaaauacagauaccugaaggacgacgaggagagcggguaccggcgcaucaucgaacggcucaacaacaagaagggaaagaauaagcugcuggacggcgagcgccucgcggaccggcgaaucgccgagcuguucuccaccaagacccacaucggg

SEQ ID NO: 15370 - RNA, 3495 nt, Artificial Sequence; identical to SEQ ID NO: 12084
  derived and/or modified CDS sequence (opt11) from CCHVF(CCHVF 7001)__AB069670.1__Gn-NSm-Gc

SEQ ID NO: 15371 - RNA, 3495 nt, Artificial Sequence
  derived and/or modified CDS sequence (opt11) from CCHVF(CCHVF 75024)__AB069671.1__Gn-NSm-Gc
agcgaggaguccggcgacgacugcaucagccgcacccagcugcuccggaccgagacggccgagauccacggagacaacuacggcggacccggcgacaagaucaccaucugcaacggguccaccaucguggaccagcgccugggcagugagaugggcugcuacaccaucaaccgggugaaguccuucaagcugugcgagaacagcgccacgggaaaguccugcgagaucgacagcaucccggugaagugccgccagggcuacugccucaagaucacccaggaggggcggggccacgugaagcugucccgcgguagcgaggucgugcuggacgcgugcgacuccagcugcgaggugaugauccccaaaggcaccggcgacauccucgucgacugcuccgggggccagcagcacuuccugaaggacaaccugaucgaccuggggugccccagcaucccccugcugggcaagauggccauuuacaucugccggauguccaaucacccgaagacaacgauggccuuccucuucugguucucguucggcuacgugauaacgugcauccugugcaaggccaucuucuaucugcucaucaucguggggacccugggcaagcgcuucaagcaguaccgugagcugaagccccagaccugcacaaucugcgagaccacgcccgccaacgcgaucgacgccgagaugcaugaccucaacugcuccuacaacaucugccccuauugcgccagccgccugaccuccgacgggcuggcccggcacgucacgcaaugcccgaagcgcaaggagaagguggaggagaccgagcucuaccugaaccuugagcggaucccgugggugguccgcaagcuccuccagguaagcgagagcaccggcguggcgcugaagcgguccagcuggcucaucguccugcugguccucuucgccaucucccugagccccgugcaguccgcccccaucggucacggaaagaccaucgagacauaccaggcccgcgaggaguacaccagcaucugccuguucguccucgguuccauccuauucaucgugagcugccugaugaaggggcucguggacuccaucggaaacaucuucuucccggggcugagcaucugcaagaccuguuccaucggcagcaucaacggcuuugagaucgagucccacaagugcuacugcagccugcucugcugccccuacugccggcacugcuccgccgaccgcgaaauccaccagcugcaccugagcaucuguaagaagcguaagaccggcuccaacgucaugcucgcggugugcaagcgcaugugcuuccgggccacgauggaggugagcaacaaggcccugcugauccgcuccaucaucaacaccaccuucgucguaugcauccucauccuggccgucugcguggugucaaccagcgccgucgagauggagucccugcccgcgggcacgugggagcgcgaagaggaccucaccaacuucugccaccaggagugccaggugaccgagaccgagugccugugccccuacgaggcccuggugcugcggcgcccccucuuccuggacagcaucguccgggggaugaagaaccagcugaacuccacgagccucgagaccucccugagcaucgaggcccccuggggcgcaaucaacgugcaguccaccuacaagcccaccgugagcacggcuaacaucgcgcuguccuggagcuccguugagcaccgcgggaacaagauccucgugagcggccgguccgagagcaucaugaagcuggaggagcgcaccgggaucuccugggaccuggggguggaggacgccagcgaguccaagcuccugaccgucagcgugauggaccugagccagauguacucccccguguucgaguaccucagcggcgacagacaggucgaggaguggccgaaggcgaccugcaccggggacugccccgagcggugcggcugcacgaccuccacgugccugcacaaggaguggccccacagccggaacuggcgcugcaacccaaccuggugcuggggcguggggaccggcugcacgugcugcggucuggacgugaaggaccucuucaccgacuacaugaucgucaaguggaagguggaguauaucaagacugaggccaucgugugcgucgaacugaccucccaggagcggcagugcagccugaucgaggccggcacccgcuuuaaccucggguccgugaccaucacccuuagcgagccgcggaacauccagcagaagcugccacccgagauaaucacgcuccacccccgcaucgaggagggcuucuucgaccugaugcacgugcagaagguccuguccgccagcaccguaugcaagcuccaauccugcacccacggggugccgggggaucugcaggucuaccaugugggcaaccugcucaagggggacaaggugaacggccaccugauccacaagaucgagccccaccugaacaccagcuggauguccugggacgggugcgaccucgacuacuacugcaacaugggcgacuggcccagcugcacguacaccggggucacccagcacaaccacgccuccuucgugaaccugcugaacaucgagaccgacuacaccaagagcuuccacuuccacuccaagaggguaaccgcccacggcgacaccccgcagcucgaccugaaggcccgccccaccuacggcgcgggggagaucacgguccugguggagguggccgacauggaguucacccccaagaagaucgagaucagcggccucaaguucgccucccugaccugcaccgggugcuacgccugcagcagcggcaucuccugcaagguccggauccacguggacgagcccgaugaguugacggugcacgucaagagcgacgacccggacgugguggccgcguccagcucccucauggcccgcaagcuggaguucgggaccgacagcaccuucaaggcguucuccgccaugcccaagaccagccugugcuucuacaucgucgagcgggaguacugcaaguccugcucgaaggaggacacgcagaagugcgugaacaccaagcucgagcagccccaguccauccugaucgagcacaagggcacgaucaucggcaagcagaacaacacgugcaccgccaaggcgucaugcuggcuggaguccgucaagagcuucuucuacgggcucaagaacaugcuguccggcaucuucgggaaccuguucaugggcaucuuccucuuccuggcccccuucauacugcucauccuguucuucauguucggguggcgcauccucuucugcuucaagugcugccgccgaacccgcggccucuucaaguaccggcaccugaaggacgacgaggagaccggauaccgccggaucaucgagcgccugaacaacaaaaaggggaagaacaagcuccuggacggcgagcggcuggccgaccgccggaucgccgagcuguucagcaccaagacccacaucggg

SEQ ID NO: 15372 - RNA, 3495 nt, Artificial Sequence
  derived and/or modified CDS sequence (opt11) from CCHVF(CCHVF 7803)__AB069672.1__Gn-NSm-Gc
agcgaggaguccggugacgacugcaucagccgaacccagcugcuccggaccgaaacugccgagauccacggggacaacuacggcgggcccggagacaaaaucacgauaugcaacggguccaccaucguggaccagcgccugggcagcgagaugggcugcuacaccaucaaccggguuaaguccuucaagcugugcgagaacagcgccaccgggaaguccugcgagauagacagcaucccggugaaaugucgccagggcuacugccucaagaucacccaggaggggcggggccacgugaagcucucccgugguucagaggucauccuggacgcgugcgacuccucuugcgaggugaugaucccuaagggcaccggcgacauccucguggacugcuccgggggccagcagcacuuccugaaggacaaccugaucgacuuagggugccccagcaucccccugcugggcaagauggccaucuacaucugccggauguccaaccacccuaagaccacgauggcauuccucuucugguucagcuucgguuacgucaucacgugcauccucugcaaggccaucuucuaucugcucaucaucguggggacccugggcaagcgcuucaagcaauaccgggagcugaagccccagaccugcacaaucugcgagaccacccccgccaacgcgaucgacgcugagaugcacgaccucaacugcuccuacaacaucugccccuauugcgccagccgccugacguccgacgggcuggcccggcacgugacucagugcccgaagcgcaaagagaaggucgaggagaccgagcucuaccucaaccuggagcggauccccuggguggugcgcaagcuccugcaggucagcgagagcaccgggguggcgcugaagcgguccucauggcucauaguucugcugguccucuucgcuaucucccugagcccugugcaguccgcccccaucagccacgggaagaccaucgagacguaccaggcccgugaagaguacaccucuaucugccuguucgugcucggcagcauccuguucaucgucuccugccugaugaagggccucgucgacagcaucgggaacaucuucuucccgggcuuauccaucugcaagaccugcagcaucggguccaucaacggcuucgagaucgagagccauaagugcuacuguucccugcucugcugccccuacugccggcacugcagcgccgaccgcgagauccaucaguugcaccuguccauaugcaagaagcggaagacggggaguaacgugaugcuggcggcgugcaaacgcaugugcuuccgggccacgauggaggucuccaacaaggcccugcugauccgcagcaucaucaacaccaccuucgugguguauauucucauccuggccgucugcguggucagcacauccgcgguggagauggagagccugcccgccgggacgugggaacgugaggaggaccucacuaacuucugccaccaggagugccaggugaccgagaccgagugccugugccccuacgaggcccugguccugcggcggccccucuucuuggacucaaucgugcggggcaugaagaacccacugaacagcacgucucucgagaccagcuuauccaucgaggcccccuggggcgccaucaacguacagagcaccuacaagcccaccgucuccacggcaaacaucgcccugucgugguccagcguggagcacagagggaacaagauccucguguccgggcggagcgaauccaucaugaagcuggaggagcgcaccggcaucagcugggaccugggggucgaggacgccuccgagagcaaauuacugaccgugagcguaauggaccugucccaaauguacagcccggucuucgaguaccucucuggcgaccgccagguugaggaguggcccaaggcuaccugcaccggcgauugccccgagcggugcgggugcacgaccagcacgugccugcacaaggaguggccccacucccggaacuggcgcugcaacccgaccuggugcuggggcguggggaccggcugcaccuguuguggucuagacgucaaggaccucuucaccgacuacaugaucgugaaguggaagguggaguacaucaagacccgggggaucgucugcgucgagcugaccagccaagagcgccagugcuccuugaucgaggccggcacccgguucaaccuugggagcguaacuaucacccuguccgagccacgcaacauccagcagaagcugccgcccgagaucaucacguugcacccgcggaucgaggagggauucuucgaccugaugcacguccagaaggugcugagcgccuccaccguuugcaagcuccagagcugcacccacgggguccccggcgaccuccaggucuaccacgugggcaaucuguugaaaggggacaaggucaacggccaccugauccacaagaucgagccccaccugaacaccuccuggaugagcugggacgggugcgaccucgacuacuacugcaacaugggcgacuggccguccugcacguacaccggggugacccagcacaaccacgccagcuucgugaaccugcugaacauagagaccgacuacacgaaguccuuccacuuccacagcaagagagucaccgcccacggcgacacgccccagcucgaccuaaaggcgcggcccaccuacggcgcgggggagaucacggugcugguggagguggccgacauggaguucacccccaagaagaucgagaucuccggccuaaaguucgccagucugaccugcaccgggugcuacgccugcagcuccggcaucuccugcaagguacgcauucacguggacgagccggacgagcugacgguccacgugaaguccgaugacccugacguggucgccgcgagcuccagccuaauggcccggaagcuggaguuugggaccgacuccacguucaaggcuuuuucugccaugcccaaaaccucccugugcuucuacaucguggagcgcgaguacugcaagagcugcuccaaagaggacacgcagaagugcgugaacaccaagcucgagcaaccccagagcauccugauugagcacaagggcaccaucaucggcaagcagaacaauacgugcacggccaaggcguccugcuggcuggagucugucaaguccuucuucuaugggcucaagaacaugcugagcggcaucuucgggaacuucuucaugggcauauuccuguuccucgccccguucauccugcugauccucuucuucauguucggguggcgcaucuuguucugcuucaagugcuguaggcgcacccggggccucuucaaguaccgccaccucaaggacgacgaggagaccggcuaccggcgcaucaucgagcggcucaacaacaagaagggaaagaacaagcuccucgacggcgagcgccuugccgaccgccgcaucgccgagcuguuuuccaccaagacccacaucggg

SEQ ID NO: 15373 - RNA, 3495 nt, Artificial Sequence
  derived and/or modified CDS sequence (opt11) from CCHVF(CCHVF 79121)__AB069673.1__Gn-NSm-Gc
gcugagggcgguagcuccgauuguaucucccgcacccaacucgugaagacagaagucgccgagauccaugaggacuccuacggcgggcccggcgagaagaucacgaucugcaacgggaguacaaucguggaucagggccucggcuccgagcuggggugcuacaccaucaaucgggugcgcagcuacaaacugugcgagaacuccgcgagcggcaagucgugcgagaucgacucaaucccggucaagugcaagcagggguucugccucaaaaucacccaagaggggcgggggcacguuaagcuguccagaggcacggaaaucgugcuggacgugugcgauagcuccugcgagcucaugauucccaagggcaccggggacauuuugguggacugcucgggcgggcaacagcauuuccugcagaacaacuugaucgaccugggcugccccaaugugccccugcuuggcaagauggccauuuacgucugccggaugucaaaccacccgaaaaccaccauggccuuccuguucugguucagcuucggguacguaaucacgugcaucgccugccgagugcuguucuaccuccucaucgcuaucgggaccguugggaagaagcucaagcaguauagggaguugaagccccaaaccuguaucguuugcgagucagugccagucaacgcgaucgacgccgagaugcacgagcugaacugcagcuacaacaucugccccuauugcgcgucccguuugagcacggacggacucauccggcacgugacgcagugcccuaagcgccgggagaagguggaggaaaccgaguuauuccugaaccucgagaggauacccuggcuaguccggaagcugcuccaggugagcgaguccacuggaauggcccugaagcgcucuugcuggaugaucacccugcucauacugcugcucguauccaucagccccguucaguccgcgcccguaggcaaggagcgggccaucgagacguaccaggcccgcgaaaccuacaccggcaucugccuuuucgugcuggggagcguccucuucgcaguguccuggcugacuaaggcccugaucgacggcaucgggaacagcuucuccccgggccucuccguaugcaagacgugcuccaucgggaguaucaacggcuucgagaucgagucccacaagugcuauuguagcuuguucuguugccccuacugcagggcgugcuccagcgacaaaaacacccacagaaugcaccugaaugugugcaagaagcgaaagaugggcuccaacgucaugcucgcagucugcaagcgcaugugcuuccgcgccaccaucgaggcuagcaacaaggcccuacugaucagguccaucaucaauagcaccuucgugaucugcauacucauccugacgaucugcguggugucaaccuccgcgguggacauggagaaccugcccgccggaaucugggaaaaggaggaagaccucaccaauuucugccaucaggagugccaggucaccgagacggagugccuuugcccauacgaggccauggucuugcgcaagccgcuguuccuagacagcaccgcgaagggcaugaaaucccugcuuaacagcaccucccucgagaccagccuguccaucgaggcgccguggggcgcgaucaacguccagagcacguucaagcccacgguguccgccgccaacaucgcccugagcugguccucaguggagcaccgggggaacaagauccuuguguccgggcguagcgagucaaucaugaaauuagaggaacguaccggcgugagcuggaaccugggcguagaggacgccuccgagagcaagaccuuaacggugucggugauggaccugucucagauguacagccccgucuuugaguaccucuccggugaccgccagguggaggaguggccaaaggcgaccuguaccggcgacugccccgagcggugcgggugcacguccuccacgugccuccauaaagaguggccucauagccgcaacuggcguugcaacccgaccuggugcugggguguggggaccgggugcacuugcugcggccuggacguaaaggacuucuucaccgacuacaugcuagugaaguggaagguagaguacaucaagaccgaggcgauugucugcguagaacucaccucacaggagcgccagugcagccugaucgaagcaggcacccgguucaaccugggcccggugaccaucacgcucuccgaaccccgcaacguccagcaacggcuaccgcccgagaucgugacccugcaccccaagaucgaggagggguuuuucgaucucaugcacgugcagaagauccugagcgccuccaccguaugcaagcugcagagcuguacccacggcguccccggcgacuuccagaucuaccauguggggaaccuccugagaggcgacaaggugaacgggcacuccauccacaaaauugaaccccacuucaacacuagcuggauguccugggacggcugcgaucuggauuacuucugcaacaugggggacuggccgagcugcaccuacaccggcgugacccagcacaaucgggcggccuuuauuaauaugcucaacaucgaaacggacuacaccaaaacguuccauuuccacuccaagcgcguaaccgcccacggagacacgccgcaauuagaccugaaggcacgucccgccuacggggcaggagagguuaccgucuugguggagguagccgaccucgagcuccauaccaagaaccucgaggugucagggcugaagaucgccucccugaccuguagcggcuguuaugccuguaguuccgguaucucgugcaaggugcgcauccacgucaacgagcccgacgaguucacugugcacgugcgguccucagacccugacgucguagccgccggcuccagccuuauggcucgcaagaucgaguucggcgccgacuccaccuucaaggccuucagcuccaugcccaaagacagccugugcuucuacaucguggagaaggauuacugcuccagcugcacggacgacgacacccagaaaugcgucaacacgaagcuggaccacccccaauccauacucaucgaacacaaggggaccauuaucggcaagcagaacgacacguguagcaccaagacaucaugcuggcuggagagcgugaagggguucuucuacggccugaagaauaugcucuccgggaucuucggcaacguguuccugggcaucuuccuguuccuugcccccuuuguccugcugaucuucuucuucuucuuuggauggcgccuccuguuuugccuuaagugcugccgccgcacccggggccucuuaaaauacaaacacuugaaggacgaagaagaggcgggguacaagaagaucaucgagcgacucaacggcaaaaagggaaagagccaauuauucgacggggagcgccuggccgaccgcaagauagcugaguuauucuccacgaagauucacaucggc

SEQ ID NO: 15374 - RNA, 3495 nt, Artificial Sequence
  derived and/or modified CDS sequence (opt11) from CCHVF(CCHVF 8402)__AB069674.1__Gn-NSm-Gc
agcgaagaauccggcgacgauugcaucuccagaacccaauuacucaggaccgagacagcggaaauacacaaugacaacuacggcggacccggcgacaagauaacgauaugcaauggaagcacagucgucgaccagcgccugggguccgaauuagggugcuacacaauaaaccggguuaagagcuucaaacugugugaaaacagcgcaaccggcaaaagcugcgaaauagacagcaccccaguuaaaugccgccagggcuucugucuaaaaaucacgcaagaaggccgcggucacguaaaacuuucccgcggcucagaagucguccucgacgcaugcgacagcuccugcgagauaaugaucccuaagggaaccggcgauauccucguggacugcagcggcggucaacaacacuuucucaaggacaaccucaucgaccuuggcugucccaacaucccccuucucggcaagauggcaaucuauauaugccgcaugucaaaccacccgaaaacaacaauggcuuuucucuucugguucuccuucggcuacgucguaacuugcauuuuaugcaaaguaauauucuauuuacucauaguugucggaacacuaggcaagaaauuuaaacaauaccgugaacuaaaaccgcaaacgugcacgauaugcgaaacgacaccagugaacgccaucgacgcagaaaugcacgaucuaaacugcuccuacaacaucuguccauauugcgccagccgccugacgucugauggucucgccaggcacguuaugcaaugcccaaaaaggaaagagaaaaucgaagaaaccgaacucuaccucaaccuagaacgaaucccgugggucguccgaaagcuccuacaaguaucggaaucgacaggaguagcccucaaacgcucaucuuggcucguaguucuccuaguacuccuaacagucucccuaagccccgugcaaucagcacccauaggacacgggaaaacagucgagaccuaucaaacccgagaaggauacacaucgauuugccucuucguccucggcaguaucuuauucaucgucagcugccugaugaagggccuggucgacuccguuggaaacagcuucuuuccgggauuaagcaucugcaaaacaugcuccaucggcucagugaacggauucgagauagaaucucauaaaugcuacugcucucuauucugcugcccguacugccgacacugcucagcagacagagaaauucaccgccuccaccucuccaucugcaagaagcgcaaaacggggucaaacgucaugcuagccguuugcaaacggaugugcuuucgggcaacaguagaaguauccaacaaagcccuacugauccgaaacaucaucaauaccacauucgugcucugcauccuaauacuagcagucugugucgugagcaccucagcgguagaaauggaaagccugcccgccggaaccugggaacgagaggaggaucucacgaacuuuugccaccaggaaugccaaguaacagaaaccgaaugccucugccccuacgaagcgcuaguauuaagaaagccccucuucuccgacucaaucguuaaaggaaugaaaaaucuguuaaauuccacaucccuggaaaccucgcucaguauagaggcuccguggggagccaucaacgugcaauccaccuucaaacccaccguuucagcagccaacaucgcccuaagcuggucaagcguagaacacagagguaacaagauccucgucucugggcgcucggaauccauuaugaaacuggaggaacgaaccggcaucagcugggaccucggggucgaagaugcaagcgaaucaaagcuacucacagugaguguuauggaccugucacaaauguacaguccuguguucgaguaccucucaggcgaccgacaagucgaagaguggccaaaagccacauguacaggcgacugcccugagcggugcggcugcaccaguucuaccugccuccauaaagaauggccacacagccguaacuggcggugcaaccccacguggugcuggggcguagguaccggcugcacaugcugcgggcuagacgucaaggaccuauucaccgacuacauguucaucaaauggaaagucgaauacauuaaaacugaagccauagucugcguagagcucaccucccaagagcgccaaugcacccugaucgaggcaggcacacgcuucaaccugggcccaguaaccauaacacucuccgaaccccgaaacauccaacaaaaacuaccacccgaaaucguaacccuacacccccgcauagaagaaggcuucuucgaccuaaugcacgugcaaaaaguccuaagcgcaucuaccgugugcaaacugcaaucaugcacacacggaguucccggagaccugcagguauaccacauaggaaaucuccuuaaaggagauaaagucaacggccaccucauacacaaaauugaaccccacuucaacaccucguggaugucuugggacggaugcgaucuagacuacuacugcaacaugggagacuggcccagcugcacauacacaggcguaacccaacauaaccacgccgcauucguaaacaugcuaaacaucgaaaccgacuacaccaagaacuuccacuuccacagcaaacgcgugaccgcucacggggacacaccccaacuggaccuaaaagcccgacccaccuacggagcuggcgaaauaaccgugcucgucgaggucgccgacauggagcugcauacaaagaaaauagaaaucucaggccucaaauucgccagcuugacuugcacgggcugcuacgcaugcuccuccggaaucuccugcaaaguaagaauccacgucgacgaacccgacgaacugacagugcacgucaaaagugaggauccugacaucguagcagccuccucuucgcucauggcacgaaaacuggaauuugguacagacucgacguucaaagccuucucagccaugccuaaaacaucccuaugcuuuuauauaguggaacgcgaauacugcaaaagcugcuccaaagaagacacccaaaaaugcguaaacacgaaacuggaacaaccccaaaguauacugaucgaacacaaaggaacaauaauaggcaaacaguccaacacuugcaccgcaaaggccuccugcuggcuagaaaguguaaaaucguuuuucuauggccucaaaaacaugcuauccggcaucuuuggaaacgucuucaucggcgucuuccucuucuuugcccccuuuauccuucucauccuauucuucauguucggauggcgcauacucuuuugcuucaaaugcugccgcagaaccagaggcuuauucaaauaccgccaucucaaagacgacgaagaaacagguuaccgcaagaucaucgagagauuaaacaauaagaagggcaaaaacaaacuacucgacggcgaacgacucgccgaccggaaaauugcagagcuguucucaacuaaaacacacauaggg
